United States Patent 11,913,074 (METHODS FOR ASSESSING RISK OF DEVELOPING A VIRAL DISEASE USING A GENETIC TEST) - sequence listing, part 15

SEQ ID NO: 1568 - DNA, 48473 bp, Homo sapiens
  source 1..48473: mol_type = genomic DNA
gtgctctgagtttttggtttctgtttcaccttgtgtctgagctggtctgaaggctggttgttcagactgagcttcctgcctgcctgtaccccgccaacagcttcagaagaaggtgactggtggctgcctgaggaataccagtgggcaagagaattagcatttctggagcatctgctgtctgtgagattaagcactatgtatattgctttattcactccccacagcaaccttaccaagcagttcttttccacgtgaaaagatggaggctgggtggagcaaaaggaggtatttagagtcctcagcaagtgagaggcagagctgggatttgaatccagatctgcctgatactgaagtctaggctggttccacctctccggactgctttccagggagtagaagacagatattttaccttagctggctgcttctagaagtctgaccctgctggctcaaaacgactttagttccttgcccagaggctgcgggctgcgggtcaagacatcagtagaaggagggcccagccagagaggctgacatgggcttctactcaccgtcatctctccttccttccaggagcagcccctgggtgcgtccactttctgggcacgtgaggttgggccttggccgcctgagcccttgagttggtcacttgaaccttgggaatattgaggtaagcctgggatttccagaggaggtttgggggaaagagaagtggtgaacgctattactgttccctatctagacaccagtgggccgagtggagcagatgccagttgggaccttcccgccctctctttggttattaatccattattgttccctgtacactggtatgagtggatgggggaagtatttagccaagtttttgagacctgtactcggagctaaaatgcattgtcttcctatagtgcgggaccccacaactgtggaggagccgcaggggatactgggtagtacgcagacattatgcactaaatgacaatggctcacatagtgaaaagttattcttttttatttttttttttgagagggagtcttgctctgtcgcctagcctggagtgcagtggcgcgatctcagctcactgatatctccgcctcccgggttcaggtgattctcgtgtctcagcctcctgagtagctgggattacaggcacctgcttccatgcctggctaatttttttttttgtatttttagtagagatgggggggtctcaccatgttggccaggctggtctcaaacttctggccccaagtgatctacccaccttggcctcccaaagtgctgggattacaggcctgagccactgcacccggctgatttcacatttttagataatatgaccacattataaaaatttatgtatttttatataatgtgaccactagatgaaagcaatatacttaggcttttatttcttggttaagttcctacttattatgaatttactctgcatgccaggaattctaagaatttgcatgtattaactcatttgattctcgtaataaccttcacatgcaggagtcactattacagtgactgtatgaatgaggaaagaaaggcactaacagaattgattttatgttacttaggtcaagattttatgttatttaggtcaaggttaattgtgttgttcaaatcttgtataactctactgcttgtctgtctttcttacccattatcgagaagggaacataaaaatcttacactatgactgtagattgtcaatttctcattttaaattaggatcatttttcctttatgtctgccttatgtgatattagtataatgatatcagttggtacatctttttccatccttatactttcagtgtttcggtgttcttatacttgaaatgtgtctgccgtaagtggtgtattgttcaagtttttcttttattatagaaaaatgtattctggaaggtacttttcttaaaattacagtatttagtccattttcatttaatgtaattgtcaatataattgggctaaaatctactatatttccagttgttttttattcgtggcatcaattcacttttctctactttcttgatttcttttagacgaattaagtaattttagaaagttcaccttactcctttattagcttgttaattatgcatgcttttagtattctcttagtaattgcacttgagttgtactacctaatagtacagccacatgttgtttaaaacagctttactgagatatgattgatatacaacaaatggcatataaagtatataatttgataagttttgacatatgtatgacatatatgacagtcatatagacacactcatatatatattcatgtgccatttcagtcaatgaccgaccacatatatgatggtggtctcataagattataatacggtatttttactgtaccatttctatgtttagatatatttagatatgcaaatacttaccattgtgttacaattgcctacaatattcaatacagtaacatgctttgtaggtctgcatcttaggagtaatagtctagaccatatagcctaggtgtgtagtaggctataccatctaggttttgcataagtacattctatgatgttggcataatgacgaaatcactgacgatgcttttcttggaacttatgcctgtcattaagtgacgtatgactgtatatatttgagtggaactatcactgcagtcaggatagtgaacatatatattacctccaaaatatttcgtatgccctcttgaatcctgtcctcctgcccctccccacccctgctccttttaggcatttagttctgtaaattttctcctagccttgctttagcggcatcccatgcattttgatattttgttttgattttaatttaattcaatactacataatttccttttgatttcttttttgacccatggattatttagagttgtgttatttcatttccaaatatttggggattttccagacatgtttctgttgtccaggccaataacaaattcctgacgccatgaagtcaaagatctaactccccagggggagagttatgcccaagaaccatcggtattttgtgttagtggtcattgccagagtgaattccacagtgtttgtgataaaccctaataattccaccagagggcagcaagccaacatgaaaattctattaaaaagtctttttttagagacaagagtttggctctgccgcccaggctggagtgcagtggtgtgacctcggcttaccgaaccctggccccaccgcagactcaacctcccaggctcaagtgattctcccacttcagctccccatctgcgagtagctggaatataggtgcgcaccaccgcacctagttaatttttgcattttttgtagagatggagtttcatcatgtttcccaggcttgtcttgaactcctgggctcaagctatccatctgcctcggctgcccaaagtgccgagatgacaggcgtgggccactgtgcctggccagacagaagttttcaagtaaagaataaatttagctgaagagcagtgtcaaattatttctatccccaccctcctgaattaaatcttcgtagtctctgattctctttgtcatattcttaaccatttggattcttttcagtgcgtctgtgtttgttccttttccccagtatgacccctttctatttttttttttttttttttttttgagacagagtcttgctgtgtcgcccaggctggagtgcagtggcacgttcttggctcactgcaacctccgcctcccaggttcaaaagattctcccacctcagcctcctgagtagctgggattacagatgcctgccaccttgcccagataatttttgtatttttagtagagatggggtttcaacatgttagccaggctggtctcaaacttttgacctcaagtgatctgcccgcctcggcttcccaaagtgctgggattacaggcgtgagccaccttgtccagacccttttctctatctttatgaaaacatctctccagtagatcttcagagtaaaaaaaaaaaaaaaaaaaggaaaaaagaaaagaaaaaagaaaaagaaaagaaaacatccagcaaggtctcggaggaaaaatagaaaattagaagactggagtgagtcatgttgattttctggtgtaaaatttgtatcgaaaccttacataaatactgaagaattcacaagttgtaaatatacagcttggtgactgattttgatatccagacagtttttttcccacttgcacacactccccgcaagaatgcatgctggtttgtaaagtcattaatttactggtgcatcagtggatggctctgtgtcttctggctttatcttggcccagaaagacaggaattaacgttgagcctagtagtctttggcctttgtgccaaagcagtctgtgggccagccttgtgtagtgatcaagcagtatgtttagatgtcaggcatgacacgggttaaaaagccagctaggggaaaaatgggaagtggcattttgcgatctcatcaaacaatcttgatataaacttagagaacaacctcttggcaaatggagagcagctgtaggtttctgactgaatgtgcaagaagaacgtgaatgaaagagatatactaggtgggagcagtcagggtagacttcctggaggaagtggacagtgttgtgtggattcacactttggagatatcaaagaggaagagtattccaagtgggggtaacaaataacaagggaggcaaaaaagaaaagtatgagggaacaacaggatgttgtcaggaaactaaggctgagctgaaatccaggtgacccagagaagccttgagaaggcttgtggcatcttgtggagcaagtggggaacttgctctgtttgagagaatatgcctggaatatatgggatatcatttaaattttctaaaggttatctacaagataatttcagagaatattcgctcccacctcagcgtaggaaacaatgaaaccctgaaacatttatttatttattttccttgcttttcttttttctttcttttttttttcttgagatggagtcttactctgtcactcaggctggagtgcagtggcgtaatcttggctcactgcaacctccgcctcctgggttcaagcaattctcctgcctcagcctcccgagtagctgggacaataggcatgtgccgctatgcctggctaattttttgtatttttagtagagacggggtttcatcatgttggccagactggtcttgaactcctggcctcaagtaatctgcccgctttgggcttcaaaagtgctaggattacaggtgtgagccactgcacccagtcttttccttactttttattttatttatttatttatttattttttaattgatcattcttgggtgtttctcacagaggaggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccattcaaccctgagtggatacagcacatgtttcagagagcacagggttgggggtaaggtcacagatctacaggatcccaaggcagaagaatttttcttagtatagaacaaaatgaaaagtctcccatgtctacctctctctacacagacacggcaaccatccaatttctcaatcttttccccacctttcccccctttctgttccacaaaaccgccattgtcatcatggcccgttctcaatgagctgctgggtacacctcccagacggggtggtggccgggcagaggggctcctcacctcccagtaggggcggccgggcagaggcgcccctcatctcccagacggggcggctggccgggcggggggctgaccccccacctccctcccggacggggcggcttccttactttttaaaaatacgtttgtcttcaactattggatatcttcatctaatttctagtgttttttttggttgttgttggcttatttgatttttactttttggttaataacaaaccttttaaggagttacatagactcttatcagtttacttttctaatttgttttctcctgaattctcagttaccttggattgattgtgctttgggttcatcttgctttttcttagtggctactttcagtttccttcctcttcagtttggcaattttttcccttttcaagcaaggagctcctccctgttgaggcgtcacgggtggcgggcaatccttacccggatcctcccacagcttgctctctggaagctcacactgcaccgtaattatgaaacttttgatattgtccctgatggcttctgatgcaagctgggacagcatttgtctgttgataagtgaaaccaagttcctgagatctggctctcttttgcccttctatccaataccagcaaggccctagtttcagagcattttggggacttatgatcccttctagttacctctgcatctgtgccccttttcccctcaaattagttcatagagatttttgaagcacccatgttactcaaataggcccatttttagcatgtgggaggtaaggcctagatgtgaatccctcataagccaggcagatcaaactgtgtgtatgcatgcagatttggcccaggaacactcttctccttcagggcccattgtctacaaggacagaaaagaattcttaaggccattcactatctcacattttctgttatttttctgtcttttccttttccccctacccacagagaaacattagaatcattgccctttagaagagcagaactatgatgcctcctgtcagggatggaacgaggcattccatgcagatgacaacccaaagagagcaagagtggctctatttatatcagacaaaatcgactttaagtcaaaaactgtcacaagagacattaaagtatattatataatgaaaaaagcatcaatccaccatgaagatataacaattataaatatatgcactcaatatcagagcacctaaatatatgaaacaaacaatgacagaactgaagggagaaatagccagccatacaaaaatagtaggagacttcaacactgtactttaaataatggatagaacattcagacagaagattaataaggaaacaggggacttaaacaacattatagaccaaatggaccgaacagaaatacacagaacgttccaccctacagcagtagaacacacattatcctcaaatgcacatggaactttctccaaggtagatcacaagttgggtcacaaaacaagtctttgcaaatttaagagactgaaatcataccatgtatcttttctgaccatgatggaatgaaactaaaaatcaatggcagaaggaaaaatagaaagttcacaaatatgtggaaattaaacaacacactcttgaacaacaattaggccataaaaataaaaaaagaaattaggaaatatcttgagataaatgaaaagaaaagcacaacatacccaaacttacaggataaaagcagtactaagcaaagaagtactaagaggtactttattgcaatacacatctgcagtgaaaaagaagaaagatctcaagtaaatagtctaacttcgtgcctcaaggagaggagaagaagatgaagaagaagaggaactaagcctaaaattagtgaaggaaataacaaagattagagtaggaaccaagaaaatacagaatagaaaagcaatagaaaaaaaatcaacaaattttttgaaaagaataacaaaagaattggttttttgaaaagataaacaaaatcaacaaatccctagttaggctaagtaagaaagagagaagactcaaataaacaatatcagaaataaaagaggagacattacaactgatgccacagaaataaaaacatgaggctataatgaacaattctattccaacaaactggataatctagaagaaatgaataaattcacaaaaccttccaatctacgatgactgaatcatgaagaaatacaaagtctgaacagacttataactaatgtggaggtttagtcaataatcaaaaatgttccccaaacgaagaagtccaggaccagatggcttcacaggtgaattcttccaaacatctcaagaagaattaatgccagttcttcttaaactatttttaaaaattgaagaagagggcacacttccaaatttattttatgtggccaacattatcccgataccaaagccaaacaaagacaccacaagaaatgaaaactgcaggtcaatatctctgatgaatatacatataaaaactcataacaaaatactagcaaatcaaattcaacagtacatttaaatgatcgtacatcctgactgagtggcatttatccctaggatacaagtatggatcaacatacaaaaataaatcagtgcgaaatggcctattaacagggcaaagatataaagataacatgatcatctcaatagatgcagagaaagcatttgacaaaattcaataccctttcgtgattaaacaatttttcaacaaactggaaatagagtctcaacatcatcaagaccatatataagaaaattttcactgttgagtattatattagatgtgagcttttcatatatgggattcataatatgtttcaaatatattacaaagctatagtaattgaaacagcatgggaatagcataaagacaaacacataggccatcagaagagaagagagagctcagaaataaatccatgcatatacagtgccttagtccattcagcctgctaaaacaaaataccatagactggtggcttataaaacacagaaatttatttttcacagttctggaggctaggaaattcaagatcaagtagctagcagatttgctatctagtgagggcctgcttcttggttcataaatggccatcttctccatgtgtcctcatggaattagggtgatggagcgctctgggatttcttttataaggcactagtcccattcataagtgctctaccttcatgacctaatcacctcccaaaggtcccatctccaaataccaacacataggggattaggtttcaacatatgaattttaggggaaacaaacatcagtctattgcatatactacctaaagcaatctacaaatttggtgtgatctctattaacatcccaatggattttttttttacagaaaaaaacctctgaagtataaaaaggaccacaaatagctaaatcagttttgaggaagaacaaagctagaagcaccatacttcctgatttctaaatatattatactcccatggtcatagcagcactatttacagtagccaagatgtgcaaacaacctaaatatctaggatggggaaagaaaatgtggtagtcacataaaatggaatattatttgccttataaaggagggaaattctataatataagacaacatggatgaatcttgaagacattatgctaagtgaaataagccagtcaccaaaagacaaatactgtatgattctacttacatgtggtatctaaagtagtcaaatttatagaatcaaagagtggaatggtggttgccaggggctggggaggggggaaatgagttgcctgtcaacaagcataaagttttagttaagcaagatgagtaagttctagagatctgctgtacaacattgtacctatagtcaacaatactgtattgtacacttaaacatttgctaagagggtagatctcacttaaatgttcttactacaataaaatataattgataaagcaatagaaaaggattcctatacataggattcctatacataaaaaggtcaatacctaatttccatttaattaaaagcaatgaatagtcaatttacacacaagacaatttctgttattgaggcagctataggatatagaagagatttcccaactcactttgcaaggtgcacatagccttgaatccacaagcataatgtaaataatttacttttaagaaactcagacagaaaaatcctataatcatctcaaaagatcctgacatttctttttgataatttaatgcccctttctgatttttgtcaaatactaggaagctaataggtaaggaaaagtccctaacttgataaaaatacctaccagatgcccaaatcaaaaatcatatgaattaggaagttctggagtgcttctcattaaactcaggaacgtgtaatatcgttattaatgtattgttccaccctgttttggagggcctggccaatttaacaagttaggtgatttgataagttagtttaatacgcataacagcatggctgtcccgaggcatacaggaggcgatgggctgagtcctgactgcagctcccccaaggacctgccacgcatggattatacacaaagtctgttcaagtctgttgagggagtgaagggtcggggggcagcaatcccctgtttggcctgccaggtaaagcctttgtaattgctaatggctgggcctgacagattacacataggattttggcctggagcccaaataattcctaaactccatcctttgatttttcagagcccaagcgagaaacataggctaccccatcatggacctgaatgggttggattttgagggtctctgttaggagccaggttattagtctgcagttacaataaatagaccatggtcaggatcaagatcacttccagcatcgtgtacagattaatatgcctggggtagcttaggtaccagaaaaatccatgtttacagaaatgtttgtttgcagcattcagtggcacaggaacaaaatatttatttgtggggatacatccagcattttgtcaaattcactggggaactgcctgggacaggcatatcaatgaatttagtgacttggaagtcacacagtctattctgtaggagagagagaaggaaggttagattcccacttctccctcctctgtaccctggctcatgggttcataggcgctcacgttgggggaattttccccaaccactgtgacatgggtaagggtagcatcttccgactatcctccagggaggtgggctgtaatctggcctggatcctctgatgactaaaaaaaaaagtttctcttctgtacattgatatccatcccttgaaaataaccaggcaaagcaacaaagccactttatggaaaacattgaattagaagcctcaagttgatagtgattattttttgcaggcaaaaaaatccatgctcagcaccaaagggataactgatgaagagggttactgtctctcatgctttgttttttaatagctaatctaatctctcacctatctgagtctttagaaaggaattgaagggggtggggggcccttgtagggttccccagagagactgaggctgtgcaataaaaggaagcaggtagacagtctgatcaaatatgcagcgcaaatgatgactgcccctttgaggaatgccacactgggaccccagactgttcccctgagatgcatagtccaggccgaggttcttttattccctcctgtcagtcacttaaccctgtccttcaattgtctactaaaacactcaatcatccctgctgcttggaggcgatagagagcatagggcgtccatcatatatgccccatgcttgggcccattgatgtgtggcttgggccacaaatctggggccattatcagatgcattctatgcctgggaatcaaccatctaagatctgaaattgtgtcaccgattgattgacctgacctcacaaggaggttttttatttgtttttgtttttttttttgagacagagtctcactctgtcacccaggttggagtgcagtggctcaatctcactgctacttccatctcccaggttcaagtgattcttatgcctcagcctcccgagtagctggaattacagacacgcaccaccatgcctggctaatttttgtatttttagtacagacagggtttcaccatgttggctagcctggtctcgaactcctaacttcaagtgatccgcccacctcggcctcccaaagtgttgggattacaggcgtgagccactgtccccagccactggacttgataaccatccggagtatcatgaacaaagctagaaatctgagtctggttgcaacctcatcatctgctgcttccacttccttatcatagacccaggggaccaccagtgtagcctgccacggctccaggtttggagtgaggcgtaggttccaggcagctcctgttgaccctgctgctgcaggccaggtcagctgtccttgcccaggtgtgaatcatgggcatgtatctccctgctgggcttccgctttgctgccctttcctggccctttggccagagagagcaggcttttctttctgttgcttttccttgtttgttcttttttttttttttttttttgagacggagtttcgctcttgttgcccagactggagtgcaatggtgcaatctcggctcaccgcaacctctacctcccaggttcaagcaattctcctgcctcagcctcccaagtagctgggattacaggcatgtgccaccatgcccggctaattttgtatttttagtagagacggggtttctccatgttgaggctggtctcgaactcccaacctcaggtgatctgcctgccttggcctcccaaagtgctgggattacaggcgtgagccactgggcccagccatttgttctttctaatttaggcctgttggtggttctggattgcaggcctctttcgttttcagtctggcatgtgtgggaataaaaagacagcccagggcacaaaacagggtgttgttcctgcctctgggtcccccgccagtctgcctctactttccacctctcagggttgtgtgattgtctgttgatttattcccagggtatttaggtgtccttagaggggagaagcagggaaaagtgaatctatgccatcgtgtctcggaactggaagtccacccccatccccacacacactagaattgcagaagaaaaataagatgagaacttgagtgaaaaaaacatattattatgcaatcatcaaatgtttggacagaaagtgttcttagacaacctctagtctaatttctcacatttggaaatctggaagttggactaagacctgaatcgaccaccctcacccccagttcagctgactgactccccagcctgtattctcaccattccacaccaggatctgtcctgaggctttgaaaaaatgtgaactgcatgtcctgctcagatcccaaccctcccacaccactttgctaagagtctgttctgtctgcaaaaatcccaaaagttgtgtcaactggaacgcaaaatgttcttcatttgactttcattgttttttggaattttggggggccagggaggagcaagaaaggagctgcaattgcccttgggtaagatttgcttagaattttaggaagaagttgtctgggcacagtggcttactcctgtaatcccagcactttgggaggccgaggtgggtggatcacgagatcaggagttcaagaccagcctggccaagatggtgaaaccctgtctctactaaaaatacaaaaactagctgggtgcagtggcaggcgcctgtattctgctagggagctgaggcaggagaattgcttgagctggcggggtggaggttgcagtgaaccaagatcacaccactgcactccaggctgggcggcagagtgagactgtctgtctcaaaaaaaaaaaaaaaaaaaaaaaaagaagaattttaggaagaaatctatctgattctagaattatctaggctgttgaggatgtgtgtctggtggccactgggacatcagggtgagacttttcttttaactgcatgtatgtgaattaggttgcttctggagcctactgagagctcactgggtccccatagcatccatgctgaaggcgccttccttctgtctgtgaccttgaccctcagctccacatttccccaggggctgcaggatttctcagaatcctcattagcacaacctatttttttttttttttttcctgaaacagagcctcactctgttgcccaatgcagtggtgtgatctcggctcactgcaacctctgcctcccaggttcaagtgattctcatgcctcagcctcccaagtagctgggactacaagcgtgtgccaccattcctggctaattcttgtatttttttttgagatggagtctcgctctgttgcccaggctggagtgcagtggtgcgatctcggctcactgcaacctccacctcccgggttcaagggattctcctgcctcagcctcccgagtagctgggactacaggtgcccgccaccacacctggctaattttttgtatttttagtggagacagcgtttcactgttttagccaggatagtctcgatctcctgacctcgtgatccgcccgccttggcctcccaaagtgctgggattacaggcgtgagccactgcgcccggccaacttttgtatttttagtagagatgggggtctcactatgtttgtcaggctggtcttggactcctggcctcaagtgatccacctgcctcagcctcccaaattggtaggattacaggtgtgagtcactgtgcctggacagcaccacctattagtgaatgacagccttgacttttgaggctaaaactttccacttctttagtatagtaattaaatctctcgctttttctactatttcggtaattaagcaggtaaagaaaaatatccagaacaatataatagggagtagggcaagaaaatcctgaggaaccacgacctgtgggtggatcgagtgcaggggtccttgagtgtagctggttgcaggaaggccccagcagaagggggctttgatgagcatccaccttgtgtaccgagtgaatgtccgtccagatgaggtgcggatgcagctgacaatggaggcgactgtaatggactatcccaagtagcaacatcatcaatttaggttttcagcctgagtgagactttcagttaatactcaactgaaaacaagatgcaaattttccttcagaaatttgttgaaagtgttttcactttggtactattgatctattaaagggctgagatgcagaggagacaccattgtgtaatttctagtggccgctctttttgtccgttatctgttcactgttctatccatgctgttctgccacacccctttttcacttaccaacacatgttggagattgctctctatcatagcatttcctctcctattctctagcctgcctcttcactctcttaatggtatcatttttctgaaaagaagctcttaattctaaaatggtcctgttggtggttttttccccttatggtcagcactttttgtgtcctttttgagtttttgtctactccaatatcataaagacattctcttaggatttctcataaagttttactgcttccttcttttttgagagagtcttactctgttgcccaggctggagtgcagtgctgcgatcttggctcactacaacctctgcctcctgggttcaagcaattctcatgactcagcctcctgagtagctgggactacaggtgccccccaccatgcccagccaatttttgtatttttagtagaggtgggggtcttgccatgttggtcaggctagtcttcaactcctgacctcaggtgatccacctgccttggcctcccaaagtgctgggattataggtgtgagccaccacgccctggtcaattgcttcctttttatatttagattgactatccatctggatttgaattttgtgtgggtaggaaatcaaggctcattttatttttatatggctatcttgttgatctgtcgttatttactataaagacgatccttttttcacttcacctcattgtcacctttacccatgtatcaagtgagaatagagtgtgagactttaaaaaattaatggattattttttaagaacagtttcaggtttagagaaaaaacagagcagattagctgggcatggtggtatgcacctgtagtcccagcttattcatatgcttatttgccatctgcgtatctttttgtgaggtgtctgttcagacctcttgcccacttttcaatcgggttgttttcttattgttgagtcttaacagattagcttaatcagattggcttcgggaggctaaggcgagaggatcgcttgagcgcgggaggcggaggttgcagtgagttgagatcacaccactgcactctagcctaggtgacagagagagaccctgtctcagaaagaaaaaaaaagaaagagcagaaagtagagagttcccatataccctctgcctcctacacttctcccctccccacactttcccgttattaacatcttgcattagtgtggtacatttgttacaagtgatgaaccaatattgatattgtaggggagggcaaatctgttttccttctacccttctaagttcatggctgagaaccctataacagaagacagattaataagagaaaagtgcataaacatatttaagttttatgtgacatggaagcctttataaggaaatgaagactccaagaagcagttacagtttgatgtaggtttgataaagggtggacagttgtggaggatatgatagagcaaagagtttgaagtaagtgtagtccgctggcagaagcttatcaaggcccgtttgtttagttagattcctctctgtgtccctttgtcttcacagataccaccaggtatagggagggcatctctcacctgagggtcttatgacctggcttcaggagaaggtcagaaaacccttcctgcacatgctgcttttgcaaattccttcaccttaaaatattcaatatgtcattgtgttagtctgttcttgcattgctctaaagagatacctgaggttgggcaatctataaagaaaagagttttaattggctcatggttccacagactgtataggaagcatgatgctggcatctgcttggcttctggggaggcctcaggaaacttacaattatggtggaagacaaagggggagcgagacatctcatgtggctagagcaggggaagcaagagagcggggaggtgccacatatttttaaacaaccagaatatcatgagaattctatcatgcaaacagcactgtggggatggtgctaaactattagaaaccacccccaagatccaatcacctcccaccaggctccgcctccaacattaggaattacaactggacatgagtttgggtgaggacacaaatccaaaccatgtcagtcgtggtgccatattttgtggtagcacgtcctgaatcccatcaataaattattctgaactaaagttccatagtttccattagggttcacttttggtgtacatcctaccggttttgccaaatgaataatgccatgtagaaccgttacaatattgtacagaataatttcactcccctaaaaatcccctgtgctgaacctattcacacttcctcccctgagtccctggcaaccactgtctctatagttttaatcagaatgtcacatagttggaatcatacagtatgtagcctctccagattgccttctttcacatagtaacattcaattaaggctcttccatgcctttgcgtggtttgatagctcatttctttttattgctgaataataatctatggtatggatgtgccacagtttatccattcatttattgagggacatcttggttgcttccaacttttggcagttatgaattatgaataaagctggtataaacattcatgtgcaggtttttgcatggacataaatgttcaatttgggtaaatatctagaaacgtgattgctggatcttgcggtaagcatatgctttggccaggcgcggtggctcatgactgtgatcccagcactttgggaggctgaggtgggatcacctgagatcagcagtttaagaccagtctggctaacacagtgaaacctcatctctactaaaaaaaatacaaaaattagctgggcgtggtggcgtgtgcctgtaatcccagctactcaggaagctgaggcaggagaatcgcttgaacctgggaggtggaggttgcattgagccaagatggcgccactgcactccagcctgggcaatagagtgagactctgtgtcaaaaaaaaaaaaaaagaaaaaaaaatggccaggcgcagtggctcacacctgtaatctcagcactttgggaggcggaggcaggtgtattatttgaagtcaggagtttaacaccagcccgaccaacatggtgaaaccctgtctctactaaaaatacaaaaattagctgggcgtggtggtcatgccggtaatcccagcaacttgggaggctgaggcaggagaatcgcttgaacccagaggcagaggctgtagtgagccaagatcacacttgccgttgcactccagcctgggagacagagtgagactccgtctaaaaaaaaaaaaagcttcatgacaaacttccagactttcttccaaagtgtccgtatgagttttcattcccacgagtaatgaatgagagttcctgttacttcacatccttgccaatgtttggtggtgtcagtgtttcggattttagcaattttggcaaatatgtagtggtatctcactgttgttttaatttgcaattccctaatgacatatgatgttgaacatcttttcatatgcttatttgccatctgtatatgtttttggtgaggtatctgttcagatctcttgcccacttttcaattgggttgtttgttttgttattgttgagtgtcaagagttctttgtatatttttggataacagcatggtttttgtttttgtttttgtttttttttgagacagagtctcgctctgtcaccaggctgtagtacagtggcatgaacttggctcactgcaacctctacctcccaagttcaagcaattctcctgcctcagcctcccgagtagctgggactacaggtgtgtgccaccatgcccagctaatttttgtatttttagtagagacgggctttcaccatgttggccaggatggtctggatcacttgacctcgtgatccaccagtatggttgagttttaagagttctttgtacgcttttgggtaacggtcttttgttttgcaaacattttctcccaatctgtggtttgtctcttcactcttaactgtatcttttgaagggggatctcaaagaacatctggtcccccacaacaacatgtcatgtcaggtgagagatgactcattttctcagaaactaggattttgtgtcatatgttgtaaaccacgaaaagttaattttataacccaccttctagatctactgagaatacgtggtgttatcactaacagttttgaggaaagaaataattgcctaattcattttgtagtgaatgtgttttgttactaccacagatactcttaaaatccacttattatggagggggaaaaaaaaggaattttctttacagaaagtgaggagtgaaacctaatggagaaaatatctgtttcagggaataaccctcccaacatctgatttttttttgttttagacaggggctcgctccgtcccccaggctggagtgcagtgatgcaatcatagctcactgcagccttgaactcctgggtttaagcaatcctcctgcctcagcctcctgagtagctgggaccacaggtgtgcaccaccactgcaccaccacacccgactaatttttttgatttttggtaaagacagtatgttgcccaggctgatcttaaactcctgagctcaagtgatcctcccacttcagcctctcaaagtgctaggattataaatgtgagccactgcacctagcctgatcttttttttttttttttttttttttttttttaagaaacagtcactagtgctgtatgtaggttacagtagctatgtaggcccttcagagtcacttcacttttctgagctttcgtttcttcaacgtcttcctgtctgtaagacacatgctcttctacccctgagaccaaaaaatgttaccagtgaggatctaatgatataaaatagggaaaatgctttaaaactgcacagtgcttaacaaatgcactgttattatatcattaaaagtgactcctgggtggtgggaatggttgcataacgacgtgaatgtacttgatgtcacttaaaactggttacaatggtaaattttatggtatatatattttaccacaattaatacattttaaaagatggttcttgacaattattcttagcgtctgaggtgccccatttcttgggtatgggcatatagtgcctcaagaatattggggatcctcacctcttctatgcccaaacctttaagaaaattctgggccaggcgcagcggctcacagctgtaatccaccactttgggaagccgaggtgggtcgatcacctaaggtcgggagttcgagaccagcctgaccaacatggagaaaacccgtctctactaaaaatacaaaattagctgggtgtggtggcacacacctgtaatcccagctactcgggaggctgaggcaggagaatcgcttgaacccaggaggcggaggttgcggtgagccgagattgcaccattgcactccagcctgggcaacaagagcaaaactccatctcaaaaaaaaaaaaaaaattctggaaaagctaggtcagtgacatgaatattggaatcagagtctaacaaactcaatttcttcctttctaaatccgtggtacggattcatgtctgcagtagtttttctgagaaagcagaaggggtaggtattggcaatcaacaagctgcagagtatgcagattgaggtcagtaactgtaaatgccccatgactgtctgatcattttaataccaaaagaaaaacttaaaatcccagttgctaaaatctttgtcttagacaactctttgagcctctccctacaaggcccagaaaggaatgagatagatgtgaatggaatctgttttcccttcccttgccacgctctggaggaggagtctagggcagtagccaaggccagctgccagtcaaggaaaggggagcggccccgttgaatccacaaaccacaccatcctggcccatgggttatatacaaactcccacattggcaacaaacaaagggcatgcacattcaggggattttgctttcactgtgagtgtttatctttgaagggtgtcacatcaagatgaatgggaagggtgtgttgcagttgagctgaggtttggtctttcttggcttttttagggacacttacaggtccaaatctgctttcagccggctggtggacatggtaggagacacagtagtctcaggaccaggcctccaggtgggagctgagattctagagggtggaaaccacttggagattgagtcaaagcagacctgtcctcattctgtgctgggcaggagccagctctccatgtccctgcagctccagcaacacctccggatctttcagcttccctgggactaaggaccatgcacattattaattctgatataaacagtcacacaggcacatgtctcaagatgagggtgagaagttggttacagcaaatgaagtaataatgatctttgtgcttcacaataggaattcaaccaacctgaggtttataattcacttattaacactttttatttttgttgagacggagtgtccctctgtcactcacgctggagtgcaatggtgtcatctcggctcactgcaacctccgcctcctgggctcaagtgagtctcgtgccttgagtggctgagactacaggcacatgccaccatgcccaactaatttttttgtatttttagtagagatggggttttgccatgttggctaggctggtctcaaactcctggcttcaagtgatccgcctacctcaatctcttcaagcgctgggattacaggggtaagccactgtgcctggccataattcatttatcagtcatatatatatacacacacactgggagaatctagggtcagtgccttacaaatggcacaagttgaagccctgagactcccactcctaccctgctccccccattctcagtactgctcctcagatgcctccagcagatcatccatttctgctaggctgggcctgggtacatgcagggagatgtgtacaggggctaagagcagaaacttttgagtgagacactcctgagttcatgcactggccctgccatttgtcagctaattgatgttgcatttaattgcatcatctgtatgtaagcctaataatttatagccatcttagagatgttgtgagcttaaataacatagtagtgaatatttatttatttgtttatttatttatttagacagggcctcgctctgtcacctaggctggagtgcagtggtgtgatcatagctcactgcagccttgacctcccacactccagttatcctctcacctcagcctcctgagtagcttgagacaacagatgcatgccaccataactgactaattttttaaaattttctgcagagacagtgtctccctatgttgcccaggctggcctcgatctcttgggctcaagcgatcatcctgccttggtcttccaaagtgctgggattactggtgtgagccactgcacccacagcctatttattgagaaatgtggaaggcccaggcactattctaagtgctccagctgttttatctcccacagttttgctcagataggagttccaaagctggagctggaagactcatatttttagaaatgttacagttaattctgaggtgggtcagattgagattcatggctatgcattaatgtttaggtggtgactaaccactcagggttttagagacaaacagaccttattctgtcactcactgactgagcgtggccaagtctttcagcctctctaagcctcagtgtcctcatccataaaatgggaccaatcgtagcatccacttctgagaactgttcagaagtggaaatgagctagtttaggtggctgtgtctggcatacgccaatggtttgataagtattagcttgtgcctttattaggccaactcctttttgttaggtgactgagaaaccaaggaccttctgccctttatgcaccagtcactattagtttaaatttgttgctcttccatccacatgattcattccaaatttgaagtgttggagaaagggagttagtatgtcatagaaaaatctctgtttttggctcagcaggactgagtttgactccatgtaactgtctgagtcttagtttcctcatccataacatgggagaacaataccctgaattagagaattctgctgccagaattagagatagttcatgtcaaggtgcaacatataggtaatgtgttattgctggtgttctggttataaaatgtacaagatgtgaaagcaaaagggcagaaaaccctttttaaaaattcatggctgggcgcgctgcctcatgcctgtaatcccagcactctgccaggccgaggcgggtggatcacctgaggtcgtgagtttgagaccagcctgaccaacatggagaaaccctgtctctactaaaaatacaaaattagccgggcatggtggcgcatgcctgtaatcccagctacccaggaggctgaggcaggagaatcgcttgaacccgggaggcggaggttgctgtgagccgagatggcaccattgcactccagcctgggcaacaagagcgaaactccgtcccccgaacaaaaaattcaaatgggaaagagaggcagatggcagagaacaggggaggggctgggcaccgtggctcatgcctgtaatcccagcactttgggaggccaaggcgggtggatttcttgaggtcaggagttcaagaccagtctgaccaacatggtgaatccccatctctattaaaaatacaaaaattagccgggggtggtggtgggtgcctgtagtcccagctactcgggaggctgaggcaggagaatcacctgaactcaggaggtggaggttgcagtgagtcaagatcgcaccactgtactgttgcctgggcaacgcaccgagactccgtctcaaaaaaaaaaaaaaaatgagagaacaggggagggtctagggctcagagctttggagaacagacctcagtagcaccaacactccaggatcaatgctacaaagacacgggttacaactaaactggagaacatggccaaggatgggaactcagcctgagcagggctgagccgagcagggctaagccaagtagggctgagccagaacacttcctccttttttctgaacaatctacctacatttcagctacagggctggctttacccagtccggcgggagggaggagagggctggtctgtgacttcagtgctgaggtttgatcaaggcaaagggaaacttcctattcccagaccctttgcaagaaagaatggcatattacttgccaccgacaggggttattattactaaatggagtcagtataaatgctttccaataaagcatgtccagcgctcgggctttagtttgcacgtccatgaattgtctgccacatccctcttctgaatggttggaaattgggcatctgttcctttaaacaggaaacatttcttgttcgagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttg

SEQ ID NO: 1569 - DNA, 29681 bp, Homo sapiens
  source 1..29681: mol_type = genomic DNA
gagtgagtcatctctgttctgctttaggagtaaagtttaccctgcagttccttctgtggtgaagttttctctttctctcggagaccagattctgcctttctgctggagggaagtgttttcacaggttctcctccttttatcttttgtgttttttttcaagccctgctgaatttgctagtcaactcaacaggaagtgaggccatggagggaggcagaagagccagggtggttattgaaagtaaaagaaacttcttcctgggagcctttcccacccccttccctgctgagcacgtggagttaggcaggttaggggactcggagactgcgatggtgccaggaaagggtggagcgggtgagtgcctgttgccaaggtggcctcttcaacaggaaaccacaatatttttgtttcttgacttgctctagaaacagggctgtgggggtggggaagcaacttggatctgcccttctgaggacacctctgggtgctgcctggcccaggtctcctgtgtggtttctctctgagccgttgcctctgactttgctactttttcactctgagcagtctccagttcctctgctacctttttgtcctccaagcttccctgccgcctcgaatgcagatacacggtctccctcctgtggacccgtttggagagtccagaagactttatcaatccacttttttttctttttcatttggccctggggccgacggttaagtactttattctgtcattctgtcgaatcacgatgccctgaggtgcacagccccttccccctcttccgtgtctgaagggtttccttttatctctccacccccacccttgccctcctgccctctctcttgttccccaaagacagttctctaatgttttgatgtggattcgtgaatttatctgtatctttgcaaaatgtatttttcttttgtatgtgtacactgttttttaactatgcgatctcaggcaagtaattcctctgtgcctctgttatctcatcattaaatgattaataatgcctccagaggtgactgtgaggcttgaaggagataatacgcatacatcacttactacacgagttagcaattattattgcatattaatactattggtattttattttgctcattctgtttctatttcttttttatttatttattttttgagacaaagtcttgctctgtcacccaggctgcagtgcagtggtgcaatcacggctcactgcagcctcaacatcctgggatcaagcaattttcccatctcagccttcagattagctgggaccacaggcgcgtgctaccacacctggctaattaaaaaatttttcttcatagagatggtgtctcattttgttgcccaggctggtctcaaactcctatgctcaagggatcctcccaccttggcctctcaaagtgctaggattacatgcatgagccacggtggccatccaggcattgatattatgaggccatcttgacctagccctctctggtgaagagtccttttcagatacttcgttcagtcttctcagctatgagtccctaccctctgaaagcttatattctatttggggaaagacaaaaggcagtttcaaagaagagaggtgtttgattttcttttcctacttttaatatcagaaaacatttcatctaactctcagtatgaaggcaatattttgtttactggtatatccctagagcccaacatggtgagggccccaggatttgcttctttgataagatggtaaacccagctttcagctaacttcatggtttcctcagctacactcatatacaaggatcacctttggtaagatggacttaccatcttaccaaagagtttttgcattttagagttttttctttttagatttttttcattttagaatttttttatttcagagttttttctttttagaggtttttcattttagagttttttctttttagagtttttttttttttttaattttagagtattttaggctgctgagggtggaatctggtgaccttggggccacagagatgctccttggctaaaccaggggctttagctctgaaagttcacagccaccctgagaaccaagatgagagggctctgcagtgtccaatctcaagacctctctgaggtgctccatcaagattcattgaatgaaaaaattaaagtcttaatgatgaacccagaaaaatctttaaatcctaaatatgaaatgaaagtgttcttagttacaatccagtccaacgtccttgttttggaatgtggaaatgaggccccaaaggtaaaatggcccatccaaagtcacagccaggggccagtgctcaggtggccaggtgccctgcgtgcggtctcctggaccaccaggcctttttcctgcagctttagaagctttagaaggcactctgctcactcaggggcaagtggtaagcgctctttcccctctagtgtttgtgactcaggagtttcgaaacaggaagtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1570 - DNA, 27212 bp, Homo sapiens
  source 1..27212: mol_type = genomic DNA
gtagagctggctggctgtgcccttccgtccttcattagacgtttgctcttgtcttagatgctcagatggtagtggataggcctgtgacgaaggtgctaccatcgtgagagtaaggtaaggatttgcctctttgttaaggtcagaggggccttttgggaggaaggcctttgattctggagttttctaggctgctgagagtgagatcgggtggccctggggccatggaggtgatcctcgtatgtgagtgtggatggggaaaccatgaagttagtgtaagaggtagcagtccctctgagagccttgccgagggccgtgcagtttccagatctgaaggccattctagcttagactgatgaagtcctaggagcttctgaaatgctgcaagtttaactacttgtataaaggcctcatcctgatcccagtcaaacttgtgaaataatagaagccaaaatttaaatctctactgactttgctgctacagctatcctcccaccaacacacatacccaccaacatacacacttgccaacataaacgcacacacacatacacacaaacacacccatgtggtcctactaattcaattatttattttttaaagaaattaaaaaagactgggcgtggtggctctcgcctgtcatcccagcactttgggaggtcgaggcggtggttcacctgaggtcgggagtttgagaccagcttgaccaacatgaagaaaccccgtctctactaaaaatacaaaattagccgggcatgatggcgcatgcctgtaatcccagctactcgggaggctgaggcaggagaatcgcttgaacctgggaggtggaagttgtggtgagccgagatcgtgccactgcactccagcctgggcaacaagagcgaaactccgtctcaaaaaaaaaaaaaaaaaaaaattaaaaagatacagaacagttcaaaaaacaatataatgggaagactagatagacacaatcagagacctgcacttgtggggttaagaatttacaggtgaagttgcaagtttcattctgtttgaaaatgatgggattatatgttttgctgaggtttggacacctttgctgggttgtttgaatgccgtggctgcagcgccctgttatggacatcatgtgcgtgcagaatggatgtctgtcaggttccggggcagcccgcagtctgaggcagccagcctggattggagggagtggcaatactacctgccggttaggggtttgggcctgagagcgagtggctttcaggttctctcaagcttcggatgagatgcaggtttctgcttccgatggcaaatgcatgttttgctttttagttatcactgcaagagctaggatgctgctagaatattactggaatgattgtgatgagatggaatgtatttacagtttaattgtgacatgtaatacagtggtagaatgggactctggaatgagatgctggggcctagattctagcacttcctttgtgaggctctaaccccctctcctatagtggatttgttaagaacttctgtttttgtggctttgttattataaaattttttgaaatgttgttctctaaaaaagttatgattttatgtttttcttcatgagattctttcactgccttccagctgcaagtagaatgacgtctaaatctttgtgatctgtcactgaagcccttgagtgagacacttaaatctggctgtggctctctctcttactagcttatttccaagccgtgatttttcacaacagaaaaatggggacagtaatagtagtttcttcagaggcttttagtgaaatgaggttaaaaaatatttttatgtttatatggatatatagattacaaacatttatatatcatttatttatatgattattataaacacatatttatatttaaatactttggggcataaatatataaaataataaatatacttatgtaatacaaatagacttatatacatttactatttagcagagattatataaaatatatgtattacatggcaacatattcaaatttacatatgttatatatacatgtggaaaaaaaattgggaaaaggccacaaaatgtgaccaaagaattacttccaaatggcaagtttttaagtaatttttattttctttttatacttctctgtactttctctatgaaacaagtgttacttttactgtttttaggaaccaaaaatacaagtacattgtttaaaaaatactagcttaacaaagtttctagcccataagctagtgcagaaaatctaggtcccataaaacaagaactgccacacgatgtctctccccttacagtgctggatggcccgttgttaatggtgtcataaatcctttgcaagtgactgttttctaggtactatgactagagggatgtgtaacttaagcaaaaaacaaaaaacagaaaaggctgactatcatctgacagtgtatcctggaacacctaggccagagaagaagccacgttagcattttcccttctaaatgtcagttatgatttgatggggaaaccacttaaaaagcattgtcacgttgttgaaaaggtaatgaaatgagtgagatgagatggctatggaggacggagctatgcgccaatcttattatatccaaattcatgtcatctcagccttggattgtattgatttttattatatactgtcagaaaatgctattgaatgtgtaacaagagcctcaaaaaggtttattcattttgacaccataatactacttttaggaaattattctaagaaaataattagaggtattcttaaagatttgcgttttaaagtcatcctaaatgtaatcaggaactggctatgtaaattatagcccatctctaagattaagtgccttacagatattaaaacccatgctgtagaagaaaaactaaagacaggaaagtacttacaatacaagatgtacttaccagtggaaaaatccacttatactacagaaatatgatgtgttcaaatataaggaaaaatgtgtatgcataaaatatttggtaggaaagagtaaaatattactgggcatttatatttggatggtggaattatacataattttaattttcctttttatcttttctgtattgtctaaaatgaatacactaagcattgttatcctcagaaaaaaataattgagggatgggggaaaggaagtcctgctttcatttgattctttggttggttttattctgtaagatgagactttaacagaggttagaatgcattaaaaattgtaaagacagttgacctaatggcactaaacagggttagatctagtttagatcttttccagcatgtgaataagaatggatctttaaataaagattttaactaggtatatgttttagaataagtcatacatgtacatggtaaaaattcaaacagtacaaactgtgcagcaaggtatgggaaataaagcagctctcactgtcacctccacccatcagccttctcacactgcacgcccacatctgtgtgtaattctgcttttctttaacattactgaaggaacttcctgtgcattttttgtcagagctcttctgtgaatacacaaaatatgtactgatcaatacattatgtagatcacgcaggctcaaccacattgatcttcctattctttctagtagccaaatagagttccctggaatatgattaatagcttgcctaaatcttctaatgctgataaacagttgtttctgctctttcgttatttcaaggaatgctaccatgaatagccttatatatggttttgagtatacttgtttaagtgaatgtaggaaaaactcttggaagttaaattgtgggccagtttatgtgaattttatattttgacagagatggctaaattacccacctgtttttttgttttgttttggttttggttttgctttttttttttaagagttggggtcttgctacctggggtcttgccacctggggtcttgcccagggtagacctgaactcctgggccacgttggtttattttactgcattcccagggcctagagcaacgattgacacgtgctagcagtatctattggaaattctggccaacttgcaatagacctgattatttctacactgaacatgtctaagatagctattactattcattcaggaaagcccagacaattatcatgccagcagcctgagacagtagccagtaatagcctggtgtggtagtttgctcctgtagtctcagctactcagcaggctgaggtgggaggatggctctagcctgggaggtggaggttgcaatgagccaagattgcgccctgcactccagcctgggtgacagagtgagaccctgtctcaaaaataaaaataagaataaaaaataaaccagcaaaagtttctgccctcacagagcttccattctagtgagagggtagtttgtcatcaggagggtgacgccggtagggctgggggccagctccctgcagggaacaaacatgatcgcagtggggtgggagtaggggatgagtccccagagcctctgtggtttccatttccacacaaaaaaaccactgctgctgtaatcaggagggggaaaagatttttaaaaattttctttcagggaatggaaggaaaggatatttttgaaagtaagactttgaaaactaaaagttttgggtcacttaaaaactcaaaatctttaggtcactttaaaaatatttaatcttggagctggaggccattattctaggtaattagctgggtgtggtggtgtgtccctgtaatcccaactactaggaggccgaggcaggaggattgcttgaacctgggaggcggaggttgcagtgagccgagatcgcgacactgcactccagcttgggtgacagagcaagactgggtctcaaaagaaaaaaaaaaaacgaaaactaaataccgtatgttctcacttaaaagtgggagctaagctatgaggatgcaaagacatacagagggatataatggactttggggattgatggtggggttgaatgggaggttggtcctaataggtcctagtacgtcccctacttctaagtcttccagtctgtcctttgcactttgaatgttaattccaagttggataatgtcattctcatttttacagtcctttcttagctcctcatcacctccaggacaaagcctaaacccctcgccccatggtaatgcggcccctttgtgacatggtacctggctagagcttcatccctttgtcccatcactctccatcccagacactttgtagttactttattgagctccttgtgcctgcctgaatggacttgaaagttcttacctccatcttttacattaattgtttcctgtaagaattgtgctttctcgcattctccccaaaatcccttccccataggaagcccttctcccaggctaagttaaggtttcttcctctacatccctaccacactctggtcacaaccctctaaccattggcttgttttttttgttttttgtgttttttttttttttgtgagacggagtcttgccctgtcacccaggctggagtgcagtggtgcaatctccgctcactgcaacctccacctcctgggttcaagcgattctcctgccccagcctcctgagtagctgggattacaggcacgtgcctccacacctggctaatttttgcacttttagtagagacggggtttcaccatgttagtcaggctggtctcaaactcctgacctcgtgatccgcctgccttggcctcccaaagtgttgggattagaggcgtgagccaccgcgcccagcccattggcttgtttgtatgtctaccttcctaaacagtaagagggaacttgtctggtgttctttttttctctcctgtgctgacagcacaatgaccagtacctagtagttgcagtagcctttgatgaacaagccagcaaatggtacttttcttccttatctgaacataccatttattttgacttagattatattctcctgccttttaaaaagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacaggtgggtggaaactcccattgtgggactgggaggtgtgggttgaatggacagcctctgagctgattggggcttttttttgtggtaccctgcctagtgcctgggaacccagcagtgccacaattctaagcttctacagaaagacagtagtgccttgggtggtcctgctaaaggctgtaaaacttagcttctccccaccctagagagagtgggtaaacaaaggcgtgagagagaaaccacattcagtatcacttgggaggctttgggaagatgtcccaccggagccagattaagaaatttaggggccttatatataattctatagaaatgctaagaccataaaataaaaatttatttttcaaagtgaaacattacttagaggtatgctgaagttataatagagtttttctaagtgttctcatttttttcctctcttatcttgatgcctctcgatatccagattgtgtgcttactttgcccatccattgagtaaagcatcatggcttcccaccctgaaatccccctcccacctgcttgcggatggctatgaaaattttcaatgagatttaagggttttctgccacacttaaagactcgaatgactaagttctttacggagctgtaagccgctggcctggcacatacagctaggcagtctccaccgaggctgcccagttcctgtgagcccggctgtatgacagttctaagcttctataggaagacagtggcacgttgggtcatcctgccaaaggctgtaaaactcagcttctccccaccctagggagagtgggtaaccaaaggtgtgagagagaaaccccattcagttacaacttcatgatgctgtgacaagactttaaaaacagaaacacattgtcactttctctctttcaacatctcctattatcggacactacttaaagcaattttagctttgctttcaggaaacttctactgaagtcttcgttctgggcccatttcattgtctctgtttgcttgttgataactatggcatgtgagatggaaagggttcacaaccagggctgacagctgctgtcctctgatggctcagcccatgaatgctctggtctttctattctcagagactattttttgttttgaggcttgactattttttgttttgttttgttttgtttttgagacggagtctcgcttcatcacccaggctagagtgcagtggcatgatctcggctcactgcaacatctacctccagggttcaagtgattcttctgcctcagcctcctgagtagctgggattacaggtgtgtgccaccatgcccagctaattttgtatttttagtaggacggagttccaccatgttggccaggctggtctcgaactcctgaccttaagttatccaccagccttgacctctcaaagtgctgggattataggtgtgagccaccatgcccagccaaggcttgaccattttgattttaagtgaaaaaagagatattctgggccgggtgaggtggctcacgcctgtaatcccagcactttgggatgctgaggagagctgatcacctgaggtcaggagttcaagactagcctggccaacatggtgaaacctcatctctactaaaaatacaaaaattagctgggtgtggcggctcacgcctgtaatcccagctacttgggaggctgaggcaggagaattgcttgaacccaggaggtggaggttgcagtaagctgagattatgccattgcactccagcctgggcaacaagagtgaaactctgtctcaaaaaaaaaaagaaagagatattctgggtatataagtttcctagggctgctgtaacaaagtaacacaaactagcaggtttaaaacagtttttaaaatgtgttttcacagttctggaggcctgagtcagaagtcaagatgccaacagtgttggttcccttttaagaggctccgaggaataatctttttcatgcctttccctgcttcgggtgggtggaggaatcctcagtgctccttgtcttgtagatgaggcacagcagtctctgcctatgttcccttctctgtgtctaaatctccctcttatgagacagtcactggattaggaattagggcccacctaatccagtatggcctcatctttgtgtgtgtgtgtgtgtgtgtgtgtgtgtgtgtgtgtgtgtgtgtgtgagacagtgtctcactacatcgcccaagctggagtgcagtggcatgatctcggctcagtgcaacctccacctcctgggttcaagcaatcctcccacctcagcctcccaagtagctgggactacaggcacccgccaccatgtctggctaatttttgtatttttttgtagagatggagtttcaaaatgttgcccaggctagtcttgaactcctgggctcatgcaatctgcccacctcagcctcccaagttctgggattacgggcatgagccactgcgcctggccagcatgacctcatcttaatgagattttatctgcaaacgtcctgggtccacataaggtcgcattctcatattccagatagacatgaattttggggaagaggggagaacactattcaaccagtacactagatagctttggtttactagcattgtgaagtctttataaggcacttattcattaaggcgccagttagtcctaaaaacccacagccccagaacaaggaaagccgaggggggtctcatcttgtgcccaccatcttggtcctttgaaggttccacttctgccgcatgagctgggctgaagcaaacagccagtgccagacacagtctgtacctttctggcggagggtcgatcatctattaataaggcaggatctctcttaaaatctttaatgtattggcttagagataaaagggtccgggcaatcctgacttactgcttgttcattatcattgaatactagccagaagctaataaatatgctagggtgaccacttaccattataagaaaacactagacattttattttccagttataattgctacctataaaataaagatcttataaactattcaggttcattactaaatggtgatggtacaagaaagcctataggcttcaataatgaggaaagcaaaagggtaaataccttgtaataaaggtgaaagagtcagagtagctttggattagatccaattttggccaaactgaaagctttagataaacacttctagggtagagagtccatgagaagggggataaggcagatggtaatactgagtaatttctgtttctacgccatttttattttcagaattttacttttctaattaaattttaaagtcaacgtgtttttgtattaaaattattttcctttacaccatagtattgaaaggtttgctgacttctaaaacattcctttgttcacctattcgacaagcatattccaagagcctaaatgtgccaatcacataaatgtgataggcatagattaggaaatagtaacacctatcactcattgagcacttagtgtgttgccaaagactgatttaagtacttcacataaacttatttgtgtaaccctcgaaaccttcctatgatgtggttacggataattatcttcagtctatggacgaggaaaaaatgtgtaacatgtctaaagttaacactgctcaaagatagtggaaccaaggctccaacaccaatagcctgggtccgctgagctcaatcattgcacctcacaaccctctgggtttatgaaaataaaaagggtacggacctggccactaggggacttgaacagtttctaaacagacaattattttctgtttttatttttagtgtggtggcatgatcacagctcactgcagcctcaaccttctgggctcaagtgatcctctcacctcagcttctggagtagctgggaccacaggtgcatgccaccacacccggctaatttttaaatgtttttggtagagatggggtcttgctatgttgcccaggctggtctcaaacccctgggctcaagtgatcctccttctgccttggcctcctaatgcgctggaattagaggcatgaaccactgcaccaggccaacagacaattatgtgtgttatcgttttggggttactaagtcatagtggagtgaatgcagctttgaggatgctcaggcaatgcttgagctgattgttcatggatgggcctctgcagatagacaaggggatggggtgtagcggcaccacagaaaggggtgagggcagggcagctgggtgtgtttggcttcaggtcctttcgtgtttgcggtctggtctgtgatagggatgtattcggagactttgtattccagaaccgaatgcttggccgtcttactgaagataatgactgggagaatactgaccagttttgattagggaagtcatgagccaatgtgcattttgaaaagcataatttccaaaaggcaaagcattttgctattgcaacaaaatctccattttacagaaaaaaaaaaaggaaaacaagatttactcaactgaaataaactgaaagaaaagttgatagaactttaaattgttaagggtgggaaagtcggggaggagccagtagacttctgtgtcaccacaccagcctctttccaagggctcaactcataaaccatgccattaactggctttatgttgaagggaggcctttggaatcaagcccactgtgactccatatatcaaatgggaaattatttgggaaaagatttctaaagtgtctccatttcccaccacagggtcatgctctatcagatttcagaagaagtgagcagatcagaattgaggtcttttaagtttcttttgcaagaggaaatctccaaatgcaaactggatgatgacatggtaagacctggtatcttactgagatttagtcctgagacttggttagccagggggcatttctgagaccaaagagaggggtattttggtaaaagcaacctggattctcactttttaactagaagaagaaagttgtcagcacgagtgttacagatgtgattcctttagaccgaagtgctgctcatgttaattattgggagcaaggcagagtcagaggccgggagaaggaggctgtgcagatgcagcccagacccggcagagctgggaaagactgcggtgggtctgagatatttcctccacttctgcagtccccgaaacaacctgggacctgaaactctgtgtgtatattgtgtctgtgtgttgtgtgtgtatttccgtgtctgtgtgtgcctttctctgtgtatagtgtgtgtctgtatttgtgtgtgatatgtgtatctctgtgtgtctctgtataagtggtgtgtgtgtctgtgtatctctgtgtgtgtgttctctgtgtggtatgtgtgtctgtgtgttgtgtagtgtgtattgtatttatgcccctgtgtgtgtatcactgagtatactctgtgtgtgttgtatctgtgtgtgtatgtgcatgtggtgtctgtgtgtgtgtgtctgtgtgtctgtatgtactcaggtctggagaggcaatgctgggggtgaggctgttccccagggtgtcaccatgatgaccgggctgctgtctcaggttgtttcacagtccccaagtaatgcattcgcaggagatttgagcacagggcctggggactgggtgacatctgacatggcttctcctttatcctctcacttctgtctttctgggccagaaaacatggaatcgcttccctagtagcctgctggctgtgagagaccagcagaaactgtcagaaacttgggaagcaagggcaggtccttggttggagaaattggaaattaaaaaaaaaaatctaatctaaaaaccagtagggctcaatccagattcccaactttatttctcctcctcttagaacctgctggatattttcatagagatggagaagagggtcatcctgggagaaggaaagttggacatcctgaaaagagtctgtgcccaaatcaacaagagcctgctgaagataatcaacgactatgaagaattcagcaaaggtagaaacaacctgacagccgggaatcggcaaaacctactctaaaattgaaactgacaaatcgctccatatcacagttgtttctaatcaaatattgtttggggtttccccttttaattcagagagaagcagcagccttgaaggaagtcctgatgaattttcaaatggtaatgcttggagatacattttcaagatttagttaatttactatctggtacctgcatgtgtcctccccacagccttctaccacatgcacatcttaacgtgcctgctctactttttctttttttttttttttttgtgagacagttttactttgtttcccaggctggagagcagtggcaccatctcggctcactgcaatctccgcctcccaggttcaagcaattctcctgcctcagcctcctgagaagctgggattacaggtgcgtgcaccaccacgcctagctaattttgtatttttattagagatggggttttactatattggcctggctagtctcaaactcctgacctcaggtggtctgcctgccttggcctcccaaagtgctgggattacaggcatgagccactgcgcccggccgcacctgctctcctaagacctgtagcccaagctggcaagtttgaaataggtgcagagttagtcagtagtaagtaatttaacatcattttttctatgtggctttttttttctccttgacgtgctgctcatgttatgcactgagtagctggatttaaattatgtttcataattttcttggttaagtcactttctctttcaacaccttctacactaagtcactcctttcaacttcctttcactttttctacctgataagcgaggctgaaccaagagagagagctctcaacgatctccttcaaaattttgattaatcaaatagtctttttttttttttgagacagtgtctcactttgtcccccaggctagaatgcagtgatgcaatcttggctcacaacagcctcgacctcctggactcagatgatcctcttgcctcaaccccctgagtagctgggaccacaggcacaagccaccatgcccggctaatttttgtatgtcttgtagagatggggtttcgctatgttgcccaggctgatcttgaactcctgagctcaagccatccacctacctgggcctcccaaagtgctgggactataggcaattaataaagtattctttctgattagaaaaattatatacactaattgaagattattttaaattcagagaaatttttacaagtccaagaacaccatcactccattcatattatgaatatttttattgtatttttacgttggctctttgtggtgtgtgtgtgtaaaatacattttggatcactcaaatgtattttaaagattaatgtctatgcaggctgtccttccctttcccctctgcctgctgagcctaaggccttaagaatactttaaggagtaaagtactaaatcattaattcatcctgagctagtggctttattaatgagtatctcacaaataccacaaaaattcaacctggccatgtggagcaatataaaattatggcatttcttggtatgtttttctctttggcgaggagacaacttgatcttgtgtttccagaagcatgttaattgccctgcttgcagaatctctctggcttgaaaggagattatattcatggcagtctgtgaattttcattttatttcatttatttatttgagacagagtctcactctgttgcccaggctggagtgcagtagtgcgatctcagctcactgcaaccactacctcccaagttcaagtgattctcctgcctcagcctcctgagtagctgggactacaggtggctaccaccacgcccggctaatttttttgtacttttagtagagacagggtttcaccatgttggccaggctggtcttgaactcctgacctcaagtgatctgcccatcttggcctcccaaagtgctgggattaccggcgtgagcccctgttcccagcttgaattttcatcttaaaaaagaccttatgttgtcctatgtgctacatatttcattaccagtgtacctttcctgccatgtctcattctagatgtgtctcttcgttgtttgcaggggaggagttgtgtggggtaatgacaatctcggactctccaagagaacaggatagtgaatcacaggtagacggaaacctccaaatccttttttttacattacagattctagttatttaatttgttagcttttttttttttttgctgccagataaactgacaaggggcagaaacttactgaaaattttgagaactgtagaaaaaattcacacaaaaaaagttaaaaatgtgacttaatttttaaaatgtgactccttcagttttctatacatttgaattttattttaagacccgagatgaagatactggaatagttggagggtggagggggtaataagcctcctaccaaatcttctagcagccgtgccagcctggatgggggagtggtttggagaaagagtctagcaggaatggaaaaagccaagccttttcctttagcttaatgtttcaaaaatgcttctccttggtgatgaggtgtaagcagcaaactctcacaatctagccatctctgtgtttttgtctcagtgaaccagcagaaacatgtaatttttaggcataataacttctctttatgtaatcaacaatccaccaaatacatcctgacttattagacgatctgctcctcctcatggtaggaagaagaggaaatcctgaatatctgaagtaggcttgagagagattattcactagtgtgggctcctgagaaaattaccagacctctttcatctgaaagtcaaggattaacccaagtaatgtggtactttctaaacagtatagcatgctacaagcattgtccccactgaagagctaaaaacactgtcttaatatcttagtaaatcttagtatctttttccttttttaatgttttattgagacaggggtcttgctacgttgccaagccaggtctcgaactcctggcctcaagcaatcctcctgccttggcctcccaaagtctgggattataggtactagccaccgtgcctggccaaatcttagtgtcttagtatctcagtaaatacacttaatatgcttaataaatacttagaacacaactgtaaataataaaaacttaacatacttggtacaaacttaatcaaatatttaatatcttagagttaacatattaagataacaggttatttgcccaaagtcataaggtgaagtagaggcaggaattgggcttcctagcctggagtccttttctccacctcaaggggctacgcagacctccaactaaatgctgagtttctcggtactgaaacagccctaggagaatgaataggacacagcgccatccctggccagtactatcaggtactacagtttggataccataacctacagtgtagccaggacctccctgaccagcccatctcttcccagcagccaccgtggtcctgagagctgggttaagccatcacctttaaaatcctgggaccacactgtgcaatgcatgaatgggagaccctcagctgttagccacgaagcacagatgagttcagtagacagccaagagaatcacaagtcatggcgtgggggcagccaaagacattcattcattcagtgactcttgattgagctctcacaagttaatacaccgtagtccctggcacagatgttatgaacctcaaggagtcttctgtatagtatgggaagcagaaatgagaacaaacaataatacaatgtgatgacaacaatattaatatatgtgcaaagtgctcaggaggcccaggtattgggacactgactttacaacgatggggcagaagtctgagaggtcctgtgtgaaggaaataggtagaaactagttcttcgaggaaacgaccccgagttggggtggtgcaatggaaagcaagtcctcttactagggagttgtttgtttacatctctagtgtttgacccacagagtcagctcctgggttgggtttttgttttccagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggtacagtagaacccaaaagagaaaagtaaaatatttcttatgcctatttttttttaaatcaaaagggagagaacaaaagctataccaaaagggccatgtttcaagaaaatggatttaaacatatttccctgtggaggtaaagaacattcttatacatttatcagtttcctgctttttttaaaaattaattttttaaataaaagtaatgtatgtataaatataaaatatcaaatcttactaaaagacataatgaaaagcagtaataagctttgttttgaattcagctaaatgcatagcgcttctgtggaatgtattaggcgatgaaattgctgtggtatcaaagttcttatagaggctgcatttttacaggttgggctgttaagtgcagcagaaattgtgggttcttaacagaaatagcattttcaagtattaaatattaaactggttagcaattcttttgctcagccaaattaagctaagatcaagaacttacaagttaaatgaaaaaacaatttgtagtatgtgaatataaaaagtgactacaacaacaaaaaataaaaatcatccatcaccattgagagattaataattttgatttgatcaaagaacttttggaaatagtgtttatcaggcataacatcaattattgatttgttttgcaaatggaggtaagtttagaaaattaatgtagactgattataatcatcaggagtctgtaatggcccctattaacattttttttttttttttgagacaaagtctcactctgttgcccaggctggagtgcagtggtgtgatctcagctcactgcagcctccacctccctggttcaagtgattctcctgcctcagcctcccaagtagctgggactacaggcacacaccaccacacatggctaatttttgtatttttagtagagatggggttttgccatattggccaggctggtcttgaactcctgacctcaagtgatccgcctgcctcggcctcccaaagtgctggaattacaggtgtcagccacctgtacctggtccctgctaacatttgatttgtttatttaagcaaatctaagcctttaaaaaggcacagagattaagtccattgattacatcattcgtcactatgcgcttggtattgaaaaaaatattttggacccttgatttgtattcttttaaaattaaaacatttctattaaaataacatttgcttctatttctggcagctcattttcttataactggcccatgattgactagtctctggtaggcattcgagtctgtgtgtcctgctttttctgttcctgttcttatgttttatgctgaatgagtaaaagtaggagacccagctgcagaagtcatttctcctgagagactcccttctgtcctgcttcagtgccttcagacttgctttacagtcatttttttaatcaacattccacatttccaaaggatcagaatttttttcacagaaccaacacactgtattagtcttgccaaagtgcttccaaatcaacaagggcctattgcatttcagttatttttttctattcctaatgctagactgtattttttcttttttttttttttgaggcagagtctcactctgttgcccaggctgcagtgcaataacatgatcttggctcaccgcaacctctgcctcccaggttcaagtgattctcctgcctcagcctcccaagtagctgggattacaggcatgtgccaccatacccagttaattgtatttagtagagatggggtttcaccatgttggtcaggctgttcttgaactcctgacctcaggtgatccactcgcctcggcctaccaaagtgctgggattacaggtgtgagccactgcacctggctgagactgccttttgactgatgacttatgtttagctctgatgtgctgacagggacaaaatgctggagaaggaataaaaaaggaataatccaacaaggatcaagagaacaggaaaggagacaatagctaatgaaaggtttccaacaatttgggggagttgaaaaaaaagagtcgaggtaattgacttaacagagaaagctacaacctcactgattacagaggggaacacggaaaggaggcaagcctatttacccccacagaatcctggaaaaattcagcaattggaagtacaaagtgtaggtgaggcaatgagcagaaaacaggaagattctttgaaagcctatataagcctatacaatcctctgattcataccttcctctcatagagccagcaactattcttattctaccatcataaggaacaggaagtttgttttctcataaaattgaaccagagaggctctacacttcggtgtgccaggcccagcaaaggaagcaatgaagcattttactgaacacagagagactgaagaaaacctgctggtggcatggagtcagatctctaaaccaacttggttccaagacactggcagcagatacagacttacctctggagaagctgaaagctctagctaaaatacatacagataatgacatctggaggtttcctaatgaaatgatcaggtccccaaccaatcatcttgctatgaaatccctcagagaacaagccacatccacaaacacagagctttcagtcgactttttaatggactaattagtcaatttatgaatggacaaccaaaggtcagcaggcatttgaagaaaggctctaatacgaaagagaggtagcttggtacggtggcgtgaaaatccagcactttgggaggccgaggcaggcgaatcgcctgaggtcaggagttcaagcccagcctgaccaacatggtgaaaccccatctctactaaaaatacaaaaattagccaggcatggtggcaggtgcctgtaaccccagctactacagaggctgaggcagaagaatcacttgaacctgggaggtggaagttgcagtgagctgagatcgtaccactgcactccagcctgggtgacagagcaagactccatctcaaataaataaataaattactagataaatgagaggcaatgcaaacaacaagaaaaacatgaaacagaatatgaatgaaaaaaagataatgttgagaaaaaagcaaccttttttaatgcttaatattggtatttagtattcttagagagttagttaaaggtccatgaaagaacaagatgttatgaaaaagggacagaacaagcaagtctccttgaaaattaaaaatttgagcaccaaaatgaaaaattcaataaagtagaagataaagtctaaggaagtaggataaaaagacaaaaatagaaaataggagtgaaagataagaaaatttgaagctaaatcaaggatgtccaatttttgacaataagagttccagaaagaaaggacagagaaaggggaaatggaactttccaagaacgaaatgacgcaatctccagattgaaagggtataatggattaagattcacttccaaacatatcataccctagaagcttctggaaagagaaaaaagtaagccaaatatgtaaagtatcagaaatggaaagtcttctctctagcaacactgaaagctaaaagactgtgaagaaaggccttcagaattctgaggaaaaatgcttttggaaatagaactctataaactaaagactcatacaggggctcaaaaaatgtacttctcatggttatgctccagcaaaggaaactgataagaaagaggaagtcatagatggaggaaacagggaacctactatggaagagacagagagatgtcccaggagaagagaaattcatctggcctatggaacagccagttggtattacagcagaaggatgcagtgctctggatggaaagttttccaggaagaaataaaaatgagtcagacaagtagcctgaaaatgttgaaagattttggccagatccattgagcacttggagaaaaaacagtgttaagcatataggaaacaaagcagatgaaaaaataatacaattacaagttccaggaaaggcaaaaaggttaataagaaaggaaacataatgaaagaacattatgtttacatagtcttaataatagaaatattactatgggccggaggtggtggctcatgcctacaatcccagcactttgggaggccaaggtgggtgggtcacttgaggctgggagtttgtgaccaacctggctaacatggcgaaaccctgtctctactaaaaatacaaaaattagctgggtgtggtggtgcgtgcctgtagtcccacctgcttgggaggctgaggcaggagaattgcttgaacttggggggcagaagttgcagtgagctgagattgtgacactgcactgtagcctgggtgacagagtgagaccttttctaaaaaaaattaaaaaaataaaaatattactatggattcaaccaaaacttgtaaataattgagtaagagcccaaatgcttattctccataataagaactcaatgcgaaagtctaaaatttataaatgagtaattagcagtgtacccaaattcattacaaaatggagctcaatgtggaaaaaagtggttaaaaactgaaagtggttgccttcatggaatgtgactaggtaatggggagggatagagaggggataaccttttgtataaggtcttctagttctatcttattaattcatatcttttattttgctatacataaataattttgagaaggtttaggataaaataagttggatcttttattcaaaaattgttttgtttttttctgattatgtaaataatataatcatttttaaaattggttcagtagtaagcctaaatgatagcttacccatcttgtaaactagtttactagagaaaacagaccaacaataacactctctcctttctcatttgcttcagggtttgagaatgtttttagctggtggcaataaatattagaagcctgcagaatccagctacgaatatagagggttttgctcttgaatttctggttcaaattcttttttttttttttttttttttattgatcattcttgggtgtttctcgcagagggggatttggcagggtcacaggacaatagtggagggaaggtcagcagataaacaagtgaacaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacttctatccacacagacccggcaaccatccgatttctcaattttttccccacccttcccgcctttctattccacaaaaccgccattgtcatcatggcccatccccaatgagccgctgggcacacctcccagacggggtcgtggccgggcagaggggctcctcacttcccagtaggggcggcccggcagaagcgcccctcacctcccagatggggcggctggccgggcggggggctgacccccccaccgccctcccggacggggcggctggccaggcagaggggctcctcacttcccagtaggggcggccgggcagaggcgcccctcacctcctggatagggcggctggccgggcggggggctgttccccccacctccctcccggatggggcggctggccgggcagaggggtcctcacttcccagtaggggcggcccggcagaggcgcccctcacctcccggacggggcagccggccggaaggggggctgacccccccacctccctcccggacggggcggctggccgggcagaggggctcctcacttcccagtaggggcggccgggcagaggcgcccctcacctcccggacggggcggctggccaggcagggggctgatccccccacctccctcccggacggggcggctggccgggcggggggctgaccccccccacctccctcccggacggggcggctggccgggcagggggctgaccccccctcccccctcccggacggggcggctggccgggcggggggctgacccccccacctccctcctgggcggggcggctggccgggcagaggggctcctcacttcccagtaggggcggccgggcagaggcgcccctcacctcctggacggggcggctggccaggcggggggctgaccccccacctccctcccggactgggcggctggccgggcggggggttgaacccccacctccctcctggacggggcgactggccgggcagaggggctcctcacttcccagtaggggcggccgggcagaggcgcccctcacctcccggacggggcggctggccaggcggggggctgaccccccacctccctcccggactgggcggctggccgggcggggggttgacccccccacctccctcctggacggggcgactggccgggcagaggggctcctcacttcccagtaggggcggccgggcagaggagcccctcacctcccggacggggcggctggccgggcggggggctgacccccccacctccctcccggacggggcggctggccgggcagaggggtcctcacttcccagtaggggcggccgggcagaggcgcccctcacctcccggacggggcggatggccgaccacccccccccgcctccctcccggacggggcggctggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggttgccagacggaggggctcctcacttctcagacggggcggttgccaggcagagggtttcctcacttctcagacggagcggccgggcagagacactcctcacctcccagacagggttgcggcccagcagaggcgctcctcacatcccagacagggcggtggggcagaggtgctccccacatctcagacgatgggcggccgggcagagacgctcctcacttcctagatgggatggcggcggggaagaggcgcttctcgcttcctagatgggatggcggccgggcagagacgctcctcactttccacactgggcagccaggcagaggggctcctcatatcccagacgatgggtggccaagcagagacgctcctcacttcccagacggcgtggcggccgggcagaggctgcaatctcggctctttgggaggccaaggcaggcggctgggaggtggttgtagcaagccgagatcacgccactgcactccagcctgggcaccattgagcactgagtgaacgagactccatctgcaatcccggcacctcgggaggccgaggctggcggatcactcgcggttaggagctggagaccagcccggccaacacagcgaaaccccatctccaccaaaaaaaaaacgaaaaccagtcaggcgtggcggcgcgcgcctgcaatcgcaggcactcggcaggctgaggcaggagaatcaggcagggaggttgcagtgagccgagatggcagcagtaccgtccagctttggctcggcatgagagggagagggagacggggagagggagagggagagggagacggggagagggagagggagaggggtcaaattcttatctatcaatgttatgcccactgtgctctccagctgtggtctgtgaattactgtggtataacgtgactgttcaaatttcacttttcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcggtaagttttgcctactcagccctcctcactgttacactaccttccccccctactccatcacactactatctactcatattcagagcctattagaaagtgctatgtgatttagatcacattaacaggtcagagaactgtccaaggggagtggtttccgttcaactctaaatgtctagctgtagatcacatagctgcatttcccaggtcagttacaaagtgggagagtggcaagtgttaacatccttagtttatagatggaaaagctgagatgctttattcctttattcagcacctcaaaggacaatcagggtatcacagagcaggaaaggataggaaagtcatatactccagctctctgtctttaggccaaaacatgactgagccaattcaactagttttggaaatcttccaagaaggcagtaacccaattcaatgtttaaacatcctccaactctgtcaaaagttctataatagcaaaccatcctcaaaacctcttggtgcattatgggagataaatagcaggttccttctagccctgtatttcatgttttgagtatatgaagagtgagaatttcccgtaacttagatcatgaatctaacttagatttcgtaacttagatcatgaatcctgcaaggtttccgcggctagctaccaaggtagaagaagaggttgcctaacaaaaatgctaagagatcctggtgagaagaaggtgggagtagctgcaggagacgttatactttcacttgccttaagtttaattgcatcaaagatgaatccgcagatgcgatgtcaattcgaggcagagagtattggggggcattgaagcaatggggagccaagtaacgtggagaagagtgagagacacacaggtcaggagagaaagaaaccaactctaatactgacaccgaggtttctgatggtcaaaagagttcctgaataaaccaaaagtaagttattaagctctgagacaacccatttaccaggaaagctggggtaggtcttggtttcgcaccttattgtttcaaatgactgatattttgagagaaagaactacagaactatctctgagcacagcagaggagacagttcatcagttgctttcccccacagacagtcacaatattatgtgatgtatttcagaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttatt

SEQ ID NO: 1571 - DNA, 2513 bp, Homo sapiens
  source 1..2513: mol_type = genomic DNA
atgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccaggtaagccccccaactccttacaggaaaggtaaggtaaccacctccagagctactaggtcagcaagaatctttacagactcactgcaaattctccatttgaaaaatagggaaacaggttttgtgggtggacaagaaatgcctcaacctcacatccagtcactggaagagccagaactagaaagctcccgagtcttttccccacattcaagagggttgctgggtgcatccatacccagctatccttacagtgtttgggaatggggaatggctctgtcttactgtgggcatggtgggcatttttggcagtgggagagaaggaaaatctgttgattagaagctcagtatgttaattcgactccaggacagctttcagagacagtggctaagagaagaacgaggtcccagggggatctcttgaggtgacttattttgacactctttgggaaagttatctaggagatttgttccataactcattttcccatactctggtgacaaatttactgagtgtatcggtcccactgagccagtgcatagcatggtaacaaacagttctaaattatcaatgacttaacagaattaactaaattaacaaaagttactttctcacttgtactaaatatctataatgtatgggctcaggcttctgcattttatactcaggattctagactgatggagaagttgcccatgtgggggaacattgatggatactgtgataaagcagaagaaagctctcaggagtcttgcataggcaatgcactgtggctcaaaaatgacacccatcactttgtctccttctttattgatcaaaactaattaatgcctccaaccaaacaaaagtggccaagaaatgcaagtctaccttgtgtctcaaaacagaggatggagaatatttggtgaaaattaccatgaccatcacatggccacgtaggtctttataatgacagagctagcatttgtcacattgaccaagctttgtccatacactctacagtaatgatgagtcctcagtgcacaggggaggatgctgaagacacaggacagcatcctccagacacataagacttcagagcagagggattctccctccacctctcgcaattccttgctttctcctaacttcctttacaaagtcatgcttggaaatgtctatgtatcatcatgtggctcatttttttctctgttcattttttttccccaaaattcagcttctgtcccaaccacctgctgctttaacctggccaataggaagataccccttcagcgactagagagctacaggagaatcaccagtggcaaatgtccccagaaagctgtgatgtaagtaaataaagttcaccctcccctagacaaaaaaataatgtctagggcacagagtcaagaactgtgtcacagttgctgggagtcatagactctgatagtttgacctctatggtccaattcattaattttcacaagtgagtgttcactcccagctccctgcctgggagattgctgtagtcatatcaatttcttcaagtcaagagcaaagatggttttactgggcctttaagagcagcaactaacccaagagtctcatccttcctcctctccgtagcaaccctttgtccaggggcagatggtccttaaatatttagggtcaaatgggcagaattttcaaaaacaatccttccaattgcatcctgtatctcccacagcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatttttttttttaaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacataaagtatgtgcatattttattatagtcactagttgtaatttttttgtgggaaatccacactgagctgaggggg

SEQ ID NO: 1572 - DNA, 1925 bp, Homo sapiens
  source 1..1925: mol_type = genomic DNA
gaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccaggtaaggccccctcttcttctccttgaaccacattgtcttctctctgagttatcatggaccatccaagcagacgtggtacccacagtcttgctttaacgctacttttccaagataaggtgactcagaaaaggacaaggggtgagcccaaccacacagctgctgctcggcagagcctgaactagaattccagctgtgaaccccaaatccagctccttccaggattccagctctgggaacacactcagcgcagttactcccccagctgcttccagcagagtttggggatcagggtaatcaaagagagggtgggtgtgtaggctgtttccagacacgctggagacccagaatctggtctgtgcttcattcaccttagcttccagagacggtgactctgcagaggtaatgagtatcagggaaactcatgaccaggcatagcctattcagagtctaaaaggaggctcatagtggggctccccagctgatcttccctggtgctgatcatctggattattggtccgtcttaatgacacttgtaggcattatctagctttaacagctcctccttctctctgtccattatcaatgttatatacccattttacagcataggaaactgagtcattgggtcaaagatcacattctagctctgaggtataggcagaagcactgggatttaatgagctctttgtcttctcctgcctgccttttgctttttcctcatgactcttttctgctcttaagatcagaataatccagttcatcctaaaatgctttttctttgtggtttattttccagatgcaatcaatgccccagtcacctgctgttataacttcaccaataggaagatctcagtgcagaggctcgcgagctatagaagaatcaccagcagcaagtgtcccaaagaagctgtgatgtgagttcagcacaccaaccttccctggcctgaagttcttccttgtggagcaagggacaagcctcataaacctagagtcagagagtgcactatttaacttaatgtacaaaggttcccaatgggaaaactgaggcaccaagggaaaaagtgaaccccaacatcactctccacctgggtgcctattcagaacaccccaatttctttagcttgaagtcaggatggctccacctggacacctataggagcagtttgccctgggttccctccttccacctgcgttcctcctctagctcccatggcagccctttggtgcagaatgggctgcacttctagaccaaaactgcaaaggaacttcatctaactctgtcctccctccccacagcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaa

SEQ ID NO: 1573 - DNA, 8882 bp, Homo sapiens
  source 1..8882: mol_type = genomic DNA
ttatggttgcattgagaactttaatggtaagccgatttttcatgtttgccagtaagctcctgtgaggggttgagacggcggaagcttaagagtgcagtgttcctcccctccttgcctctagaggcatgctgacttccttcctggtcacagagccctggcaaagccaaggcaaagccagagctcagaacctagagacttccttttgacaaagcagcgcctcagaagctcttctaggctttagttggggaagctttttgttgttgttgttgtgacggagtctcactttgtcacccaggctggagtgaagtggcacaatctcagctcactgcagcctccacctcctgggttcaaacaattttcctgccttagcctcccgagtagctgggattacaggcgtgggccaccacgcccggctaatttttgtatttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagatggggtttcatcatgttggccaggctggtctcgaactcctgacctcaagtgatccacccaccttggcctcccaaagtgctgggattacaggcgtgagccaccacgtccagcctggggaaggtttttgtaactgctgctgtgtggtagaatctgggcccttcaaggagcgggtggggtaggatagtgaggggaagcctcccaagctaggacaagagcaagcagaaacaggcaaatttgtgtaagttcaggttcaaggactctccatcctagctcatctccaaagagttgatgtactcccgaacccatttcttctctgggttggcacacacttggcggttctttcgggtgacaaagctgtgggagaggagaagaagagggaggatgagaccttgtcagtaccgggacagccagtttgggggatgaagtggattaaggtataaagggaaattatgatgatatcggggtagggcatatttggagctccataagattttatttgtggcttttaaggagagaacatttcctcatctgttggatcaaagggctccaagccagaaacaaatttgtgtgcattttaatcgccttcacacaaatgcatgtagcctgaaaagctaagaggatacggagccttgaagcccagggctgagcctgccaatcactagacttttctcagcacttcctctgctccaggccttgtgctgggtgcttaagatgcagagagaataaggtgtccctcaagaactgagtcatgattgaataagtgggagacaagaagttctttttttttttattttttgagatggagtcttgctctgtcacccaggctggagtgcaagtggcacgatctcagctcactgcaactttcgcctcccgggttcaagcggttctcctgccttagtctcccaagtagttgagactactggcgcccgccaccatgcccagctaatttttgtatttttagtaaagatggggttttaccatgttggccaggatggtctcaaactcctaacctcaggtgatccacccaccttggcctcccaaagtgttgggattacaggcgtgagccacggcgcctggcctctttttttttttcctttgagacggagtctcactgtcacccaggctggagtgcagtggcacgatctcagctcactgcaagttccacctcccgggttcacgccattctcctgcttcagcctcctgagtagttgggactataggcgccccccaccacgcctggctaattttttgtatttttagtagagacagagtttcactgtgttagccaggatggtctcgatctcctgacctcgtgattcacccaccttggcctcccaaagtgctgggattacaggcatgagccaccgcgcctggccgagaagttcttaaaagaacatctgatttggctttagacaacgcagtgcctggcacactcaacaagtgaatacatctgtgcatgggtgggtgaacgaaagatgggcatgaccttgagtcttcatttcaccatttattagtttgatcattttgtgcaaatcacttaaagcctctgcttctatttgctaagctctgaaatgtagatagaaataattctttgcacaattactgtgaagctcaaaggataatatgtatgaataagtttggaaaaataccattcatgtgttgttactagaatgctctgaaacttctcctttagggtggatgagagcaacatgagactaaaagtcctggtactagacactgtggctcaggggagttgagggccatgagataatggcaatgtcaaagcacttgcaccaagtaaccagccagaatgtggaggcctatgagaatcagaggccttatctctatagtcattgatgataaagctggaaatgtaaaagttgggggtcatgagggtcagtccagctgcctgcctcacctgtctgctgggaaactgattctacctgtgcgagaccttgggccttgctagcagcgctgccaattaacacattacttcagggtcagtcctgcctacttaccctttcccattttggcttttcctttaggattttttcctgcacattattcttattattatttgaaatttgaacactgattttacttaagttcaaatactggatatgttattttagagattctcataggaagaaaatcaactatttattgtgcagccatccagaagtttatttatttatttttatttttgagacagggtctcactgtcacccaggctgaagtgtagtgacatgaacacaactcactgcagcctcaacctcctgggctcaagtgatcctcccaccttagcctcctgagtagctgggaccacaggtgtataccaccacacttggctaatttttaaaaatttatttttgtagagacaagctcttaccacgttgcccaggttggtctcaaattcctgggctcaagccatcctcctgcctcaatctccctaaaatgctggtattacaggggtaagccaccatgcctggccagaagtttattttattttttatttttgagatggtgttttgctcttattgcccaggctggagtgcagtggcacaatcttggctcactgcaaccttcgcctcccgggttcaagcgattctcctgcctcagcctcctgagtagctgggattacaggtgtgcgccaccacgcccagctaatgtttttgtatttttagtagatacagggtttcatcatgttggccaggctgttcttgaactcctgacctcagatgaccacccgcctcagcctcccaaagtacagggatcacagacgtgagccaccgcacccagatagaagtttattttttaaatcttattgacccatgcagtatgccacatgattacatagcataacaaaggaattatatgtctcaaacaacacagaaattccgcctttgcttttgtgattactatcacattaaaaaaaaaaagaaatgtattccctagatggaagtattattcccaaatatgttctgatgtgctatgtacccaccttatttaaatatttcatcactcattcattctttggtttaatattttcattctttctctatgcatgtattggtgtgtctgtcaaagtcattaagctcttgtggttctcctgattctgtgcctaacagcattaaatttttttttaattgtggtaaaatattcataacataaaatttaccatcgtaaccatttttggatgtatcctgcacattcttgagcctaaatattttcagacaaagtgaagccttagattgtctggtgagaatgaggatttcttggtttctctttgtgtttccctttcccagcctcactcagagccacttgaccatctctttttctcccaccccggtgtgcagagatgaaaagggaacggaagcaatattctggcctctcatactttctagagtttgtgttcttatttagggtggtgtgagagtttcagacacagaccttgcccttgttcagccgggagtcatacaggaaatcctgccagacttgctgtccctctctctttggcatccttgacctgtggctaggaagtcaaaaggccaggaaaacaatacctgagatgagggtagctcaggcctccatttcctgcccccaacctccccgcagactgtgataccaaagaacagcccctccttgccaagtcttccctccttacctccatttttggcaccctctgcttgcctgacttcctccttctgcctaccccttaagagcggatgttctcaaagctgctgcccttttctcttctttgcgttttttcctaagtctctggccctgggcctggcacatagttgatgcttaatggatgtttattgaatgattaagtgaatgaatgcaattcactcattcattccttaagtttcacctgttatttttgtgtacgcaataatgcatttagatgataatgataataataagctaacatttatgcacctactgtgtaccagagcatattctaagtattttcatcttactgtgacccagtgggggaagtacttctattaccctattttgtagaggaggtaattggggttacgagaggttaattgaagggcctacactcaccaagtgtcatagctggagtcctaacaaagcaaactagctctagagccagtactcaccaaggcaggctgcattgcctttttaaaattgggatacccctttttcccacaaaagaatgtcatattttcagccctaacaccctttcctcagctaccaacccttcatttcaccatcaccactggacatatccacagggttatcttgctggcaccttagctctttcctctttaaacagctctttcacaaggcttaagatggttctacacttctccagccagaggtggaaacctcagtgtcatccttaacccccatttttctcccttgctcttgagctcaaatcacctgctagggcttgcaaattccacctttgaaggtttcaaaagtgtctgtctttgaaacctcctgtctctcctttccttcaggcactgttcagcctccaatactactcacgtggataacaacagtagccgctaaactggactcctgttttctcagctttccctgttctagctcattttacacttgacagctgcatttagcacttttgctgcattttcctgacactccgtgctttcctacatggagactgtacataaaccaaagtagaatcctgggggacagtcccttttcctgatatatcccattccctaggcttttctctgccaggccaaatctctcctcagacagcaccatttgcagcaaacctgtaaatccctgaagctgaatgtgtttcctctctctttcccttgtcatgtttttttttgctgtgtactctagtcattgctgtgtctgtcttgcccctcttattagactatgagtcccataaggttgggctgggacagtggctttagtaatctgtgtctgccaatagtatgtgctcagggaaggattttcttcttttgaaaaatatttgttttcagaaataaaattagtaattgttaaatattaccattatacttaaaaggattcatcagatccaaagtctgtctttgagtacctctaactttgccagtgtcataaatttttggattaaaaaacttcaccctggctgggtacagtagctcacacctgtaatcccagcactttaggaggctgaggcaagagaattgcttgaacccgggaggcaaaggatgcagtgagctgagattgcaccattgtactccagcctgggcaacagagtgagtgagactctgtctcaaaacaaaaacaaaaacaaaaacttcactcttatataagaaacttcagaattgcaccattttcattttttaagtctctaccataaatttcttaagcaattgtcactaatgactttgctatagtagaaagaggaggctctagagatggacttcatccctcatttactgtgcagccttggctaaatcaataaacctctctgaatcttagtttcaatacctgaaacatggagagaattatgcatacttgtcagagctaagtgtaatttaaagatcaggcacataagacatttgacacatagtaggcatttcctatatagtagggtttattatatttttccaaatatactagcttgcatatttaaaggtgaatctcatttccttatttcttctctgatggatggctttttgtttttttatttgactacagttatagatccctgacctctgacctcttctccctagttcctctgaggtttaggtggatttgattgggtgtgaaatatgggggactgtgtgaaatatggggttcttcactgaaggggatgactgacttgatcttccccacataggagcattccagaccatgtttcaagtaaaggccacactagtaaagattggagtcctaggccaggcacagtggctcatgcctataatcccagcactttgggaggctgaggcgggtagatcacgagggcaggagatcgagaccatcctggctaacacggtgaaaccccgtctctactaaaaatacaaaaaattagccaggcatggtgtgggcacctgtagtcccagctactcgggaggctgaggcaggagaatggcatgaacccaggaggtggagcttgcagtgagccgagatcgtgccggtgcactccagcctgggcgacagagtgagactctgtctcaaaaaaaaaaaaaaaaaaaaaaaaaaaaagattggagtcctgggaacatagtccattggagtgggcacgattctctaaggacagcttgtctagtctttttacatgatagcaggggactctgaggctagagatggaggagctgtggctgcttgcagctggaggataggtggaagtgggtagggcatcctctcagaggactcctcagggaacaggctctgggagggctccatggggctgagactcacacgactgctgggttggagcacttgccactggtgtagaaatactccttgatgtgggcacggggcagtgggcgggcaatgtaggcaaagcagcagggtgtggtgtccgaggaatctggaagaggaaaggaaggagggagacccttttattcattgctactgcacacttgacattgtgctggacactttatatgatttatttagaaagaactgttatcttccttgacagaaactgaggctcagagaggtaaagtcacttggccatggataaacagtggcagagtggggattccaatgcctcatctaatccttgagccaagcttgtatccatccctctacaccataaccttctgccctgggctttcagggcctcctcctggcttgtcctgggtcctctggcttcattcttgcccttccagcatcctcaatggatttggaacttggtttctttgagacctagggcaggttgtggggaggcttccaaagctcaggctccatgactcagccaggatcctaagaagggcctggagatgcatattgtatcttgggagctctggttgagcttcagtgagaagggctctcaacagagaacttcttgttggtcagttaattcaagatgacgttgggaagcatcagttgccacttcccagcagaggagtagtttttattttcccagcaagatggaaccaggtttgaataccagtctccccatttcctagctgtgtgcctccatggacaagttacttaacctctctgttttcccatctgtacatcaaggacagctactcaaagaagggttgtgggtattaaataagatgtacaaaaatcggctgggcacggtggctcacgcctgtaatcccagcactttgggaggccgaggcgggcggatcacgaggtcaagagatcgagaccatcctggctaacatggtgaaaccccgtctctactaaaaaatacaaaacattagcagggtgtggtggcgggtgcctgtagtccccgctactccggaggctgaggcaggagaatggcatgaacccgggagacggagcttgcagtaagccgagatcgtgccgctgcactccagcctgggcgacagagcgaagactccatctcaaaaaaaaaaaaaaaaaaaaaaaagatgtgccaaaatcagcacaatgcctgatccatagtaaccatttaattagcttttattatcctctccttgtttttatttgttttttaaatgtattcactctaataaagccacataccctctcataagccaattttttttacatttatgaaatgagagagaatatggctgtctcagggtctcaggaagttttagtttagttaaatttcttagaaaccctgctgctgacaggcatgagtcagacgtgtttcaaagtcagtgtgagctactcatgactactaatctccccaacatgagtccacactcagtgaacacctgtaggccttgagggtgtagaccttaaagacagaaaaactgatcaggagatccctgccatgaagcagcatagagatctctcaaggacaacaggacatatgggtaagacaattcataagaatgtaaataatggggttcagacagtattcatgctacagttgaaaagagggcaaggtgtgggacagtcattgggatggggtaggcattctaggcagagtctgactccaggggctgtggtggtcaagaccaggacttacatggggaggcagatgcaggagcgcagagggcagtagcaatgaggatgacagcgagggctgccgcggagaccttcatggtacctgtgggagaggctgtgcgaggtccacgtgctgtcttgatcctctgcaggaatcctctgcagc

SEQ ID NO: 1574 - DNA, 7179 bp, Homo sapiens
  source 1..7179: mol_type = genomic DNA
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctggtgagttgtaggcattttttccattactttctgattcataggctcaacgcacctcaaagctggaaatgccgggtctgggtacaccctggggaactgcaaagcctgcacacttggggggaatgatcaagatgagaggcaggggtggggatggcatgtgcaccaggagatgttagagaaaccctgaggaagagcagcgtgcagcaggtgatgggggagagtgggcagcaagcgaggccaggacagccactctgctcagtcaccagtccacacacccaggggctcactctgcccctctgagcacccaaggacgttaaagagctggaactgttagtctaaatataggaccatccaagctctgaaccaaaatgtgtcccttgcctcaactcaggagatccacagaggcagaagtaaggaatttattttctgaaagatagatttctatcagttctgggtgacatgttctgacacttgaaatgacacctaggacagcacatttcaggcatcttgctcattgttcactgtagtagaagctacatgctagccagttgtaaaaatgaaattaagtaatgtgtgcacagcatttaacatagcatctgagcttcaggagcactcaattaatgaccacagttgtgattctttaggcagatgcatttttttccaactttgatcagaggtcttatttagcttctccagatttcaagaatctggctcagtgatatgaaatacaagacttgtgaaaagtgtcaattgcaagagaaatggaaggataaagtatacaggtgggtggaaaagaaattcacagtcactgccagaaaaaaaattcttgagaatcaagtcctgatgatgttagggcttatagttcttattataaagagttttatgtactcattcagtgaacatttattggtgcctcctttagccaggtactatcataagagctgaaaatagaagcataatccagtccttgatcttgaggaacatgctgtgtgtagcagataacataataagtgcttatctagatgcatgcagtgttatgtgataagagtaatatgacagaggatacagattaggcttcacagagaagggggatttgagcaggaggtattgaagggtgaatagaagctcaccaatcattttgggcagaggggcaaggacctgcaaaaccactgaagcatgaaggaaatggtgagtttagggaaaatgaagagaagatggctgtgactgaagcacaggatttgggattggagaagggactggaggtgaggctgaaaagaggcaaactcagaaaagatgttgtgctgggcagtctggacattatctttgaagcccaccacatataagtcatagggctactggaggttttaagctaagagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcaacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgcttgatctctccaggaggtagtgattatgagaagggggtggagaatgatgagttccttcaccaggagcaaaggacggggatcgtgtggaaccactgcagaactatttccgaaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaagttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttga

SEQ ID NO: 1575 - DNA, 5634 bp, Homo sapiens
  source 1..5634: mol_type = genomic DNA
tttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctggtgagttgtaggcattttttccattactttctgattcataggctcaacgcacctcaaagctggaaatgccgggtctgggtacaccctggggaactgcaaagcctgcacacttggggggaatgatcaagatgagaggcaggggtggggatggcatgtgcaccaggagatgttagagaaaccctgaggaagagcagcgtgcagcaggtgatgggggagagtgggcagcaagcgaggccaggacagccactctgctcagtcaccagtccacacacccaggggctcactctgcccctctgagcacccaaggacgttaaagagctggaactgttagtctaaatataggaccatccaagctctgaaccaaaatgtgtcccttgcctcaactcaggagatccacagaggcagaagtaaggaatttattttctgaaagatagatttctatcagttctgggtgacatgttctgacacttgaaatgacacctaggacagcacatttcaggcatcttgctcattgttcactgtagtagaagctacatgctagccagttgtaaaaatgaaattaagtaatgtgtgcacagcatttaacatagcatctgagcttcaggagcactcaattaatgaccacagttgtgattctttaggcagatgcatttttttccaactttgatcagaggtcttatttagcttctccagatttcaagaatctggctcagtgatatgaaatacaagacttgtgaaaagtgtcaattgcaagagaaatggaaggataaagtatacaggtgggtggaaaagaaattcacagtcactgccagaaaaaaaattcttgagaatcaagtcctgatgatgttagggcttatagttcttattataaagagttttatgtactcattcagtgaacatttattggtgcctcctttagccaggtactatcataagagctgaaaatagaagcataatccagtccttgatcttgaggaacatgctgtgtgtagcagataacataataagtgcttatctagatgcatgcagtgttatgtgataagagtaatatgacagaggatacagattaggcttcacagagaagggggatttgagcaggaggtattgaagggtgaatagaagctcaccaatcattttgggcagaggggcaaggacctgcaaaaccactgaagcatgaaggaaatggtgagtttagggaaaatgaagagaagatggctgtgactgaagcacaggatttgggattggagaagggactggaggtgaggctgaaaagaggcaaactcagaaaagatgttgtgctgggcagtctggacattatctttgaagcccaccacatataagtcatagggctactggaggttttaagctaagagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcaacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataatattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaaga

SEQ ID NO: 1576 - DNA, 6065 bp, Homo sapiens
  source 1..6065: mol_type = genomic DNA
cttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttgtttccgtttacagagaacaataatattgggtggtgagcatctgtgtgggggttggggtgggataggggatacggggagagtggagaaaaaggggacacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctcttttcgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagccgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctgtctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataa

SEQ ID NO: 1577 - DNA, 6065 bp, Homo sapiens; identical to SEQ ID NO: 1576
  source 1..6065: mol_type = genomic DNA

SEQ ID NO: 1578 - DNA, 14514 bp, Homo sapiens
  source 1..14514: mol_type = genomic DNA
ttcatttctcagccttttcttttaaatttattatgcttttcttttcttttttcatttaaaataaggattgagactttgtccccaagtaagtttctcaaatggctacattactgagaacccagacccaagcacaatgctgtagtgggggtgggtagtgggctggcttcagctctgacaaattgtgggggctgatgatctcctttcaggggcggggtgtgtggtgctgggagggatgtcggtgagtagaaggggaatggcctccctgtgggagactccggggccggcagtccctgcccagtccctccctctgcttcctcccactcttccacatgcggaaagggctctgtgcctctcacagcagcatctgaccctctggactgagtcattcggtgtacttgcctagaaggttctttagctctgggactcacaggagtaagaagctcagaaaagcacagtgagtccctgcccagttccaggaagcaatctgaaaagtctggtctggtcaccagcagatgacagttctttcacttagagcaattttgctaagcacacttatttgctttctctggaaaccttcagcactaaatgtgttggtatttccacctgagaaggtatttaactgcaaaaaatagcagaatagccaacaataatagaaatactatgagaaagaaaatgcctatggctgtaatcccacaggaaagcttgacatcagatagcttaactccccttagagatggcgggtttgcacacgtggtctcctccgagccttcaagtttgtgcaggttttctttgtaccatgttaagaaatgaatattcgagcaagtgcagtccagggggttatgacttaaattaatggtgctctgctgggacaagatagggaggagacggggtgagatgatgttaatgctgttggcagccagattgaggtagattcccttaagatggctaagagaatcaatgctgtcgcatgtcaggctgttgtggcttaagtctacatggctcatttttcccaagctgtggaatgcttgctggtctatagagaggagaccacaagaggacaaaatcagaacctccaagctgcccacggtctgaagtaggttggtcttcgtgatagtcccatcttgaaagtgattcccttttaagttgagatgccggagaactggtaggcctgctagaagatgctgattgctggtatcaaggaagcagtaagtgagattcagaacctgaaggaaatggaggttttggaagggactttgtggagcattaatgtgtaagcgggtaaatgccaaatcgaggagttctagctgaggacattctttgaatgcctgactctggagaccaagaggctcattgtggctcaggtttaaggtttgcaagtgggacaggtttttgagttgcagactgcagcagtcagaagcctctatgtcattatggcttaaatcaagtgtctgaaggtttcctagtttctccaagcagccaacaccaaggtgaagtttcttcacgttgcctctgatgtagaggtgtgtaagggaggggaaattggcagcactgatttgacacaattgatcgaaatgatttacactgagaactaatttcttgagcaagttcagacccttcatcccagagggtaaccctttcaagtgagttgctgtcagatccaattcttggagttgggtgaagcactgaaatgtggtggatgagatgtcagagaagcggtgttcctgcaggttgaggctctcaacagacatttcacagagtcccttgagcatggctgaactaatatcttcgtcatcaatgtcctcaaatgttcccagccagagagactgagtagtagagttctgcagaccattgaatataacagacaaatttggagttcctccaaagttcaaactttggaagatcgttgaatcaaaagccccaagctcaatacctttaacattattgccattgaagttcaggcttaggttgatggcctgctccagagacctcatgtcttctctagagatgtagtgtatagcattattctgaaaatccagtactttcagattccgtgctgggaagtctttggggaacttaatggaggaaatatggttgcttccaagatacaagctttccaagttttccagattgtgcactggaataaactcgagattggatattcccgtttggattaagaaaagatgcttcagtgacttgggcccattaagcgatgtttctgccatgaatatcaggggatttccagttaacacaagtgtgcttaattgatgatggctttgaaaagtgtcttcatgtatccagttaatctggcaccttgaaaagataatcgtatttaacaataattcatttgaaaaaagtaaaaaaatactttacagtgacacacattaacaaagtcatcttttgtatcattcaaaatcaaatataagaactttcttcaatatcaacagatggcctattgaaggaattaatgagtagcctcacttctgaacacgccaatctagattttttttccaggtatctcaccccttagattgaaccctcagaggtttgtgcctgtattctaaggaaccatgggtcatttgattgtggcaaaaatcaaattattatttactgttttaagtaatacaaaatatatcatatagaatgcataatagataatatatggtataaaatacatatatatatacacacacaaaaatctgtgtcatcccgggcaagttacaacttttctcaacctctgtattttcatctgagaaaaccatcctggtattgcacctaaaaatactggatcacacacacacacacacacacacacacacagatggcctcctcatctaaccataagttggatgatactacgcaccatggaatctcacactggtgcttttaaagatgaagcggtagtatggatgtggacatcctgtccacagaagctgaagttgaaggacaaaatagaagaagtagaactgccgcaaagggtgcagactgcaggtacacgcagagcctgtcccctcttacacacacacacacacacacacacacacacacacacacacgcagtatagccctttcattttcttcccttattttcttgtaatacttcttcctactggttctcaaacactggctcagcatgtggaatcccaattatgccactataacaaaataatggaactcattttccaatttgtaggggggaaaagtagatggtgtgcttttctcctagaaatttttcttaaatgtaattacccaaaaataaactatgccaaaatttagcatagtttggcatctgatttagtacaagattattttcatttttgctatcagtattccttagaactgcttcaacagtgctattgatgcaactggtttgagagcaatccattttcctctccattggttgatgtttatttaaattacatttcacccacataggagtatttcatggggaggcataaacatgtagtataagcagattgtccctgggccccccaaaaaggtcctgcaaataaattaagcacatactgtattttaacttaaataaaataaaagagcacacaaataactcagatacatacctagttaaatccaaaaaggtaagattcatgagtctgctgaaggttctattgtgaattgtaggcaaaaaattaaagctgaattccaaaaattctgttgtgtttggtagagtgtcagggatttcactgagacctaaattttcacagttatatgttttgttggcttctttctgatgggagaaacaaagtaaattaatattagacttaataattttatagactatctagcaaaattatatatgttttaccttccgagcggcaatcgtacttctagtaatctttaccaaatatacacttgccaaaaacaagatgatgaatgcacattgttaactgtagtactttttttgtaatagcaaaattgacaataaccagactattcatcaatataggactacttgaacaaaacatggtacattcacaaaatggaatcctctaaaactgaaaaaaataaaaaaaaccctccatatattgatatggagtgatatctgggatatatttcaaggtgaaaaaagcaaaatgcagaacaatatatgtagtgtatatagtatacagtatgtagtataatgtacagagtatgccttttgtgtaagaaaggtgtgtgtgaattttcttatatttgttaaaacaaaccatgcaaaaacccaaaaactgattgcctttaagaagagggaagagaccagatagaagagcagggataaatgtgagacttctctgaatgcacttggttttacagttttgattttggttgaatggaaatgtttaatttcagtttgaaacaaacaaatcgaccttagataagcatcaccaaaataagacaatcaaacattacatactttcgtatgtgagacaatgtgaggtatacagcattgtctatgaagtattcttgccaaaaaaataattaaactttaaactcatcaagattttaggtttaacttcacatctcaaagtgatatggtggatttaagtgggacattctatggaacaactgactttgttctatctgtgtgtgtgtgtgtgtgtgtgtgtgaaagagagagagagagagagagagaatgagagaggagatagtgcttgttaaaagatacagagatataagatctacttaagagacataaccatcaaataatacagtagacctcatttagatcctgatccaaataaagcagttcaaaaaggcattttatagactgtcaggtaattttgaatgaggacagtattcaatgatattaaggaattctggattttgtaaatgacagtggacttgtggttatttaaaagaaatgttcttattcttttgagaagcatatttaaatatttaggagtaaaacagcatgatgctggaattggctctaaaataatctggcaaaaaaggaggagaggaatgcagagatgaagtgagtaggcaaaatgcttatgattgtcgaatattgagattctttgttactatttctgtatatgtttaacatttttttcttaacacagtgcttaaaaaaactagcagggtggcatagacctgaggccttgcaatcttgaagtatgaattaattttagatctctgtatttgtaggctgctgataccagacagtaggcttttgggcagaaccctacacataagtacagataacttcctcatcctgtgccccagggtagtcatgtattctgaagcctgccaatcatgtcctaatacaagttatgtgttgaactaagtaggtaaaaatgggaagtggttttttagaagcctgtagaactgtggggtcattatttatctggctaatgctttaagatgaagggtagtggggaaaataggaaggtctgacagggcaggtatgaaagtctgatggagtatattttgcctgtggagtctccttggaaagatatgaaggaaagttcctgctatgctttgaatatgtcctccaaagttcatgtgttgagaacttaattgccattgtaatactaagaggtgaggcctttgggaggtgattggatcatgaagattccacactcatgaatgaattaatactattattgcagggtgggttagttatcgcgggactggactcctgataaagcaagtaagttattgggtggccgaggtaggcagatcacgaggtcaggagttcaagaccatcctggccaacatagcgaaaccccgtctctactaaaaatacaaaaattagctgggcgtggttgcgcatgcctgtaatcccagctattcaggaggctgaggcaggagaatcgcttgaaccagggactcagaggttgcagtgagccaagattgcaccactgcactccagcctggccacagagtgagactctgcctcaaaaagaaaaaaaaaagattgggggtaagttaggcctccatttgctctgtccacatgcttgctttcaccttcctccatggaatcacacagcaagaaggccctcaccagataccagagccaggctcttggacttcctagctcccaactatgagaaataaattacttttctatacaaattacccaggctgtggcattctgtgaagcagcaggaaaccgactaagacagtgaccttggaagcacaagaacaaggacatcccaggaccttgggccagctctcagatcatctcaggctccaggtgagttcattcacccttccagcccctgcctttccttgacacataggggttcaccagaagccccactgagacttccctaggctggaaaagatctactctgttacggactccagatcagtgtcttttcttatgccgagttacaaacagatctgcttagtgagaaacagaactgcacacatcttgctttgctttgaagcaggaggcttttgagatgtcaccattgtaacctcattttctttcactccaatttctgcttagcgatgcactttcttgtagccacagacatgctcatctgcagaaagtcaccagttttctttgatattgtgacaacattataactgtcactgatgaaaatgctttatttatatgtccttgtaatttattcttcattttatagacccaaagtcctccaggcactgccacaaatccacataatgtccttgaaatgcacacttcgcatttaaaacttagatttagctgactggtgggggaaaaaaccacgtgttgccagacctatcctcagtgcccatgaatatggacgacccagagagaatatgtatgtgcagctgctgccccagtagttgcaaaggtgctgattagcttagaggagacattttgcttttctcgtctcctttggcataactgatgtcacatacggttggagaaaagggacttcctcagtttgtctcactctattccggccctacagcaaaaggctcaatgctgtcatttccctccttctcctgaatatataagtgcccatgacacctaaattattctgtgcctcagccttttgtgtgctttactaagcactttactgccctaatgtgatgcagaagattgagaatccaggaggagctctgctaagccagtggcctgagtgagctccttgaaaatagaaagcaggtaaatgaagtagcttggtttcaacccagtgaaaaactgataacgagtggatgacgctaccaagaggatcaaggaggccaccataagcctgtgccataatattgaatcatctctggttaggtggaaatggcaatagatcctgtgcctttgatttctaggagaaagaggcaagtgacaagaaacacagctgataagagaatttagaaaccaaacacattttagagaatgtctagggctcagcatacacgtagcccttcccttatagcttttataatcacaattgtatcatcaaaatggccacgatgatagaggcaccaaagcaccacatgctctggaattatctaggaagcattagattgttttcagactattgtaattttttaaggcaaaaggtacacacacatgcacacacacacactattcttcacattctgtttgattgagagtacactactgacatcatgacccttaagccctatacaccaatgtttatatatcctaaaaacaaggatattatatgactatagtgccattatgaaattcaagatatttaatattgatacaatgtaattatccaacatactgtctatatccaaattttgccaattgtcccattattgttctttatagtaatttttgtttttccaatccaggatcacacattgcatttagttgttatatctccttagactcctttaatctgagacagttcctcagcctttgtctttcacaacatgaatgtcctttgaagaatgcaggcctatattttgcagaatgtcccagttatgggtttgtatgttcctcataatttgactctggttacacatttttggtagaaatactgcattagtaagggtgtgtcattctccctatcaatattcaaatgaaacatttttgagcatgagttctgatagccagggttccagaacagcacaacggtaatgcaacagagagtgaaaggacaagatgcagagaaggaacactgggccccagcagacagcatggccaccgccaggaccacgtgcttctgttactttttccaggcagacacccactaccattgcagtttctcggatctccacatgaccatttcctataaacccagccttctcttcctagagaagtctagaaatgtggttaatttccaaagtccctttctcacctctctgcttctgctggctccagtgcagatgggacttcttgatgtgaactcacacagcgagtagagctgtggcaaggccacgtggtattcatgacaattgcctcatgcccatcactattctaagtcaaggggcattcgcttgggactcactgtgcactgggacctgtgtcatctgctttgtctccagctctgtctcagacctgtgctcccagagctacatctgtatttgcaatcccttttccctctaggtattcatttgcattttctcaatcaggctcttattttcctcccttctgctgtatatctaactccctctcatcccactgtattttctttccttgcaagtgttgaaacattttctaatttggaactctgaatttcactcaagtgcttattctcaccttttcggatttctcatctgcgcttgacacacgcagcagccacctccccatgcatcagaagtctgggacactgacctccaacgcttcctcattaagcatgcctccatccaagatagagcaagtcgactgagccaaatcccagagcaacaattagtctctgaaaacaaaacaaacactccctagagagcacattcctgtaacttcattgtcaatctgattcctccaggcaaagggcattccagttacatgcactttattttctgtttgtctgtaaagtcagactgcttgggttcaaatcctagctctcaaccaccaagctgtgttctctgagcctcccttttcctcaaatgtagattgaagttaggaacttcgccttgcaagtttactgtgaggattaatgcgataatgtgtgtcagcactaaacaagaagagttagcgtttaactggatcatcacaacctcacatcattatcgaaagctattgggaagcccttgtgtctatgaacttggagttcctttcaaaaaagagctctgctaaccagtccccatcccacacctagggactgaagggctcacttctatcacagttttgagggaaaaggatggccaagctgagctcacttgaaaaggggaggcatgcccacattcccaagtaaatatttcaagagtgcatctaaaatgatgccacaatccaaatcacagaacacgaattccagctgttctttgcatatttatcagcttccaaagacttgatacgggtcctaatatttttgcttaagtcacacatatatagggacacaaacattcacagagagagagagagacagagagagaaaacatgtagcatttgacaatggaagaatctatgtagcctgtaggtgttcactgtaatagtctcagaacttgtaggtaggtttggatatttttccaaacaaaaagttttatttaaaaattaatcttgactcctacttgtatgtaaaaaacaaaaacaattttgatccatctaaatgtgaaacctagaaatagcaaataaatacaaaacaataaagcttctagaagaaacatgggataatatcacggtcttgaggtaggcaaagatttcttaaacaggacagaattgtactgaaaatacaggaaaaaaataagttgaggtatattaaaattaagaactttggggccgggcacggtggctcacgcctgtaatcccagcactttgggaggccgaggtgggcggatcaggaggtcaggagatcgagaccatcctggctgacaaggtgaaactccgtctctactaaaaatacaaaaaaattgccaggtgtggtggtgggcgcctgtagtcccagctactcgggaggctgaggcagaatggcgtgaacctgggaggtggagcttgcagtgagctgaggtcacgccactgcactcgagcctgggcgacagagtgagactccgtctcaaaagaaaaaaagaaagaaagaaagaaaaaagaaacagtactgcgtaatttataaagaaaagaggtctaattggctcactgctctgcaggctctacaggaagcacagtgctggcatctgcttggcttctggggaggacttgagacgcttacaatcatggcagaaggcagacggggagcaggcacgctgcatggtgaaagcaggagagagagaatgacagaggaggtgccactcttttcaatgaccagatctcaggctcaggagaactcattatcaccaagacagcaccaagctgtgacggagctgcccccacacgcctcccaccaggccctacctccaccactggggattaaaatacaacatgagatctgggcagggacacagatccaaactatatcagatcccaagtggcaaactgggcctaaattttaaatacagccgagcagccacttgctgactagaggtcacacatgtactctgagtttctgaaaacccccatctctgtttaattttggaactttctgatctcacctgaaccaaccaatcagggctcagctttatcaaccagtcagggtccagctgcaccaaccgatcagaactaagcaagtttgaatccttctgctgcgtaaatgaatttgattgggaagctgagtgggaaaatttctctctatggaggccaagttcctcatttgttccctggaatgcaccttccaaaggctacgtgccaaaggccgtgtctcctcagtttgcgaactgttcattggaataaagtctccttcgtcaaattccacctcagagaacttttattcacaggcttaatagggtaatggcagtcacatgaacatgcagacattatgtggttaactatgcatgagctgaagggggaagaagaaaagaggaaaggaaagcagcttggaagggtgagtaaagttcggggtaatttacccttgaaaaacggccaaacccttaagtcaaaagcaagagtttattcttttagccacccctccttttatcccttgccagcagcctggaaagttccagaatctcaggaataagttccatttttctttgcatcccccagctccctccctagtatccacacagtagcaagggctccctaaacagccttcgaatcttgttcttgagaactcactcacacgtgatagatgaaacaaaagaaaatacagatctgatgctaactgaatagctgacaaggtcatttaaaatcagacttctttcagagggagggctgcaggaatgttgttgtattggaaggtttcagtttcatctggcttatccaaaaaggaaagactttgctgccacacagggctaggcttgcaggccctagaacactgagcaccactcctgagacatgaatagcactgaaggccccagaacaggcagccaaaggactagggggcctcccgctgatgcaaggatttcaaagttaaacttgtaggtgtataagagtggggcatttaaaacagcctgcttcccaatgaggtggaattaaatggtgatgttatcctattggaggctgtctcctggaggtgataacctatgttcctgatcactggggggatggtgcccttattcctacccacttgtcatgcctcccaaatgtctgtatgacattgacctgaaaccacctttgcaaaattatgacagcaagagaaatatgacatagttgactccatcttacttctaacctccagtttctccttggtcattcctgggtgtagaccaagctgaatttgggatgaatttagtttatactttaaccttaaagcaaggatggtaatagcccttcttaaaacaaaagcacctttttaaaactaaagaaaggtcacccgttaggattatgagaggggcttgaatttgcctaagatgttggcatagttactccttactgttcaggagtcatgtggccagaggtcacaagatttgtgacttccccaattactcctgtagataacatctattatagaatctaagatttttttttgagatatctttcagactaaccccacccagactcctgactcaccccatcctgcggcctcacccagaggtggactcagaactaaggaccattttccaaaaccttatgacttcttccccaaccagtcaacatttgccattcccgtgtaccctgcccaccaaactatccttgaaaactcctaatctccaagactttggagtgattgatttgagtaataactctgtctcccacctggcgtggccagtctcacatcaattaaactttctttactgcaatgccgtagtctcagtggattgattttgtctgggcagtgggcaggaagaacttgtcaggcaattacagaccttccaacctgaagggtgaggggacagccttctggggctgatagaaatgtcttactcttctccttctgttatgggctgaattttctctcccccaccaccaaattcatatgttgaagtcctaacccacaggacctcagaatgtgactgtatttagagacagggcctttaaagaggtcattaagggaagctgaggtcatataggtgggccctaatccaatctgactggagtccttaaaagatgaggacatttggacaaacaagaagacaccagtgctcatgcacacaggaaaggccatgagaggacacagagagaagatggccatctgcatgccagggagcgagggtgcagaagcagcaaactctgccaacaccttgatcttaaaattccagcctccagaactgtgagacaatcaatttctcttgtttaagtcacctagtctatggtattcagggtttttttggtttgtttttgttttttggtgtatttttggtttgtttgttttaagacagagtcttgctctgtcgccaaggctggagtgcggtggcacaatcacggctcactgcaacctctgcctcccgggtttgagtgagtctcctgcctcagcctcccgagtagttgggattacaggcatgtgccaccatgcccagctaatatttgtatttttagtacagatggggttttgccatgttgcccagactggtctcgaactcccagtctcaaggcatacacccaccttggcctcccaaagtgctgggattataggcgtgagccaccacgcctggcccagtctgtggcatttgttatgacagcccaagcaaagcaacacacaccttcccagccttcatttctcattggcatgatgcctcctcttggcctgctgctgattccatcctaatgccagaccaacaaggctctgctcacccagctctgagccttaccccagtgctggctttgctctgctcttcctgatcctctgatctccttctagtcctgccccagggcaactccacatctggctattcctggctcttactcttctttttacctcaacccagaccagcagctcaccaagccaccaagactcatggttcctcctgtatgcagcccttgtctgacaggccacgtggtattgatcacttgtggggtcagagaaagtgggaggaagtttgaagcattttagaggatggcaagagacggaggcccttctcctttttctctcattatcccctccaagaacttcccacaggttgataaatattgctatggtccaaaacagaaggtgcaatttggctctattctcagattttcctcctatgggttagtaaaacagatggaaggctgtccaagtccaagagagagccagactcattcagagtgatcttttcaatgctcgaaaacctggcacagcgctgtctttactaattctcaccctgagaggagaccaaaggactcattgggatagaggccatgtgagagtggggatgttaaaccaacagctcccctaggttgaggcaggtttaggggtctgctttgtgcacacagaccctattaatatcttatgacccacttgggattatttgggtggaattgtttgaagaggagaaaaattctctttgcttcctattaagatgccaccagatgatcccctggcagagttctttggctcctttctcacaataatgaaaaaattatatatacaccttatttcctttttaaagacactagatattgggatgccaaggctcagattggactgcgtgctaaatctcaaaattttcagacagtttaatctgcataaagacaaacagtttggactcacctcaatgcacatctgatcccaggaggtgatgactttacagccggcagaaaacagcaccacccaaaagaagcagctgacgtcaaacgccatcacaggctaggattgcttggtgggtttacctaatgcttggagctgagaaatggaatcaaactgtgaaggccctggcaatttggcagccagagaggtactcagaagggtgatcttggaacaagaaatgctgttgactgctcagcattct

SEQ ID NO: 1579 - DNA, 7409 bp, Homo sapiens
  source 1..7409: mol_type = genomic DNA
aggcccctgcctgccccagcatcccctgcgcgaagctgggtgccccggagagtctgaccaccatgccacctcctcgcctcctcttcttcctcctcttcctcacccccatggaagtcaggcccgaggaacctctagtggtgaaggtggaaggtatgtccaaagggcagaaagggaagggattgaggctggaaacttgagttgtggctgggtgtccttggctgagtaacttaccctctctgagcctccattttcttatttgtaaaattcaggaaagggttggaaggactctgccggctcctccactcccagcttttggagtcctctgctctataacctggtgtgaggagtcggggggcttggaggtcccccccacccatgcccacacctctctccctctctctccacagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggtgagggccgggctggggcaggggcaggaggagagaagggaggccaccatggacagaagaggtccgcggccacaatggagctggagagaggggctggagggattgagggcgaaactcggagctaggtgggcagactcctggggcttcgtggcttcagtatgagctgcttcctgtccctctacctctcactgtcttctctctctctgcgggtctttgtctctatttatctctgtctttgagtctctatctctctccctctcctgggtgtctctgcatttggttctgggtctcttcccaggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccagggtatggtgatgactggggagatgccgggaagcgggggtccagagacagaggggaggggaaactgaagaggtgaaaccctgaggatcaggctttccttgtcttatctctccctgtcccagacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccaggtagagtttctctcaactgggaggcatctgtgtgggggtactgggaagaagtggaagccagtcaatcttagattcccccaacccgagggctactcccagcctcaccccaaaccccaacttccacacagaacactgactccaagtctttcttttttttgacagagtctcgctctgttgcctaggctggagtgcagtggtgccatcttgtcttggctcactgcaacctccgcctcccaggttcaagtgattcccctgcctcagcctcctgagtagctgggattacaggtgcccaccaccacgcctggctaattttttttttttttttgagacggagtcttgcactgtcacccaggctggagtgcagtggcacgatctcagctcactgcaacctccaccttccaggttcaagtgattctcctgcctcagcctcccgagtagctgggattaaagcctggctaattttttttgtatttttagtagagatggggtttcattatgttggccaggctggtctcaaactcctgacctcgtgatccacccgcctcggcctcccaaagtgctgggattacagacatgagccacagggccgggccaagcctaattttgtatttttagtagagatggggtttctccctgttggaccaggctggtcttgaactcctgacttcaggtgatctgcctgccttggcctcccaaagtactgggattacaggcataagccaccgcacctggcctagacttcaagtctttcttccctcgcttccaagacactacttttctgggtcttcacctaccattgcttgcgcctgcccaccagcttgggtggagtcttccttcctccccaactcctcactcttggagccctgggccctcttcttatccctgtctgcacactttcctatttgaacttgactctcaatggcttcttgggtcaccatgccttggtgactctattccaggctccatactcagccatctcctgtgccatttgatatcccatggacacctcaggctcaacagatacaaaatcaaactcaatgtcttccccaagtatagtcttcttggtggcccagtgtaagcagagggcaccaccacctgctccctcgcccaggctaagaacctgggcatccttctttttcctcaccccgtccaacaaactggtcacagtgttctgccaattctctctccatgcaatcctatcatgctatcctaactgcaattcacaaacccaaccccaactttcactccaaacttgatccaagcaatgtgctggatcccaactgtaaccttgcaaactcaactctgcccttcactttgaccgtgactatccttaattgcagcaggaaactgatcattatgctcccctcaatccacacattgcctctgagtacagccatggtttgtccacgatttgctcaaagacactgccccatgtcctgtgccagggtctgtgacaatccctgacctcctgggacatggctccttagagagaggagagcctttctcacagcttgggactttgagtctgtgtctttttttttttcttgagacggagttttgctgtggttgcccaggctggagtgcagtgatctcggctcactgaaacctccgcctcccgggttcaaacgattctcctgcctcagcctcccaagtagctgggattacaggcacccaccaccatgcccagctaatttttttgtatttttagtagagatggggtttcaccatgttggccaggctggtctcgaactcctgacctcaggtgatccacccgcctttgcctcccaaagtgctgggattacaggcgtcaaccaccgcgcccggccgagtctgtgtcttgcctctgtgcctcagacttgcggttccttgagatctcaggattgggacgtaagatgccagcctggggtcctcgtctcatagccccttccccctagtactatggcactggctgctgaggactggtggctggaaggtctcagctgtgactttggcttatctgatcttctgcctgtgttcccttgtgggcattcttcatcttcaaagaggtgagtcatgtccccagtgggtctgtccaaaccctactccatcttccccaggataagccggctctggccagtctgacaaccatctttctttcctcccatccctcccttcaagaccccagaatcctgttctccccagtcttcctctagcctccctcaaacttcccaagcctcttgcaattttttttttttttttgagacagggtctcattctgtcaccccagctggagtgcagtggcacaatctgagctcactgtaacctctgcctcccaggcttaagtgattcttgtgcttcagcctcccgagtacctgggactacaagtgtatgccaccacacccggccaattttttatatttttagtagagacgaggtttcaccatgttggccagactggtctcgaactcttgacctcaaatgatccgcccacctcggcctcccaaagtgctgggattacaggcacgagccaccgcgcccgtccgcctcgcaatttgaactcctgtctcctttgttgaaccaagtgacctccccagcacctggccccacaaatcctcaccctgccaagcagcccctcctctgatcacgccctttaactcccaccagccctggtcctgaggaggaaaagaaagcgaatgactgaccccaccaggaggtaatgcaaccagtgcaccccgcggtaacaccctccaccttcactttatgccttgcacttactgtttcctctgcccaggggttctttgctccgtctctactgtttcaaatactgcccaacctcaaagcccagctccaaagctacctcctctgtgaagaactccttggaaatgatcatctcagactcctctattggctgtcccagcacaagtgatcacgtttaacttctgaaggcctggacagaatcttgagtgggtccgccattccattccaagtcggccctcaccgtgcacttcctcttctcccgccagattcttcaaagtgacgcctcccccaggaagcgggccccagaaccagtacgggaacgtgctgtctctccccacacccacctcaggcctcggtaagaggcaccgcccctccagcctatagctccgccccagatccggggctccacccccactctcctcatccctccaatccgctgtgcgccaagccttctggagctcggaactccgcccccggggcggggagtcccgcccagctatgagccccgcctctagaaccagaccccgcctccagggctcagagccacgcccccaggacccagagcctgaagtcgtaatcaagagcagaacttcgccccagaactgaaggcctcggccctagatttagattccgccccagggttcaaggccgggttcctagacccagagtccattcgcagagcccaaaacatcctcttcccgtgccccgccgcgcggacccttagccttgaccgcccccatctcttctgaccccgtcttacaatgcccctctcaccaggacgcgcccagcgttgggccgcaggcctggggggcactgccccgtcttatggaaacccgagcagcgacgtccaggcggatggagccttggggtcccggagcccgccgggagtgggtgaatgactgggagagggaagggtcgttccccacatggagggggttggagcggtctgtggcccgaatagtggactgggccctggaggagagggggcatgactcggttccccatccccatccccaaacccccaggcccagaagaagaggaaggggagggctatgaggaacctgacagtgaggaggactccgagttctatgagaacgactccaaccttgggcaggaccagctctcccagggtaaggctgccctcccccgtggccccccacctctgcggtggcctgtggactcccatggacacccctccttctccaccagatggcagcggctacgagaaccctgaggatgagcccctgggtcctgaggatgaagactccttctccaacggtaacttggggcctttgtgggacctcagagacttaggtgtaattgcagcgctgtgacactcctagaaggggtccctggagttctctctcttctgccacagctgagtcttatgagaacgaggatgaagagctgacccagccggtcgccaggacaatgggtgtgtgtgaggatggcaacagtccaggggggaggcggaggacacctggaggccaggaggaatagtaacctccctcttccctttccagacttcctgagccctcatgggtcagcctgggaccccagccgggaagcaacctccctgggtgagagatgctttcaatcagactgccttgcccagcttgggtgacctggcctcagctctgacaccagatccaactttgacctgaccctgaccccaaacccgaacccaatcctgtgactcctctcacctcaacactgagccccatcccccatcctgagccccatcccccatcctgacccccaatatttaccccctccctaactgtgaatatcaacaccgatcccaatgcagtatcagcctggacttgatctccacctcacctcagccccagtgcagacctcaacttggaccccagcttactctgcagcttcttcatgactctgactccgactccctccagtttcttctttttctttttcttttttttgagacggagtctccctctgttgcccaggctggagtgcagttgccacctctgcctcctaggttcaagcgattctcatgcctcagcctcctgagtagctgggattatagacgtttgccaccacacctggctaatttttgtattttcagtagagacagggtttcgccatgttggccagactggtctccaactcctggcctctagtgatctgcccgccttggcttcccaaagtgctgggattacaggcatgagccaccacgcccagcccagttctgttcttgaccccttccttagccataatctaacccatatctaaccctgaccctacagctaactggggccccaaactcaatgctaaccaaatcaccccttcccagcacagcatgggtaatgctcctcaccttcctctgcccctcagtcttcctccttaccgtaggctgtacttcccatgccctagcctccaattctccatcccccgcccaagcagggtcccagtcctatgaggatatgagaggaatcctgtatgcagccccccagctccgctccattcggggccagcctggacccaatcatgaggaaggtgggtgcttctgccgctgtcccctgctgtcccctgggctgactttgccttccagcctacttccagtgccacccatgttctcctcctccctggtcctatccagatgcagactcttatgagaacatggataatcccgatgggccagacccagcctggggaggagggggccgcatgggcacctggagcaccaggtgatcctcaggtggccaggtgagctgggactgcccctagggaaagcggggagggagggagataggcacggatggcagtggctgctggctttcagggagggagagggaacagggttcctagggcctggtgggcagggggaggactgctggacccctccccatcaccgtttcttctgcatagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtatacatgccagtgacacttccagtcccctttgtattccttaaataaactcaatgagctcttccaatccta

SEQ ID NO: 1580 - DNA, 7409 bp, Homo sapiens; identical to SEQ ID NO: 1579
  source 1..7409: mol_type = genomic DNA

SEQ ID NO: 1581 - DNA, 7585 bp, Homo sapiens
  source 1..7585: mol_type = genomic DNA
tttgtagagagaaaaatttattgcaaggcagccaagcaaggacacaggagtctggcccaaatctgtctctccaagttggaggctggggcagattttatatacagagggtagtgaggcatgatatgattggatcttgtaatgaggggattcaggaggcttgatctgactggatcacgccagggctcaatctgattggatcaaggatcatgccacgtggtgtccacttcttaactcagtccctgttcctcggtctgagcacttaggttccacgtggatttgcacgcttcgttcatctggacatgcccagggtatgtaacttgcaacctgggggtccacgacaactgaaaaacaactcgccattttattacacaaagttgaaccagattgggctgaatctgcggttacaatgtttaccagtttattataaaggatacaactagaggggcggggcggtgccggcaagatggctgcgcccgaaaaggtgacatttccagagaaaccaagccacaaaaagtacagggccgccctgaagaaggagaaacgaaagaaacgccagcaggaacttgctccactgagggactcaggactctcacagaaagaggaggacacttttattgaaaaacaacaactagaaaagctatggggaagagagaggcaaagattacatgaggagtggttgctgagagagcagaaggcacaagaagaattcagaataaagaaggaaaaggaagaggtggctagaaaacggcaagaacaagagcgaaagttaaaggaacaatgggaagaacagcagaggaaagagagagaggaggaggaacagaaacgacagaagaaacaaaaaccggaagctgtccagaagatgctggatcaggctgaaaatgagttggaaaatggcgccacatggcaaaacccggaacccccccttggatttcagagtcatggagaaggatggagttaattgtcccttctacagtaaaacaggagcttgcagatttggagatagatgttcacatgatttcccaacatccagtcctacccttcttattaaaagcatgtttacagtgtttggaaaggagcagtgcaggagggatgactatgactccgaagcaagcctggagtacagcgaggaagaaacctaccaacagttcctagatttctgtgaggatgtgctgcccgagttcaagaacgtggggagagactgggcgcggtggctcaggcctgtaatcccagcactttgggaggacgcggcgggcgaatcacgaggtcaagagatcgagaccatcctggtcaacatgttgaaaccccgtctctaccaaaaatacaagaattagctgggcgcagtggtgcacgcccagctaatttttgtacttttagtggagtcccagctactcgggaggctgaggcaggagaatcgcttgaacccgggaggcggaagttgcagtgagcctagatcgcgccactgcactccagcctggcgacagagcaagaccccatctttaaaaaaaaatagtaattaaaaaataacgtggggagagtgattcagttcaaggtcagttgcaacttggaacctcacctgaggggcaagtatatatgttcagtaccagtcggaagaagaatgccaagcagctctttctctgtttaacggacgatggtatgtacgcaggacgacagcttcagtgtgaattctgcccagtggctcggtggaaaatgatgatttgtggtttatttgaaatacaacaatgtccaagaggaaaacactgcaactttcttcaggtgttgagaaatccaatagagacctctgcttgtctcctcctttggcaagagctccaaggggagagagagggtgggccaccacgatgaatactacaggctgcggggaaggagaaccctagtccagaccattcctacaaaagaaatggggaatccgaaaggaaaaggaagaaatctcactagcacatgtcaaagagccaggagaggcacaattcacctagcagaggaagaaatagtgaccgcagcgggggccggtgcagccgcagtgagaacggccggagccgtcacagccggagccaaagctcctctagatcccaaagtcgtggtaggaggagatcaggtagtagagacagaactgttcagagtcccaaatcccaataaacctgttttattcttacaaaaaataataggccaggcgcggtggctcacacctgtaatcccagcaattttgggaggccgaggcgggcagatcatctgaggtcgggagttcaagaccagcctgaccaacacggagaaaccccatctgtactaaaaatacaaaaaattagccgggtctggtggcgcctgcctgtaattccagctactcgtgaggctgaggcaggagaatcacttgaacccgggaggcagaggttgcagtgagccaagatcgcgccatggcactccagcctgagcgacaagagtgaaactccatctcgaaaaatagtaataataataataaaataaagaatacaacttagaaacagccaaatggaagccatgtataagacaaaggaagatgtgggggtggaaggggttgcgtggagcctccatgccctctctgggtgccattggttgactgggggaattaattccctggtgcttccagcctgcaaaatgagctcttgcaaccagtaagtccccgatcaaaggggtgcaggaggtggtaggtggaagttgaacagatggtaggtttgcatgtataagataacgccccaggggacatagcagctacacatggcaacccaaatatcctaatctccaaaaggaagagagagtggattcttggaacacaagtccacccccaaaggcatcccacaccagctcactcataaagctccaaggatgggccagaaaaacaagctctacaccaggggaaattggaggcatgacaagaaggacagaatgggacccagccttctaaaggaggaagaatctgacaaagaacagtcccagagattttgtgaaggtcgaaggatggagagaaggaactgtagcttaaaagggggtgaagttctgctacgcaggaggggggtttggggtggcaggggctggagaaagaaactgttcttcatccctggagcaggaggctgcggactttttgcagatccagaatttggcaagattacatttgtcgtcgttccagccattgccactaaattccgcgcagtcttcctccccaacgttgttgggctctcctctgttccaatactgcttgaagctgcaaagcccatgcggaatgtgagcctctgtccccgccagctacatgagctgtgtttctaccttctgtcatcttgatgccttaacatctgccctgcgtgtgtatgctggacttgaatccctctgcatacctgataatatgcctgactcacgatgccttgagttcctgcctctcttctcacaacctgtccttgggtggactccacctattgagtgtgtgattttcaaatacaagccaaccagtctggagtccacacctccagcgacctgccttactgggctcttgtactccaagccactatcctgtactaatcaccccaaggccaggtgtcagacagcgaggggcagcccctgtgccccagagcccaaaaaatgcttcacacttcccaatcctaagcctgttcacctggccttgacctttcctttccacagaaaccataataaaggctctggcccacagtcccccctccccaccactctgactcataacagaccctggtgcttccccaggtggcccccagctgtgatgtgtcctctctctagggatctgtgtatatgagaagctattcacaatggcaggtgtctcctgagctggtggccttactggacctcagacttcctattaatacattatattttaatacacctccccggtggcaggctcctcctgcagctctgctggtggaattctaggcacctgccatgctgtctggaagtgggtatgaagaccaccttcctcaactcagtaaaacctccagattcttgggtctagggtgtcagggagttggggaggatccccagggaaagttcaaatcagagtttcacaattccagccccagtggatagggtgccccttctgagatctacctgggcaacagaggtgagccgtccacccattgccacgtgccttcctgatttagatctgaaagtcccatccaggtgaagcggttacttctggaagactgcagctgtaggaagttctggagggtacaggaggagtcaggagggagctctgcttcccattttccaggctctgtctccccatctcttggtaggaagttctgcttgtaggctaacctacagccttctggtatactaggtcctgagccccctcgtgtctgagtccctctcacatgtgtatcccacggcacatgtgtcctgacatgcacacatccatgcacagctggcctctcctcacaccctcttgctaatactgcatgtttatccatttcacatgttctgtgcatgtccatgcacatttactcataactgggcttaatgtgttggagccagaggcaaccatttcctaactgctggtcatgcacatctcctttcagctctgcactgagtgacatcacaacgacagcttgaaatcagccaccatgggaatatttacaccagggaaactggcaaacacgacccatcaggacttcttcctccagagagctggttgttaacctcttgcagcatgctgcaggggtttgcttacatttgatgtttttttccggagcattcacacatgttcagatttggtttgtatctgctctaagggtacttgagactccctcattcatatccttctcctcccttctttccaagtggagcaaaacccctcttctgcaaagtcatctctgagcacctcctccccagttggccagaagccatgccctaggccaggacggggacccccaccaggtgtacctgctcctcagcacttttgattacgacgagctgggcccccacttctttgcaggcggtgatggagtcgtgccagttccgctgggagttagacatgaagtaacagtttccttggaagaatgtccattcccagggacaggggtggcacaggcgttctgttgggggaggctggtcagggctgggcttagattaggttgtccatattcctgtacctgcccagccttcaaggtcttgagagtcagagtccttccttgactgtccacgccgggtagaccattcccctccccacttcccgagaccctcccccatccccatgagaacccaggagtcctggccccatctcctccagactaggagaagttggggctttagaactcagaacagaaggcaggagactggcttaactgagtgcctgttgtgtacctggcccactgtgaacactgagggcaatgatcacagttaccctgtgttctcatttcacagatgaggaaacttgctcaggcagggtcagtgactcaagcaaactcacaccacacaacgaccatctcaggcccaagaagccctggttccagatactcacccactgcagccttcagctgggtcagctcctggtagatctcctgctgcttagatttctctggaagctcacccactgcagccttcagccgggtcagctcctggtagatctcctgctgcttagatttctctggaagctcacccactgcagccttcagccgggtcagctcctggtagatctcctgctgcttagatttctctggaagctcacccactgcagccttcagccgagtcagctcctggtagatctcctgcatcttagatttctctggaagctcacccactgcagccttcagccaggtcagctcctggtagatctcctgcagcttagatttctctggaagctcacccactgcagccttcagccgggtcagctcctggtagatctcctgcagcttagatttctctggaagctcacccactgcagccttcagctgggtcagctcctggtagatctcctgcagcttggatttctctgagagctcacccactgcagctttaagctgggtcaggttctggtagatcgcgtcttgcctggattgttcctgacttatggagctggggaccttggacactgggccaagaaaaaaaaggaactgcaattattaaacacctactgtgtgccaagccttgaactgagccccatagggacatcatttgtgagagccaaggtcttggttaatcccctttgaagatgaagaaaactgacacctggagaaggcagcacagaaggccaaggagagccagattcttcctgtcctcctcctcctccctctcctgtcctgccctagagtggggaggggctgtgggagaggcccctacagacccccagggacaacatcttggctctcagtcccacctccctcccagatctggcagccccaggctgtgtccacagccaaaagccaggcgtggggaccccagaccctcagaacctgcccctgaccttggacaaggagcccagccaagagcgtgaaggagaggagttgcagcaccaggggaccatggccaagacaccctgagagaggatacatgcgtcagcctgccagtgtccccaccggagcctggcccagggagagcctggtctaaatccctcagcaccccaggacccaggaaccccagccccagccccctccactccaacacctgggaatccaggccctagctctaacctccccaggacccagggaccccgtccccagcctccccttccccaggtcccaggaaccaggtacctgcttccacctccccaggacccaggaatccaggccccagcctctacattcccaggtccctggaacccaggcccccagctcccacctccccaggacccagggacccaggacccagcctccccttccccaggtcccagtaacccaggtacctgctcccacctccccaagacccaagaatctgggtcccagcccctacatccccaggtcccaggaacccaggcccaagtccccacctccccatgacccaggagtccaggcccaggcccccacctctccaggacccaggagtctaggcccctgaccccacctccccaggacccaggaacccaggcttcaacttctacctccccagaacccaggagtcttggccccagcctccaccttcccaggaaccaggaattcaggccccaaactcaacctcctcaggtcccaggagtccaggcccctagccccacatccccaggacccaagagtccaggccccagcgtccagctcctcaggacccaggagtccaggagtctctcgtctctcctcccaaactgctaagtcctctctacctgctaagctcttgtatcctcgagtctgtcggaatccaaggcctctcagctgttcctcctctgaatggatagacgtgaaatcagagcctgggcaggctgaggccatggctggccatcccttcccccttcccagaatcccagcgtcccaacccagcctcacccaggaggcccagctgctgcagtcttggttccttggagtcactcatgtcaccccactctcccccagtgtccagaactcctgggggccacagcttttatttcccaccctgtgat

SEQ ID NO: 1582 - DNA, 7585 bp, Homo sapiens; identical to SEQ ID NO: 1581
  source 1..7585: mol_type = genomic DNA

SEQ ID NO: 1583 - DNA, 7585 bp, Homo sapiens; identical to SEQ ID NO: 1581
  source 1..7585: mol_type = genomic DNA

SEQ ID NO: 1584 - DNA, 7585 bp, Homo sapiens; identical to SEQ ID NO: 1581
  source 1..7585: mol_type = genomic DNA

SEQ ID NO: 1585 - DNA, 7585 bp, Homo sapiens; identical to SEQ ID NO: 1581
  source 1..7585: mol_type = genomic DNA

SEQ ID NO: 1586 - DNA, 7585 bp, Homo sapiens; identical to SEQ ID NO: 1581
  source 1..7585: mol_type = genomic DNA

SEQ ID NO: 1587 - DNA, 7585 bp, Homo sapiens; identical to SEQ ID NO: 1581
  source 1..7585: mol_type = genomic DNA

SEQ ID NO: 1588 - DNA, 7585 bp, Homo sapiens; identical to SEQ ID NO: 1581
  source 1..7585: mol_type = genomic DNA

SEQ ID NO: 1589 - DNA, 87971 bp, Homo sapiens
  source 1..87971: mol_type = genomic DNA
tgcattttcactgaagcatttattatgcaaaataggaaggctttagcatgccagtataaattaaaacagtagaaaaaaagcagagtagagagcgttttccatccatggcctgtgccctgtaatgacgcagcagtatcctagtacattgacgggtttttcctgtcctgccactgtccgctgggcagttataggtcccatgtgttgggtcttcctgcgaggccttcacaaagatgattttgtcattcgctgaaagcgtgaagtgaatcaacggcctcctcttgctccgcagcactttattcacactgtgtaaccacatgttttttatgccactttgtgcacagctcatcaaggtcagtctgttcatcttctggcccctgtagcacatggtacagttcaatggtgcggcacagaggcctgaggcagggaggctcccgctgccctcgcaggccctggctgaccctcccctgcccgcccaccttcccatgcccctgcagctccctggttgcacctggcctaggctcctttccatctgcccctctgcccggccctctcaccagggaggcacaacatggcccagtacagttaccttgaaaggaggtgaaggtgacaacagaagccaaatttacagcaggagtgaagccactcagacacagagtgatacagacattagggcatgtgctagcatctgcgctttctctggggactttacaaaacagactcaacaactcagctgtgagaggcagtgcgcccgcctcccagggagaacgaggaaccgccaggagacaggtctacctgcaccaccggcaaaccagagggcccaaggccagggccgtaagccctgggagtacactcccttaaagagtgcagggacaacagtctgtgtgtgaaggtttggagctaaatataaccaaagcatcctgtacataaaggggaatacttcagtggctgagaagagtgaaccgggttgtaaatgcttcatcctgtgtctcataatctgggcgtctgcaggtctggcctttgagtggtgaaatcccctggctgttagcgagggggcagggcctgcatgtgaagggcgtcgtaggtgtccttggtggctgtactgagaccctggcgtgaaagcaaatcagaaaacaaagagtgggtcagtagcctgtgtgggcaggagccaacccagaggccaacaggtgtctctgcagcacagccctgtgaccacccacccagcctccagaggcccaggaataatccccctggccccacgggcaggagccttggctgcaacagcttcgttggtagatgggtgctgtgccctgccgggaatggccttgcagcaactcctttccagctaaattctcacccctcttctcagctcctcaaatgctgtgccttacagtgcttgggccccgccaacttcctgctggacctaagagaaaggagtctcccacctcccatattgggcaggaatcaggggggagggcccagacctgctccagagaatctgctgtccctgacacctgggcccaaaggaagcctggacttgtcacagggagaagaggggctccttggcctcagccctctgtgagcctccttcccttcccaggcccggtgattctagtgttttcttggtcacgaacaggcccacaaggctggccccaaacctgctggaatgcctgtccccctggtccaggggccaggaaggagaaggatcaacagcagccacacacaggtaagtttctggggcccttttgatatcactcaactcaggcaagctgggcatcctgacactagagtcagaagaacgagctatgaacagcccatgggagccagaaggagggaaatgacaacccgctggggatcatgttttagagaagtagtttgaccgtgcttagtttgcataattgcctgcactgatttgcaaaaaccaggcacctaactacataacattttctttctgaagctgccatttttcttagctttttttccttcagtcttcccagccaacctctcatcttactaggcctaaggaaatgatgcagagtgagggttctacaagaacccaaagaggcaggataatcacttgtgtggtcctttgcctccatctgcatcggcggggaggctgcgtaccctctggacagctgctgctctgtctgccatggccaagcaaggcatggttggagccaagtaattcgcttgaatggccaagtcccagctgtgctccagggacttattggcagtggcgttgccactggcctaaatgggtgccttgggcttgccctgcccagctgttggcaagagctggtgccaccagcaggcaaaatgtgggggccttgatcttgccccttgtcaggtggtgccccttccactgaagggacgccggcagctcctacctggtaaaggccatcgtgccccttgcccctccggcgctggttgtttgggagtgaaatgagaaaaggattagaaagtcaggcagtcagtagtggcatttctgctcaagggcccctcccaaggtacccaggaagtcagaggtaactgtctcccagcagcacccctgcccctgggagagaaggatcctcaggcccctggtcagaccttcatctctgcagagtaaggtgaggcctggccatgatggggcttgggtttgctccaccccactcagatcctcacagacatcagattcctaaggtctagggcccgcaggacctatattgcctactgcttagataaatgggcttcccttcagctcttaaagttcttggctagtcatttttgctcactgacaaccagctgttttgagcagttacgagctctggcatagtcagttcaatcacgtgcccgtttaccagctagaagaccttgggtaagtcactcaacctccttgtgccttgcagggcacatgtttctcattgggttgttgtgggaattaaataaaactacagagaacccctgcttggaaggggtcaatgcttcactctcaccattttgaaattcttaattgttgatgaacaattaattgttgatgaacaattcttaattgttgatgaattgttttcatgttgtcctgggacctgtggtcctgagcactgaacacggcagcacatattaagcactcgatgcttcctgttattaaaacggacctgcttttgcaaagcttaggctgtcatagaatctagatgtggttttctgtactgaaagagcatcagcccttccttagtttcttatgttctgcccggctgggtgacagccaggttcgccttcacctctgatggccaccacatgggcatttgcagctgggatgagaagtggatgggaaaggaggcctgcagcaggcgtgtctggaggaccaagaggaactccctcggaaattaagaaacagcaacactcacctcgcctttcatcccaatctcactgtaggcctccgccatcttatctttctgcagttcctgcagaagagggcgtggaacactgatttttaccaactaatgcagaaagcagcaggttcccctacaacaggaagcttcttgatccccaagttggcagcagtggcagacagggagggctcccacaatcaaggctccaaaccttatgcacacaaacttctctgcccacaaccagctccagcccacccccctcatcctcagccctttggagtctcctccgagctgccagctctttgcactgagctgaggggctcaagttaggctcaaaaagataggaggtggagttctagacaaagacacggagactgggcaaaacaagggctcacctggagccccagaatcatttatctgagcaagttgtctctttacacagccaaacgggctgtagatcaaccctccctccccacaggaggggcggggaggcatctccttcacagaaggctgccacctgcaagggtctcctgcatggcaacccagatcgacaatcagggttcagggtcacacccaggagggtgaggttgaccttcctataggggggtacactcagaagacttcagcacccaggacaggagcccctcgaaggggccagccacctcgtccttgcctagcttgaccttgctgtgtccccctacaccccaggctgatcaacctgggaactccagcagcagggtttggggagggaagggagattactcggcacttttcagctaaggagactttctagaagcaggtgctgctgcaggccgcaagcaggtgagacattactcgatccaagaagggaaggtctggacagacaaagaccacagagtgaggagcaaccgccttcctctggagccctcctccagcccttcctccagcccttcctccggagccctcctccagcccttcctccggagccctcctccagcccttcctccagcccttcctccggagccctcctccagcccttcctccagcccttcctccggagccctcctccagcccttcctccagcccttcctccggagccctcctccagccctacctccagcccttcctccggagccctcctccagcccttcctccagcccttcctccggagccctcctccagcccttcctccagcccttcctccggagccctcctccagcccttcctccagcccttcctccggagccctcctccagcccttcctccagcccttcctccggagccctcctccagcccttcctccagcccttcctctggagccctcctccagcccttcctccagcccttcctctggagccctcctccagcccttcctccaactttccaaggtcaaatgtgaggtctcctctactcacattgtacaggccttcctgagggttcttccttctctgctaggaaagacaacgggaagacgttagagggagagaaacacaaacccaagccatgaaagtacagcaaaccccatcctgccccctgactgcagtttcctggggctctgccgtctgcctctctcctccctgtgctaccccagccttgcctaggccactgttggggccctcatggcactacatggctcatacttggttacctgcaactggatacacacttcgctcttccagaggggcccacccaagcccagcattgcccagggcaggccatcgggacgcccacacacatcacaagctgacaagtgggacttttggctgaagacaaaaggagtcacataccatcatttggagcagggccagccactggtagtgagtgcctactgaaaggtgccctccccacaccctcctagtcctgacaagaggagaggaggcaagataaacttggatggtgggggtgaggagtggtcaatgaaatcgacagcctctctactgcccattcactctagcaacaacacaaccagcacagggatcagcctggacaggggctggatggacaggcgtgaccactggcagcatctggcagcactgcccttacaccaggacagccctggcctttgtcctgagccctgtgcttaaaaggaccctaacaagtcaaatttaacaacacattaaaaggatcattcagtgtgatcaagtgggattaatccctgggatgcaaggatggttcaacaaacgaaatcaataaacatgatacaccacattaacagaatgaagaacaaaaatcatgatcatctcactagatgcaggaaaagcatttgacaaaatttaacatcctttcatgctaaaaactctcaacaaattaggtatagaaggaatgtgcctccacacaataaaggccacatatgaccaatccacagctaacaccacactcagcagggaaaagctgaagcctttcctccctttcttctaagatctgaaacaagacaaagatgcccacactcactacttctattcaatatagtaacataggtcccagccgagcaattagcaaaaggtgccaagaatatacaatgggaaatgaatggtctcttcaataaacggtgttggaaaacctggatatccacaagcaaaataatgaaattggaccttatctcacaccgtatacaaaaatcaactgaaaatggattaaagacttaaacataaggcctgaaactgtaaaacttccataataaatcatagatgaatagatatttctcaaaagaagacatataaatggctaagagacatatgaaaaaatgcttaacatcactaaccattagggagataaaaagtaaaaccacaatgagatcacctcacacttgttagggtgcgcattaccaaaaagacaaaagacaacaatagttggcaaggatggagagaaaaggaaacccttgaacactcttggtgggaatgtaaattaatacaaccattatggaaaacagtattgaggctccacaaaaaactaaaaatagaactaccatatgacccaacaatcccgcttctgggtatttacccaaaagatttgaagtctgcttgttgaagaaatgtctatactcccatgttgattgtagcactattaacaataaccacggctgggcgcgggggcttacacctgtgattccagattgtagtcctattaacaataaccaaggctgggtgtggtggctcacgcctggaatcgcagcactttggttggctgaggcgggcagatcacttgaggtcgaaagttcgagaccagcctgatcaacatggagaaaccccgtctctactaaaaaaactacaaaattagccaagcgtggtggcgcatgcctgtaatcccagctactcgggaggctgaggcaggagaattgcttgaaccctagaggcagaggttgtggtgagccgagactgtgccgttgcaccccagcctgggcaacaaaagctaaacgctgtctcaaaaaaaaaaagaaaacaaaacaaaagaaaccaataaccaagttatggaatcaacctaagtgtccatcaaagaatgaacagataaagagactgtggaacatacacacaatagaatactattcagcttttaaaaaggaagaaattctgttattcactctaacatggatggaactagagaccattatgccaagtgaaatcagccaggcacagaaagacaaacactccatgttctcacctatatgtggaatctaaaacagtttaactcactgaagcatggacaggtagcatgatgtttaccagaggctggggaatggggggaatggggagatgatagtcacagggtacaaagcctcaattagataggaagagtaatttatttttagatcaacagcacaacatgctgaatatagttaatatgtgagtactatacattttaatatctctaagagtaagttgctaatgttctcatcacaaaaaagttaaagatttgaagtgataaatatgttaattagcttaatttaatcatttcatattatattcaaaaatcataacaatactttgtaccccataaatatgtagaactataatttgtcaatataaaataaataaagacagaggaaggaaggaaggaaggaaggaaggaaggaaatcagaatgaaggggaaaaaacaaagaggaccctaccctactgtggtgtcatccagctgctcccctacccacaggtatacccacaggtatagtgtctacaaagccaagaggtcaaaccccccagggaccataccccgaccatatgtgggttatccaggggtcttgggcccttcctgtatggacctcttcaccaggtctgtcctcttggggcagatggcgtcaccgtatgtgcatctcaggatggccaaggagcagtttgaggggaagtgggtagagcttagacatgagcagtggggtgccacgtccgggggtgaggccccttgagatgcagaatggagccaaggaggaaggaagagggtgcggcagcaagtgggtctccatctcttctcttgtcctgggcccacacatgtgagggtcgagtctggttgcagagtgagctgaggagccctcccccacagcctgggctgagccccaccacacatgcaggaacacacaggaaggtagaggaacccctaccggctttccccccatctcagggtcccggccacgtctcttgtccaaaacatcgtactcctctcttcgtcctagattgagctcctataacagataagaaagtgtcagacacaggacggaggaacctcagaaggatggagccagctggactggggagtgtggtttccctctctggggtggctcataaaaagaggggcaggggctggggaggggatggtaactggtccatctggagaccatcatcccagaggacatctcagagaacacgccttaacatgacagtggatgggatccccaaaggtcaccaagtactataggctgatcagtccaacgggataaggatcaacattctcatgagcaaatagagaagtgggggctcagaggtggtagtcaatttcaccacagtcccattgcacagggagtgtgaaatcgctttcccctcctctgggaagattctaatacattccttctccacccccctctagcctttgcaaattgctgatggcttgggggctcactagtggcaggcactagactaagctcgttccatgcatcaagacattaaagcatgtaatctttatggcgccctttgagacaggtacaattactacacctgttttgtgggttagaaaactgaggttaaacaagttgcagccgggtcgcagaggtgatagctagggaccaaacctaaacccaagactctggcgggcgcgttccctaggtccgaggaggaggctgcccttcctttccggagggtctacggcgaggctgacttacgttatagagctggttctggccctgctggtacgcgggggcgtctgcgctcctgctgaactgcaacacagaaagcaaagcgcgttactgctccgcgagggcgcgcaggggagccggggtgccagggcgcgcggcgacccgagggacagccctactccgctccttggcaactaacaatgctgccctgcctcctggggctgagcccttgcaggggccggggcgtggcagcccctttttctgagcccagttgtcctttttcctcccgcctgtgacacgtgcattcatcacgctggcccaggacccgctggagtttattcttcccgggctagcgccctcgcgcgtgcgcagaggtataaggttcttggtctgcgcccccggggacatgagtattctctaggatcccttcctccggggactctgaggacaatccagggtggatggcggctggtcaagatcccgcctcctatcttgacccccggagcagtgtactgtacgtgcatcactcgcccagccctcagccatcgcccggctgccccggtgcccaggaagcctcgcgttcgcttagtgtcctgagcatctgtgggaagctgacacagcctcactcctgcttcacttcatgccgcttcaggcgggagaaactgcaatgtcttacagatctagagcattggaaacaaccttagaaatcatctagggcagcattttcaaacttaaaacaagaaactcagtaagatttggtttttcaaataaaatattatgccaaagtccaaaattcaaacaagaaatgggttgagaagcactgaagtgatgactgggactggattctcccctttactcctaaattcttccaatctctgcccacaccatgaccagccccacgaagaaatccagggtctgcaaggcaccaagtgaaaaacccacgctctggtcagctccccagttacagatgaggaaagggccttttcaagagaaaggctaacatggccttcattcacacttggaaagaaggacctctgcctgagtgtaagcccctttgtcaccagtagcatcgccttccctgggacactctgatgtgcacacatttgtacggcttgtcatggaggtgcctagcaccaggctctccctcctaccctgtccatctcagccagacactgccacctcctcctcagcccactcaaggcacacacttggctggtccttgctttgctcctggataccaagccccaggcaccacccgagcttgagaccttccaagaccaaggcccctctgaacatccatcaagtgggggaccccgtgccctcctcccaaagcccagtggtacccaccttcactctcaggaacaaggcagtgagaatgacaccatagatgaagaggattccatccagcaggtagcagagtttgggatccagcaggccaaagctctgtgcctctgtgccaagagataaagctggtcagccaggcccaaggtgacgagaacacatccccattaccccagggtggcactaggactgactgaccaaataaatcatgacacggagactatatccaatccccatgcctcagcctgatcacaaccctctccctccctcccacctcaaccagctcctggaaaacctattggcaccaacggcagatgtggccgctgtggggccaaagaacctggggcaatgggaggggaggtggaaacaaggcgagcagatgaggctgttctctgtgcacagagctcctgccactgcagcagaagcccagccatgttagccccggtgtgaaccaagaactctggaagcctcgggaagatgttcacgtctggatgaatggtactcctggcctgaggtgtgtggctctgaggcctacccacagggagacaataggtcaaatgatggtcaaatgagatcatttcaatatctgacagttaactaggacagggagaatctgggttaactctcccccaactccctgcctcctcagtgccaagcactctcccgcctaggacagtgggatctggtgctcggcttcccttccctgttccctgaagggtttcatggccaacagacagaggtacctttggtgcccctccccacctaggcccagcatctccctgtcccctagtcccagctccatggcctcagccttctctgtctcccctcctcccactacacacaccccattcccaggacacgccttgctcttccagactatttgccctgtgccttgcactctctgttccctcttcatgttccctccatttctctccctgaaaccctactatttggtaacatttgatgcatcctacaaaatgcagctcaaagatcccttctgtgttagcttctcccactgcaaatttcccaggggcccctaactcctagtgccatattaacctttgtcaagctgtagttaatgcacgtttagttggcactgccattggagtacaatgggctgaagaatgcagatacactaaatactctggttaaataaaagtttgcatttttgggctgggggcggtggctcacgcctgtaatcccagcactttgggaggctgacatgggtgtatcacttgaggtcaggagttcaagtccagcctggccaacgtggtgaaaccccatctctactaaaaatacgaaaattagctgggcgtggtggctggcagctttgatcacagccactctggaggctgaggcaggagaatcgctggaacctgggaggcagaggttgcagtgagccgagatcacgccactgcacttcagcctggcacacagagtgaggctccgtctcaaaaaaaaatttaaaaagttagtgtttttatttggaacatcattgcactgtgaatgaggagactcagattttagtctgaccatacttcctactaggtaaacgtgcagcaactcaacctgtaaaacagggtgtggtacccatctcactccacccctgcctggtaactagagcagaggtcccaggccagccccgctagtgtctgtctcccaaggcctgggcgccctctggtggcctttggacccagatgagggcagagggagtggaggccatatgtgggagtgctgtcattctttctggctgtgtgatttggggcaggttatgtatgctctgtcagctgcctcttctgttgaacagggtgaaaactaacatttcttcagacactgccttaaatgtaatcatcgtcagatcctcctgccacccacactcggacactgaggcaccgagtattcgggttcagagcacacggtcacaggcagcccaggactgatccctagcagttctcgcccccttcctgcccctgggccagccctgcctacccctccatgccagcaacgttttggcctccctgacgaactatggaagcagatgattcaaaggcagccgccagtgtccccacccccaccaccctgaatccctctgtcccctggcttttgactccaaccctaattcaggacccctcttgcccccaggcagctgatctctacaaacctcccacagaccctgcccagagaccattgatgacccagccactcggacgagagtccaagctctttgtccagccatgttagggctctgccataaccagtccaggcctgaaaagaccacagctttgtgccaccctgtccctctgctcttgtcttttccccccattcttccttgaacacccatatttttctaccccctggcctgctgagctagatctttttctaggcttgcgttctacccctccactcaacacctgttgaaatcagactgtcccaccacctgagcccctgaggaaaaagtgagaggatgtcggttcaagagcctatatcccccaaagcgctctacaaacccaactcctcaggactcagatgcccctccatctaggctgtcagcacctgagaccaatggctgcatcttcattattgcctcttcctccagccccagcatcagagtgcagggcacagggtagacaatcactcgatatcatggaatttttcagggctgaacttcagtgatgaggaagatgctgggcccagccccaggtgtgcctgccctctggccccaaggtattgctggaagtcctcactgacctagggacgatctaaaggcctctgggggacaagccagcccccatgaaggccaccaaagctggggtgactttttgctgtgaggactgcagaggagataaccgtggcgatttatgggactggttgagactcagaagaaaatccaggagaaaatcactcagctgcttgtcacagaaaattagaacagaaaaattactggacagtaaatttagcacaaataagaaatatttctttgtgttgtgcagactcagcacaacacaaaggggcagggggattgggcatgtccctgagataaataatatgaacaagtttccttcctttcttccttccctccttccttcttcctttctttctgcatagttttatgactgatgacaagtgtgctgtgtgtggttgggtggaggagaggatattaaccccaacataattccctgtgtaggaccctcctctcctcggtcccactatacctgtgctgggagagatgggcctgaggaagacagtcatggcccagaaagctccatgcagggatgcaggacctgattcagttacgcaattaattaaatattcattgggcatctgctctgtgccgggaactattgaaatggaatgaactctggattgcgtgcaggtgggttcgagtacttctcttgccacttactagctgtgtggttttggacaagtcacttccctctctgggcctcagttacctcatctattaaatggagggtaatcatatctaccttaagggttgtgatgagaatcaaaagacaatgatgtctgatatttgggtcgagtcttctgagtccctgccctcatggggcttaagtcttagctcttgaggccgcacacaaggtgtaggagcttccctggacaacagacagttttgcaggatgccagctcaaaggcaccgcatcgccactctctacttggtcctggcttcttccctgtgcgcgctcctgtggcttcttcgtatttctaccaattccatcccaaagggaccagcagctgcttcctaggaggtttcagggtattacatggtagctacttttctgtaaaagtggagaagctgttttatttaatgttcctgatccctacccaagagtacagcacccaggagaacctcagcatctgaaaggagccccagagactaatagagcattctcacacagactctcaatccaccgccctctcccctgaggctctgacttaagtggcctggagtggaacctgggcatggggacttcactgcatggccatgaatggattgagattcagacctgcatcattacaggggccacagcatgtgagagggaagccctgccttctgtagagatgcagccataccctacaacaaatgtaaatttctgtcaaacagatgcaataaaattaaagctttggtccttcttatacactgtacttctgaactgtgtattatggaacttctctaagccttcgttttctcatctgtaaaatggggataacaacactacctgtctcattagatggtggtgagggttaaatacgatacttttttttttttttaagtggagtctcactctgttgcccaggctggagtgcaatggcatgacctcagctcactgcaacctctgcctcccaggttcaagtgattctcctgcctcagcctcccaagtggctgggattacaggtgcacaccacgatgccctgctaatttttgtaattttagtagagatggggttttgccatgttggtcaggctggtctcaaactcctgacctcaagtgatctgcccgcctcggcctcccaaagtgctcggattacaggcatgagccaccgtgcctggccaaatatgatacttcttatggggtgaggataaaataaaataattcttatggggtgaaggaccccataagggtatgtgttccattttgccacctattgttactgccatgatttctactttaagcccatgcacgataagttggaaccttcctgccctgtagcaagatcccaggaataggccatgtgagatgctcagaggaggctgggggcagccaaagatgatcacagagtatctaggcatacgggtcattgtatctaagtgttgtgagtctaattagtgacagtgagcctcgccatccctttgtagccttttgtcatcttcattaaaaaaaaagccctgaattcaggaagtctcatggtactgaccactaacaggaagattctggagccccagagtgcaccctgggggagacgcacctatccttacagaatctggtttctctgggtgagatttacttgaattgcgttgtttgtctgtctgtctctgagccagactatgaacttctgctaacagggatcaggccttaatcaacctggtcctgccataccctgaggctgaaaatacacgctggtgccctttcccctgcagtcaacctccttctccagcaaatcctgtttcggagctgggcatctgcgggacttactcacatccaactaataaggattcttctcatttgaactctaatttctacttttaaagtgacttcctgtgtctgatggagttagattcttatgagtgccaggagacaaacagggggctacttttgggcccaattcacaggtggataaactgagatcagaggaatgaagcaacttcaccaaggacacctgcaggttagtggcaaagctggaagggaattcctgggtctcctgactccaggtacttctcttagccttatggcttcgatgcagctgacctatgggctcaggatccggagtttccacctacctctgatttcacagcccttgccattttgcccacttttgacacttagtcacaacggcttgtaaacgttccacttcaagtccgccccccaccactggctctggcaagcacagatggtgccttatagtttcatttgcacctttccctcctcacccgcacatcacaggcttagagaagagcaaagaacataataagtctttgagtcagaaagactctaagactcaaatgtggaatctgccccattattggcttgttttggaacagttttcttaacctctctgagcgtcaattctcctatctgcagaagggctttgacaagaccgatttcacgggtgcagagaaatgaggtaaagtttgtggggtgccctgcacagtggcgcatgctaagaggctctgcaggtacaaggagtgacagcaggggatggccctctgacctcccacaccatcatgccacggttggggacagaacctggccaggtttcccagcccaggatggggatacccactcttcaggggtgtttgaagataaaaacagataatgggggccaggcgcggtggctcacgcctataatcccagcactttgggaggccgaggcgggcggatcatgaggtcaggagatcgagaccatcctggctaacatggtgaaaccccgtctctactaaaaaatacaaaaaaattagccgggcgtggtggcaggcacctgtggtcccagctgctcaggaggctgaggcaggagaatggtgtgaacccaggaggtggagcttgcagtaagcggagattacgccactacactccagcctggacaacagagtgggactccgtctcaaaaaaaataaaaagagataatgggtgtgtacaaagtgcctggcacacagtgggagctcagtagtgtgtagactttctgagaactcctcacttcacaaaatgataatgatgtaacacatgcatgaagcatacagtttagagagctctttgcacttgcatgatctggcttaatcctcagaacaaccttgcacaatacgggcagaattattaccaattctattttgcagataatgacgttgcagctccaataggtcacatggctagagattttctgagtgcatctgatgcaaagtcccttctcaatctaccttatcccagtgcctctggggttcctgtcatatagagagcttcccacctctttcaggagtttcttctttggtaggcacttctggcctctgcttgaatatctctggtgacaggaagctcagcacccagcaatcactggtggagagctctaattttcagagttaaaaaaaaaactttgaacctagttctgccttcagaagcacaaatcacacagatcctccaatttctatagggcagcctttcaaacctcacccccgtccagcttgtttccactttgataggaagcacggcaggtaagaatgaatcctacgaaggcgacaactgcaatccaagtcctggtgttgctactgtgtaatcactgagtaatcacagcgacctcccagggtgtgtgacactcaaatgggaagggcttggtacctggtaagcgctcagtttgtaggcactgatggaatcaatatgaatcacagtagctcatgatccaggtaggagtggccagctttctactcgccaaccttccttcctttgagtccccaactttgagccctgagtcctgctgctgccagctccacccccaggctcaggcacaactggtgatgacattgcagggtaaaaacttagaaaacaggaagtcactgttcttaggaaggcagtggcagcagctatgggtgggggggtgggggcggtgtctgtgttgggcagggtgctgggtgtgatgccgacccattgaccacagcatccaggcacccagaccatccccctcagtgggttgctccctttcatcgaataactaactttcactgcagcagaaaagatataggctagacacacagagtaatagttataaccactggttgaagatttgttctgggccaggaaccacacgtgtgagttttctcattcagtcttcacagtgactctgatttcacagctagggaaactgaggctcagagaagttaataacatgcctaatgtctacagccagggttgaatccaggcacatctggatccacagtccaggtcttaaccaccacttggtactgaccttcaaagacttgctgatcctcagaggtggtgagaggggtcctcaccaggctgtggagtcccttctcccaggatcgaaccattatagcaggtcatattcttgactctacaattagctttctttcattgagggctgagaggccggcctggggggttgacagatacagaaggcctgctaccaaatgtgaggccaggactcacactgcccagtgcttatagcaatgacccactggagatacctcaatcaccctgaactgcagaacgactccagctaatttactggcaacatataatgttttactactctctttaatttgctaccagcctggccaacagggtgaaaccacatctctactaaaaatacaaaaaattagctaggtgtggtggcgggcgcctgtaataccagctactcaagacgctgaggcaaaagaatcgcttgaacccaggaggtggaggttgcagtgagttgagatagcaccactgcactccagcctgggccatagagtgagactctgtctaaaaaaataaataaacaaaaatttttttaaaaagtaccacagcctccttaattctctcctcagtgtcagatttcaaatattcatgtttcattgtaaaattggatcatttgttcaaaactacctacaaattatgtattcccatagataagggttccaagggaagagggaagaacagggctgtatgatttcttaggggtagcgctttatgagcaaatgtttctcttcttgtatttttatttccattaaagttgttatgttttgagcgatactttgtgatcatttttcttttctttttttttttttttttttttgagacagagtctcgctttgttgcccaggctggagtgcagtggcatgatcttggctgactgcaacctccgcctcccaggttcaagcgattctcctgcctcagcctcccaggcagccatgattacaggcacctgccaccacacctggctaattttttgtatttttagcagagacggggtttcaccatgttggccaggctgttctcaaactcctgacctcaggtaatccacccgcctcagcctcccaaagtgctgggattacaggtgtgagccaccgagcccagcctttgtgatcatttttcttttcattttcaagtaaatcaacttaatataaaagtgcagaaaagtaggaaaaaatcagaattgcccataataccactttcaaacacagccattattaatatgatggcagatggctgaccaaagtctttgttatttataaactgtaatcattttacataacaactttccacgggcaggtgcagtggctcacgcctgtaatcccagtacgttgggaggccgaggtgggcagatcgcctgaggtcaggagtttgagaccagcctggccaacatggtgaaaccctctctctactaaaagtatgaaaattagccgggcatggtggcacgtgcctataatcccagctacttgggaggctgaggcaggagaatcacttgaacttgggacgtggaggctgcagtgagccaagattgcgtcattgcatgtcagcctgggtgacaaagtgagactctgtctcaaaaaaaaaaaaatttcctgaagaattgtttttttcatttagtattatgttataatctaagacttcatgttatttcatatattcatatttcatgttactttgtcattttactattaataaatatcctttttaaaggttgcctaataagctttccactatctacataaccattccccattggtgctcatttgtttccaatttttcaccattataaataattctaagatgaacagcttcattcctaaagctttttacaggattggaattccatcaataatagcttgaaaaatgggccaggtgcggtggctcaggcctgtaatcccaacacttggcgaggccaagctagcaggactgcttgagcccaggagttagagaccagcctgggcaacatggcaagaccctccctctacaaaaaataaaaaattagctgggcatgatggtgcatgccttagtcacagctactcaggaggctgaggtgcgaggatcacttgagcccaggaggtcaaaactgcagtgagccctgaccgtgtcactgcactccagcctggttgacagagtgagaccctgtctcaaaaaaaaataagtgaataaataataatactttgaaaaatgaaagctaagactaatagtccaagagataaatcagcaaaagatataaataggcaattcgcagagacaggaaaacagattacttacaaacatataaaaagacatactgggagcagtggctcatgccaatcccagcactttggaaggccgaggcaggcagatcactaggtcaggagctcgagaccagtctagccaatatggtaaaaccccatctctactaaaaatacaaaaattagtcaggcatggtggcatgtgcctgtagtcccagctactcgggaggctgagggaggagaatcgcttgaacccaggaggcacaggttgcagtgagctgagatcgagccactgcaatcccacctggtgacagagcaagcatctgtctcaaaaaaaaaaaaaaaagaaaagaaaagaaaagacagtctcagtgctagccaaggaaatgaaagtatgaagtgacaaagagatgtctcctgtttttcacaggtggtcagagcgggcttcagctgtgcagatctgtcagggaagggcactccgggcagaggagcagaggtggaaaggctgtgtggtggacctgtgcccagtgtctctgaactgcaagcaggggtaggtagcatgaatgaggggaagttctaggagactaggaaagagggcgacaagcgtgtggggttgttaggtagaacttccttggccagtggcttttactctgaatgagatggggaacagctgcagggttttctcttttgacaaggacacattatgtttttatttaaaatatggtaataacatttcaaagaaaaaattaaagccaactggaacaaggcaaggttcacagttgccttgggcccctgggctaactggagatgccccggcaagccccaggacaggcttcaaatcagccctaaaatccaggctatactgccagcctccattacctgtctgcattcagccaaacatagtcattgtcatctcttcttcccctggtcctcaaaaccaagctcttcctactcttgccccataaaccacccagaaagtggttgtttgtcctgaaagggtgaaacccattcactcttttgctccttcctcatccattaacactaataatccctaagcctccatttctgttatgggctgaattttgccccctgaaattcttatgttgaaatcctaactcccaacacctcagaatgtgaccgtacttgaagaaaaggtcttgaaagaggtcactaagttaaaatgaggtcattagtgggggccctgatccaatatgactcgtgtccttgtaagaagacaagattaggtcgggcgaggtggctcacgcctgtaatcccagcactttgggaggctgaggtgggtagataacctgaggtcaggagtttgagaccagcctgaccaacatggtaaaaccccaactcggccgggtgcggtggctcatgcctgtattcccagcactttgggaggtggaggcgggtggatcacctgaggccaggagtttgagactagcctggccaacatggctaaaccccgtctctaccgaaaatacagaaaaattagccaggtgtggtggtaggcacttgtaaacccagctactcagaaggctaaggcaggagaattgcttgaacttgggaggcagaggttgcagtgagccgagatcacgccattgcactccagcctgggcaacaagagcgaaactccatctcaaacaaaacaaaacaaaacaaaaaccatctctaataaaatacaaaaaattagctgggcatggtggtacaccatgaggcttcaggaggctgaggcaggagaatcccttgaacccgggaggcggaggctgcagtgagccgagattgtgccactgcactccagcctgggcgagggagcaagactctatcaaaaaaaaaaaaaaaaaagatgagattaggacacagacatgtacagagggaagatgccgtgaagatgatgtaaagacacagggagagatggccacctacaagccaaggagtggcacctcacgagtggtcatgtggtggccatccttactaggagaaaatgtcacgcactgtgctgggcagtgagggtggaggtgacagacacagatgtagcctcccagccgagcagagaggtgggcaaggaaacaaatcatcccacgagagaggggcacagggtgctaaggaaacatgagggagggacgatgcctgcagtcacgctctgggagtaaacaatgacaggcaagtgatctcctttggtgagcaggttgcatgtttcagttccctccgctcattccaccaagagccccccaacgccagtggacaagtctctcaggttagcagacaacacttgctatatgccaggcacatagagtgtaagatacacacacacacttgcatacatatgtgtatatacacacacataaatagaacaatacaaacatatatgtatgcatgtacatatatacatagagagcaatatgtgtgtgtatgtgtgtgtgtgcatatatatatattatagatatatattatatatatatatattatagatatacagagagaaagacacttattcttacctcttgttgccaacttggacatgtagctttctctggctgactccagggactgatgctgtaacaatcattgtcataccaaacatttgctctacactttcagtttacaaaacccttttatattttttatttcatttgatcctaacaacaattgagtgaggtaagccgggtagatcttatttgctccactttgcagataaagagactgaaggtcagggaggtgaagtgactctcccgcagtcaaacagctcatgtgtcagagcctggacgagaagccaggtcttgccgggcctttgttctttctcacgcagcacactgccctcaagttttgctcttgaaaattagcaccatttcaaaaaaatctactttcgagcaaaccccttatgtcaaaattccaggcagtattttgccatttctctgagaatttaattttttctgaggataaactctcacagtatacagagaaaataatgtaaatgtccatcaactaggaacctgataaattttggtgtattcatatataaccgttaaaaaaaacacaacagataattctacatgtgctaccatgaaagatcttcaagataattaggttttaaaaaaggtggccaggtgcagtggctcatgcctgtaatcctagcactttgggaggctgaagctggaggatttcttgagctcaggagtttgagacatagcaagacccgtctctgcaaataatgacaataacaaaattagctgggtgtggtggcacacacctgtagccccagccccctcctccggaggcttaggtcggaggatcacctgagcccaagaggtggaggctgctgtgagctgtgatcatgccactaccctccatcctgggcaacagagttagaccctgcctcaaaaacaaaaacaaaaacaaaaaaagctctagatacttgtgtatgaaaaaaacactatgtaagctgcatatatatgtatatatacataaaaatatatctagatggagtttctgtttgggatggtgaaaatgttctggaaatggatagtgctgatgattgtacaataatgtaaatgtacttacttcatgtcactgaattacacttaaaaatgaaaatagtaatgttatattattttacaagaaaaaacacgttaaaaatatatgtatatctggagggccgcacacacaaaaatgtcatccacggttacttctgcagaggagccacgggagggggaggctgggtgaatttcacttattttccaccttacacctttttgtggtgtttggaactctaactatgatagtatataatatttataatactaaacaaccaaaacaaaaacaaataacatgaacccttacatcaaagaaggtgtgtgcggcaagattctggcagggcagaaagtggaggaacaggggctggcccatttagcgaagcgctttgcgcccagccctggctcagtacatttctggtgatgacttgccggggtttggaaggacctcagctatacagaactttcacgataatggtatttggtgaatatggttacatttatatatgaacacagaaaaccaactactgctggtaaatagcatgatcactattgttattatccagtgctgtaaggacgagatgctttcaccagcagccgagtgagatgaaagcgcttttccgatccaccgaatcagtcccactgcaactgtaagctggagaccctctgggccttgggagctcaggctgcctgggcaacgcaagggaggacaggggcggagggggagccaggagggccgcacctgcctcgctcgctggtcgccctcgctctgggatccgtcctgccggtcccaggctgttgagggcgcctcctcagagtccctgtggcccccgcagcttccccggaagaaacccgtgcatccatcggctagcccaagcccaagctcctcccggagctccccgagccggggccaggcctccgcccctcggtgcccgcgcctgggctcctcccgctgcgggccgcccgcccggacgcaaggcacagggggacgccccgccgagccgctgcccactgcaccgagtttttcggaggctgggagaggaaatgccacttggattttaaaaccgtcaccgatacgctataggtgaatatttcgctgggattttaaagagacgagcttcagcctgctaagccgcgctcacgccgcctctccgccctggcctccccgcgtccggcttggggccgggtccctcccgggtcaaagctacgccgggtgcactgcgggctgggcagctctcccactacgcccaaagcccaggcggccgggaccgccgtcccaaagtcacaaaccacacccgtgaaggacgccctccgcaagacagagaggaggctgggcctgggaaggaacctccggcccttcctcaccatgcagccaaggtgggctcccagccccgtgttgccgccagccgcggctcccgtgcggttacgggagcagcagccccgccccgccggcccccagctggctcctcgctcgaggtttcctgtcgagcgctgccatccagggcccgggttatcgcgcgtgatctcccatctgagctgctcacacgctgccgcccgcccccacttgcggtcccttgtccccgaaccgcacccgcccccaggcccccgcgctgagagaccagggcgtggatctgcgccgggctccggcgctgggggccgagggtctggtttttagatatcaaaggagcccgacaccagggtcccccagacaggcaaggagagggacccggcctggggcctgccttcggtggtgggcacagtggccaggatcgggcctggctccggctggcccggcacacgagcacggcgacagtggcaagactgggagggccggcgctgcctccttgggaagccccggagagacgcaaccctgagaggctgggccttcccaccccccgccccctcccccttcctcagatagcagggaggaagcgccaggggtctctccgttctcacatagggggactccaaatgtcgtcaaacctgccactctcggaatcaacagctgctttcattttgagccctgtgagcaaaagtttcagggctttcctggcacacatacccagtgcatggagagcgctaaattttatcttcccttctagagtgggacattcctgtgtggagctccgagaatacatgccggcactgcctgtgcctggggctgtgctggctcccacccagctgcaggaatgagggaccacggtacggagggaagtggctgagttgacagccactgatagagctttttcctgattgtctctggcttgagctaaccaggtggcatgacaaagtacttaacaaaaactacagatgcagagaattttggaaatttttaaaagacaggaaaaaaggtggttgaggcagaaaaaggtagttctagagtgagaggggtttctttcctcctcttggctcacagcagaggccaagtccttagcagtgtttccagagcaggtgaatgagactctctgaaggccggcccaggggtctgccttgtaacacgttcccccagcttctcatgtacaccaccactcttcggggaccaccaccttctgggttggatgggtctggaagattctacgaatatatccagccctacctgagcatttgcagaaagcctgctctgtgagggagggcagccccaaagctctctgttgtagacacagaacccaacagggactactggtgccacactctatctcttctgtcagagaagcacccaagtgagccatgactttgacattgcatggccatcttatgttcattcctcaaactttgtcatgttaatgtgtactctctcggggacatcatacctaacacggctgcctgaagatctgcttcgtttagaatatgctagtgaggacagtcctggaatttctttgtctctttccagccctgctttctctacctccagtcgttttctgaggaccggcttggtgggtgctgatgcctgcctggaagacctcacacccacagtgtcttagaagattctgaaagcagtgtgaggtaccagcctgctttagcgctaggagctggcatggtgggggtctcaggctgcatccgcacattctcagcggtgcttttgctcctggaatggagccacaagctgctctgggccatttagagactctaagtggtttgctcagggctatatggaagtgggaggtgggggacctgggcgctctgtagcatgcttagtccccctggcagggttagaggttagttgaccagagacaacgagtccaattcccaaacagaccagaatgaccagcaaaggagaaaagaacaaggacacattgcagccaaaatggagctagaatcttgcctctgtccatccttcactggagttatcctggatggagaaggaaccatatcacctgcaaagcctggaaggggagccctgctgtgaggtgagccagtaagtctgtgagttcaggagggagcacacgcttgtctgtccatctgttcatgagcaggcgctcttgagtcttcctaaatattgcccagagctctccatccagatactgtcctttcccttcctctccattgatggtctccaagcctttcttagctttcatcttcccctaaggattccttctcccaaagctccagcccattccaatgtcaactgcattcgttgtttttgttactctcattgtgtcaaatgggttctttcctatgcaactagattgtaggttgctccaaggtaaacaccgtgatttctagttcctttgtttctaccactgcaggactgtaggaagcccagttgtaggcatcactaggactcagtaattacataattgctcagataattgagagaatgattgattgattagtggtcattaatgccataaaatgaaggaatttcgcccctcacattttcaagaacctatgagttcgaagagacctgaaagaacatttttatgggagcctacaccagtgctatcacctaaagtgcgtgaccttagggaagttgcttcaccccttgtttctgtgcctccaaaatactggtgttaatacagtaatttctgattccttccacctgtgccctgctcagcgatccagtgttcaagctggtcatcaggagaaagctacttatgatttcctaacaagccaccacagaacatcacattcccaaacatgctcttcaccgtccctgctgtccccacgtgcctagccctggtgtgggcaggaatgagtgggattgggatgttttctcacaggtctttctcaggtgaggccccaggctgtgaccaggcccctgccctgcatgtgactcaggcctagcccctgctggggcaggaatgccacccagcacagcatcctactggtgcctgaataaagaatggactggaggttcacctgaaaggggctgccaggtttctgcgggggccagccaacggctcacaatgaccctgtgttcgactcatcttacgatgaaatttttcagcttgacgaacttttactcatctttcaaggctcggctcaaatgttatttccctgggaaaactgcgctactttcagcaaaatgcatttccttttgatgggcatctgtttttttctttctttctttctttcttttttttttttttttttttttttttgagacagggtcttgctctcttgtccaggctggagtgcagtggtgcaatcttggctcactgaaccttcacaatgggcatctgtttctgttctatggagtgacctaaaagtcaagaatcatggagaaattgggagcaatggctcacgcctgtaaatcccagcactttgggaggctgaggcaggcggatcacttgaggccaggagttcgagaccagcctggccaacatggtgaaaccccgtctctactaaaaatacaaaaaaaaaaaaatctgttagctgagcactgtggcgtgcgcctgttatcccagctactcgggaggttgaggcacaagaattgcttgaagctgggagggggaggttgcggtgagccgagatcaagccactgcactccagccttggtgacagagtgaaactgtgtctcaaaaattttaaaaaaaaaaaaatcatggggagaatttattgttaaacagaatattagttacattttcaaataatacagtcaatatgtttttctgtaacctttagatatgttttcaggtgaagtacctctaaatgtaaagaaatgggtccaattgttaattttttttaaaggttcaagaaatacactactttctctggctttttccttacaactcttttttttttttttttttttttgagatgaagtcttgctctgtcacccaggctggagtgcagtggcatgatctcagcccactgcaacctccacctcccgggttcaagcgattttcctgcctcagcctcctgagtagctgggattacaggcacacgtcaccacacccggctaatttttgtatttttagtagagacaggattttgccatgttggccaggcttgtctcaaactcctgacttcaggtcatccgcctgccttagcctctcaaagtgctgggattataggcttgagccactgtgccctggcctcttgtaccttttttacattaacaactggactcgctttaaatgtagagatacttcctgaaatggtgtgtgaaggttgaagaaaaacatgagcatattatttgaaaatgtggctaaagttctgttttaaagtaagtttatggtaatatttctaacttttcagatgctctgtagttcttggcacatttttcactaatatttggtgacaggtctgtccccgttaaaaattgagaattccacaaagcctgggatatgttttattcttctttgactcttcactccccagctaaccaccatgcagtgggcaatcataagggtttaatgaatgaataaatgatcaagtcaggtaggttttccccgaattcttgtctttggggctgaacccagggtaggtttcctggcatcattcctgtgttttctactctccctccctaatcctctgaaagtttgaacaaaaataagattatgggccaggtgtggtggctcacgcctgtaatcccagcactttgggaggctgaggtgggaggatggcttgagcccaggggtttgagactagcctgggcaacatggcgaaatcccgtctctacaaaaaatagaaaaattatctgggtgtggtggtgcgcacctgtagtcccagctactcgggaagctgaggtgggaggatcacctgagcccgaggaggtccaggctgcagtgaaccaagatcacatcactacactccagcctgagtgacagagtgagaccctgtctcaaaaaataaaaataaaaataaagaaataagattatgaccaagagccgtatgtctcagatgttgaagggcaatatacctgtgcttcagaaaaatctgccctgtgtgccaaaatgtgcagaaaggagagccagcttctcagctggccccatgccccactactaactactcccacggcctcggcgagttatttcttctttttttaaaaattatactttaagttctagatgtgaacaacgtgcaggtttgttacataggtatacatgtgccatgttggtttgctgcacctatcaagtcgtcatttacattagatattctcctaatgctatccctcctccagccccctgaccccccgacaggccctggtgtgtgatgttccccgccctgtgtccatgtgttctcattgttcaactctcggggagttatctctgagttactcctgagtctgggctgggagacaccagggggacagggcacacacatttgcaagtttcctattcaggccatgctgtccaggcagccagaatgaagcccagccagagccaaaaggctttcctggaggtgtgtttgtcagtttggcaacccttggtgtgcccagcccacgcgctgtgagcattcgcctatgacgtactttgcgtggatcaaaggccccacaaagcctgccgtgcctgcagctgccacgctggggacatgctggggacgtgggcgatcgtgggctgagaggcagactgctgggctgccgcctcccatggcagctttctcccatgggagggagttcaccttgcggcttccaaactcagccgggccgcccctaggcatgtcacctcttctctttttctctctgttgtcccatgatttgggtcctcaggacctctcacctggacccagggataaatgagatccactatcagagccaatggcagcatcggcagcactctagagctatttctacttgattctaaacctagatttatactatgtgtagccagctagaaatacagatctcactgtagaaaagagactggaagaaattacagcaactgttagcagtggtttcatctctggtttgtgaaattatgggtgatttaaattttctttatgctttcccttattttccaagttccatagtgtataagaatatgtaattttgaaataagagaaaatagtcggccgggcgtggtggctcacgcctgtaatcccagcactttaggaggcccaggcgggcggatcacaagatcaggagttcgagaccaccctggccaatatggtgaaaccccatctttaccagaaatacaaaaattagccggctgtggtggtgggcgcctgtagtcccagctactcaggaggctgaggcaggagaatcgcttgaacctgggaggcagaggttgcagtgagccgagatcacgccactgcactccagcctgggcgacaggctcaaaaaaaaaaggagaaaatagtcaaagtacatttttgatgccttgtattaacctcccttttgtgtcccccaccctcaaaccttagttgcactttaggtcaatgaatatctaaatcactctgcattcttcaggcacacagcagcaggagggaggtgtgcctgataggatgctggattaaagattggttctgaccaattcacagagtataggatgcccacaggaggaaagctgaatatttagcatggtgtaagtctcatgggacttggccactgtcacaggctaactgatgcccaacctgcatggagcccaggccctctccccacctggctctcttcaagcttaggaggctcctcatcccactcagggtttaagattctcctttgatattctaggacatggaccaagttgggatttagggttgctcttgggttaccagccagcgtccctgaagcccctcccaaaatgtcactggggccctgtgaccatagaagaggcctctgtgggccacacagtgagtccagcgatgaagccagaccagtgtggtttagggaacaggccgcagcaatgggcaggaactctggcaaagctgtgcctcctatggctctcctcgacacagaagtcacaacccaggttggggacctaggcgtctctgcatgtgcctgtgtaggagcctgtgtgtgtaaacaagtgtatctacatacacgagaacccaagggagagagctgcacagggggcctgccctggtctaagccagaaaaggaggagaactgttccttttgggggccgatccctgctgggagaggtgtgccagggttcccgccgctgggccatttcccccacctgagttctctctacaatgtccaaagaatgggaccagtaaaagggggccagggcaattctcccaccccctggaaaagtctgccctccctccctgcaggcctgaagcccttccggccctcatcctccccttctcctgtgtcatcctgtcttcagactgatacactccttccctctggttttcctctcagttgtctcttccttgcatttccctccttaattccctcccaccagccttatttttttctccatcatctgtgcttgctcttccatctttactcttgatagcctcattgcctgtctcctcagatagccttgggtgccaggttacctggcatccctggccctaagaatttggggactgcttcttttgcttgatccagctctctctggaggatgggcagtcgccgggccatcccaggaacccttcctgggttctgtttgtggcttttctgcgttgccactgagcatgggttgctctcggctggttagcataggaggtcacactatctgttctggtgcaggaattgtccagggaattacagtcaaggctgcaatgtgacctatggcctggggccagcaagcctttcttagtctccaggcaggccaggtacagacagcaaactcagaaacccacgattacattggctgtcctttatattagcacaccaggatgcacccaattagcagtgctcattcctgcctcccttctgacttcaaatacctaaagcccctcatatctggaagcagagacctgaaaaagtcatcatttctttttttaaaaggagaaagggagagggaggctaacacacatacacttattcacaaaaaataaaagatggtttcatggagttagtctgctgggatatttagaatctaggtttgtaacttgcatctcctttctcttgatcctacatttcagcctccaatttagtgggaacttgaactgaactgtgctaatttattacttggacaccaaagagttattattttgtggaggaaaatcaactttgaacattcaagaaaaaagaccccattgtaatgattggttagaatttgatctggatctacatagattcattttctaaaactattcaattaaggataatgtcaacctattgcctgaatttaaatcagcgattcatttggctaatgaattttcctttttctgtgagtaccgtgtcctacgaatttacaggggatggtcagagaaatggtgacaaagaaaaggaggtttgtttgtttttaatgttttgtttgctgacttaaaaagcacacagccctggaaatggccttctcattactcgagacaataaaacatcccagaaatcctgacactggctaataagacacatgcctttaatgacagcctcaaaaagaagcccctacggtggaaagtgttgtgtgtttgattgcgctagttttaccatggaatgtgccagttgtggctggaagtaattgtcttttcagtggacaacaataaaactgtttttaagttctcttccttagtaaagcctaatttataaatggaaataagaagtttctaatttcccccaagcagatgccactctccttgaactaaaatcaccttgggattgcagtggagtccagcatgaagatgcggttttcctgcgtttccaactcaggctgattgaaggcagcttatttgtttccccaaacacttggctccaaacacagagggctccctgctgagtgatgggttcctaaaaacctgtttttcttcaggggaagatgggtttagttccagttctgaacatctctaggggttgcttcctccaagaacggctcagaaatagtcccctaaggaaactccatggggagaagcttccctcaaactcaggactggctgctttctgctttggacaaggatgctggctcccaaaacaggggcccaaataacttgaattctcaaaagctatttttatctttctcagcccccactcctattctaaaagtagaaagctggggaaacagggtgagtagaagaagaggggtacaaaaaggatctacagagaattttgcctgtagtttttctagctctgaaatgcctggggacagaagatgacaacactaacttgaaacttcaattgtctctgttttaaaggcagacacttttaattagacaaaagcaaagggaaagaagaatagaagtacagttaccgaaaaggccccaagatcgcactatttatctgcagtgtgtgctctgtaaaaaacaaaaacaaaaacaaaaaacaaataacaacaaaaaaaaactgcagcaacttttagagagccacatagtattattccagctctttcttcccctctgtctccattttacgtttatttcctttttattggtttcactatctcttgctttttctcttctccctccaatactcaatcttcctgtccatatatttatttctttccttccttccccacctcctttcttctccttcagagacctatccagacagagaatcatgtgtttacaagcctcatacacagagttgttggagaaggcgccagccccctccccaccaccctgctaggccaacctgcctccagtggccagtcccttataaactggagatcagtgagatagaaagtcactcatagatgccttccaccttccttttttttttctttttcttttttttttttttttttgagatggagtcccgttcagttgcccaggctgctggagtgcagtggtgatctcagctcactgcaacctccacctcccaggttcaagcgattctcctgcctcagcctcccgagtagctggattacaggctcccggcatcatgcctggctaattttttttgtatttttagtagagacggggtttcaccatgttggccaggctggtcttgaactcctgacctcaggtgatccatctgcctaggcctccaaaagttctggtattacaggcgtgagccaccgcacccagcccctttctttcttcttcacctgtagtgttgctctagtttcttgtagctcagcaactgggcagtgaaagaattggtttccctgaattatttgggggaatttatttatttcacagcagcaggaattatttatctagcctaggctgccagacacttctgagcatctagtcatttggaggtcattgatgactggccatgccccctccatatttctctggctacagttaaagcagttctttgagcagtcagctgggtgatattaactcactatctttttcctctgctaatttgagtgttcagatgatgcatggccaggcacatgcacacactcctgacagcaattgccagggaatattgcttttctggactttgacaccagctccaactttgagaggaatttaagtgatatttactgcatagaaattcctctttggagctttgctcttctggttcagtctgctgacaacacgttagatttattctggcatcaactagctgcagagcccaagactcagacttaattaactttatcagggatttgagttgcaactttggagttcgaggctcagcacagatctcagtattactaccaatcacagcacttagaagtacctaaaatcaaacaaatgcacaaacagaagaattcctcccccttgcacagttttctgactatttgccaattaactctgatagcctttagaaaaaaaatcagtttgtactgatccaagctgctagatgttctgtgtattaaatgtaagtccattttaatactgtaccacattcgtctttttttttttaaatattagaatttagaactaatgttgttggggaaatttccattttgagataagctacaggataattattgccttgtcctgctttttatccccaatttttcccctcagttttaagagtcacctgaatattggaaataaaatttaatccagtttcatttatgaggaaaaacgtgtgtatgtgtgtatatacatatggataggtacctatgcaaatgtattttcatatgcacatatatacatacgtgtgtgtaatgaatgccatgcagcaatttcagttttcaagagcgaggcctgtggaaagtcaagtgagtaaagaccaggcaatgtgagcccaacaggctggagccccttgattagttagttaacatgcaaaggcttcgggaggcctagctcctgttctagaagtactttatcctcttcttttttttttttttgagacgaagtctcgctctgtcgcccaggctggagtgcagtggcgcaatctcagctcactgcaagctctgcctcccaggttcacgccattctcatgcctcagcctcccgagtagctgggactacaggcgcccgccaccgcgccctgctaattttttgtatttttagtagagacgggatttcacgtgttagccaggatggtctcgatttcctgacctcgtgatccgcccgccttggcctcccaaagtgctgggattacaggcgtgagccaccgcgcccggcccctttatccttttcagtcccagacctgaaccaggaggcaacggaagatttattacagatgctcattgcggtgcacttttaaaatttatcgtggactccaagcttgttaacaaagatttgccattcgctcctggctaatttcaaggttaacataatctgcttttctgcggcccttcatgcaaacgcagagtcaccctgactcatgaaaccatgccttgctttcccacctgaaaactctcattttccatttggaacgttccaaggacacaaattccaaaggggattttctgttcaacagataattctgttggattggattattactactttccagcctgcttctttgcctcggtgactcagaagatgagcactttgcagttaaatagaaagcgctgaactgtttacgttccctccccaggacactagggcaggttggtgcagagcacagccctaagcgttgggggctggctgttaagagcagcctctccttgggctgctggctttcagtcatcattttggacagttctgagcttctgctttattatcggatttatttgtctgtctgcacatcccctgtcatgctctccccagcctcctaacccacccacatgaaccccagcacagtttgctcgtatcccagtgacctagggcctccgtctggtcggtttaataacggtatggtacttctgtgggctatttcccatcatggacactttctcattccagacatttggtaacaaatagaagcatgagaggcgtattacatgccagagttctccaatccccttagccaattcataattgacttttaaatcatttaggcgcaaaagcaaataataatagcttcagtgttcagtggcgaataaattctagctcatgaaaactgagggagaaggcttagacagtaaaaattaaatatttatgaagatactacgctcacaccgacatataaatgcacatacacatacattttaggcatagctatttatttttaattctttatgtgatacccaatgagaaaagatttccagtaaaaaaaaaatgaggggaagatttattgcctccaaattaatataagaaaacgtccctgtaatagctgtcctcctcccccagtaaaaggaaagaaaaaagatacacaaatattgaattgacaaaattatcttttctctattgtgagaaaggcaagttaatacccataaagaacttcgcactccctcagttgaaggatgctctataaatacaaagcatcgttataatttattattgaacagagtcaattttttcttctgaatcatttttcaaacctctcatagctcaggcctctctgatgggagctctgacatgaagccaaaacacctcttccagacacagagagaccatcaatcagtttaattcgaagactcctcaaagtgagcctcctggtagcccagcaggaactgttttagagtcttcttccttcagttacagtcagtgacttgcatagagagctcaggtcacctggctcatctcaggcactcaccagacacctgggaagggctggtatttctacccttgatactttgctcccagtaaagggaaaccaaggctgagaaccctcacttttctttacccacctttgttcttagccctgccttctgctaaattgtaaccaacaaatccacagtggctaaaattcccagtcatgcagtcgctcctagactgagatgctccacccggctgatttgttgtgaattaagggaaccaaaaaataaagtgctctctttccttccaagcagggaaaggaagctacattcccaaacatagagaagagcaaactgcaataaaaaaaaaaaaaacaggagttcctaccactaaaaaatacgtgatctgttttgctttgttttgtctttttcctggagtgcagtggcacaatctcagctctctgcaacctccacctcctgggttcaagtgattctcatgcctcagccacccgagtagctagcactacaggtgtgtgccacagtgcccggctaatttttgtatttttagtagagacagggtttcaccatgttggccaggctggtcttgaactcctgacctcaagtgatctgccccccctcagcctcccaaaaagtgcagcctcccaaagtttggcaagaagcatttatacatttgtgggactgagtccatttaaatcgtccaaatgtccagatccaaaccatgggcccacagagctaaggagttgtcttggaagatggagacgtatttgattttcagttgtaagatccagttaaacaagggaattcactggagaaggaaatcgagtctttccctgtcctctggcattggattacttcccagtatgcttaagtggttcttgttgatgttgggacacttaactacactcattaagacagtcacgggcattgactctgcattttttaatctgacattttctgttttccaagcgattttattttcaagaacaatgcagatctcccctcctcacccctttttttttcttccaataattaggcctgaaagcagagtgagagataaaggaaagtgttcaagcaaatgatctgaggttctagaataaatatgtcctagtcattacagagctgtttgaaagcctgtgattggcctcctatggtcactggggcacagcctccttggatggcatctctgcctctcctagatgtcttggagagaatcaagactcaggccttggacctcttctctaatcttacacacttcttttgtgatttcatctattcattctcggtactttattttattttattttattttttttgagatggagtctcactctcgtcacccaggctggagtgcaatggtgcgatctcggcacacggcaacctccgcctcccaggctcaagtgattctcttgcctcagcctcctaagtagctgggattacaggctcatgccatcatgcccagctaatttttgtatttttagtagagatggggtttcaccatgttggccaggttggtcttgaactcctgacctcaggtgatccacccatctcagcttcccaaagtggtgggattacaggcatgagccaccatgcctggccttttctcagtactttaaaatatcatccgtatactgttgaccccaccatttagatctacagccccagttctctcctgaaatccagactcgaacatccattcaatatctaacggacaactcagctctacttgtcctaagcagaactccttatttctcccccagcaaacctgccttttccagggtcattgggtaacatgaggaagaatttgatttctcaatccaaaactgggggaaatattttttttatttcctatatgacttttgggcttacagaagtaaaaatgttaattgtaaaaaaaaaaaaaaaaaaaaaaagaaacaaggaaaatacagaaaagcgtggaaaagaaaataaaaattagccaaaaaccaaccactcaaacataatctttaacattttgctatattttcttctaatgtttttttctactgctttcctttttttcaaaattaggatcatatgttagggtttgtgtttgtttgatttttcttagtattacctattttttgactattttgaggtattgctatgtataataatttactcagctatgcccttattgttagaaatgcaggttatcgttgatttttagtattatagtgctgcagtcaacatccttgaacacaaatattttattccactgattatttctttctttctttttttttttttttttgagatggagtctcactctgtcacccaggctggagtgcaatggcacaatctcggctcactgcaacctccacctcctgggttcaagcaactctcctgcctcagcttcccgagtagctgggactacaggcgcccatcaccacgcccggctaattttttatatttttagtacaggtgggttttcaccgtgctagctaggatggtcttgattttctaacctcgtgatctgcctgcctcggcttcccaaagtgctgggattataggtatgagccactgcgctcagcgtgattatttcttcagaataaattaagacacatggaaacatgtaccctaaaagacaaatatatttttctggaaagtaactcacccttaaatttaaagaaaattggctctatctttctggaaagtaattcagctctaaattttctgggctatttaaacttagggctgacttactttccagaaagacaaaaccaatttacattcagcagtttttgagagactctaattcattgtgttctcaccacactgggtattatcattaaacagacacacagcaaacaaaacaactcaacctacccagtaagcaaaaatagtctaattttaaaatttgcatttttttgaatagtagcaatgttgaacatttttttcatgtgttttcttcaccctgtgtatttcctattttatgaattgtgtggtgatgacttttgcttatattttgtttatgtgttttagagatgggggtctcattctgtctctcacgctggagtccagtggtatgttcctagctcactgcagccttgaactcctgggctcaaacgatcttccagcctcagcctccagggtagctggagctacaggcatgagccactacactcggctttatttttcttttgatgtaccctcttacaaagtgatttcttttttttttctttctgtttctttctttttttttttttttttttgagactgagtcttgctctgtcacccagtctgaagtgcagtagtgcgatctcggctcactgcaacttctgcctcctggattcaagcaattctcctgcctcagcctcctgagtagctgggactacaggtgaccaccaccacacccaactaattttttgtatttttagtagagatggggtttcatcaagttggccaggctggtctcaaactcctgacctcaggtgatccactcgcctcagcctccgaaagtgctaggattacaggcatgagccactgtgtccagccctaaatgatttctaagagcgtgttacatattaaggattcatccttttcctatggtatatactgtgaatattttccctctttaccatctaccttttatttggtgtctttggcacatagaagttgaaatttaagtcatcagatttttgcttagaaaatctttcctcattttgagatcaaagatcattcacttatattttcttgggggtactattttcaatgtcctgataaaacgctcacaataaaaaaattaggaagtgttttaggctgcagttcaggttggcagaattatgcctatggccaaatgtgtttgtatgcactcacacacagtgtgtgcacatgcgggaaagcaagtctagcaaaatttattttatctatttaaatgcattacaattaagaaagcaaaatgtggactttttttttcaaggggacagtaacaacgaagcgaagaattctgtttcatagctgggtgagggagggtattgttgcacatctattaggattttgctggctgttgaagtcaggtcctactgcagattgtgtatttatcacagttttctttaaagaagtaaaatcaaagtgggcaaaggcatctgttggaagcgctctaaatatgcagatattcttgagggagacacaacattactaatcttgtgtctgaccctcttgtgtctgatcctgccactcccacacactgtgagggcctgttcggcttggtgtcctcatggcctagtgacccccatggcctagagaggattctttgtgtgtccacacctgtgttgcctgcatgaaagatcagtgaacatttgctagtgtgtggaattccttggccttcccggcagcccctgcccacctgctcctctggcctgaccacctttgccctccagcccacacaagtattctacagctggggccttgaaggatatcagatgtctactccttaggcgtcttcttcaagttttacacacacacacacacacacacacacacacacacccatctgtagtcttacagggagatctattctgaggcctttccttgaagagctgtggttctgtgttcacactccctcttacaccctctgggtggttctctgacctgagatagccagctgtcccgagctgccctccaccgcccagggggcaagtgtggtttctcctgctccctgcttgccatctccttctctctgggcctttctctcctccaaggcccatctgagggcagctgcaacctgcatattgtttcgaaaataaggttgcttcctgcctacctgcagaccacccacgcccacaggctactaggagaaatgtcatttagccgcgctcacagccagtgattcacagagcttctcgccaactccttcaaccccaactgcagcttgagaatgaggcgctgttattattcccattagaaaaaaaaatgggaaggaacagcccagaccaagttcacacagctggggagttcgtgcagaactgggagtcctaggtcttttctgctctgccacaggcaagtccacgttctctctttcagccaagggtcactgtgctctgcaagattatgatgtgtgtctggtcagggtatagaaacccctcacctaagcattcctgactggagaccccccagactttgaggagctctcactgtgaaggggaaccccttcttgcacattgcagcccctcactcctttgctggggggttttactggtcaccagcctccttgtcacactgactcacggatctgctagctctggccttggaaattaaccactacactctcatcttctacttggttgcaccttgcatatctgatggctgctcctggcctgtgcccttttggtcttctatgccgttttcatcttgtacttgtctctggagggctctgcctgctctgcacaccctctcccttcaccacccccggaagactagataaagccgtgtgaaccagagataccccacttccttcttcctaaatatttctctctgatttcattcgcaagagaaatctgcctaattatagatggatagagatactgaatagtctcactgccctctttttcttctccctggctctgagtctgggggtggggctgggaagggggagccagcctcaggcaaagttactgcctgagactttaaagtcagattttaatctccttaatctcctttcccttccacccacccaccagcacagtcaacgcatcactgagacacctgcttgggtaggggtgggagggtagcggtagtggggttagagggtggcagaggcacacttgtttggggtgtggggagaaaaattctgcttctggccacagaacctaactggaggctcaaagagatctttttagataacagtggccaggcaggaatgatgagagtcatgccacagaaaagatctttagtgaaagacaagagccctacttcagaaaactggctgagcccccggtctgggaaggaaatgcacacaaatgggacaccttggcccgctgaaagcacagacaccagcgaagactactggactcagttcaaaaagtatttgggagccagcttgaagaggctcccactggccaacgatggaacaacttgagcatataagaaaaacgactgccatgggttaaaactgtctttttttttttttttttttttgacggagtcttgctctgtccccaggctggagtgcagtggtacgatctccactcactgcaacctctgcctcccgagttcaagcgattctcctgcctcagcctcccgagtagctgggattacaggcgcccaccaccatgcccgggtaatttttgtatttatagtagagacaggtttcaccaagttggccaggctggtctccaactcctgacctcaggtgatccacccgcctcagcctcccgaagtgctaggattacaggtgtgagccaccgcacccggcaaaactgtcaaatatttttatgttcctacatttatcacaaccctaaaaccaaccaaccaacatacttattgctcacccttggaggatgctaaggaaccaaattattacttaactttttactgggaaaaaaccccaccatttttattataaaattatcaaacacacataagagtggaatagtagaatgagcctctgtgcacctgtcgcacaacatcaacgatgatcagctcacggctcttcctgtttttctatatccctacccagtcccctctcccctggattattttgaatcaaatcacaggcatcatgtcattttatctataaataataaatcattataaataaagggaagaaatcgaacacttatcctgggcatttatcagggtaaccaaatagttaacaagggtaagtttctctctatagaaatattccagcaaacaaatgaaaaaggaaagataatccctaatgaaatagaggctctaggcaatgattatcagtggcttttggtgtcaccaaaagaaagagcaggacacatcacaagcctcctgaggaaagtacaataaccaccttgaaatgttcttgctacattaaacctgaatcccatcaacctccagattcaacagccagtttagaaaaaacacaggaggcagaggaacacgttaaatgacaccacagggatgcaatcagcaaaaattcacactgtgggagattctgtggcacaaataacctagcttcgtacagttcaaagaaataaagagaggggtcgggctgtgggggaaggaattctagatatgcaagagacagagaaactgtctttgttggataaaatgaactgtgaagtaaaaaacatgagacagagaaattatttcaacaccaacttgatatttgatgatattaaggaattactgtaaattttgtaggagggataatggtagtatagtatatattttttttctttaaagggtgcttatcttttggaaatacacactaacgtatgtatatgtagtttattatattattttctttacttttctacatgttgaaacaggaagagttgtcctggaaaatagtcctggggtcccccttcagaagaaaagcagttggtgagaagtgaagcgctataacattatgggttgaaatggcgcctttcttgggctgctgacaccttctcagattctgctgagcttcctgagggtggactctgaatcttggcttctcttataccctctggtacaccaggcccagggatggcccactgtgcactctccccaagccctaccaagcaaatagaatgagcctttcagagagctcttggctctgtgtcatgtcttacttagctgcatacttaatctcttaattttctttctttatctataaaataggaccaatgattcttaattcacaggatttttgtgaggataaaatagtataatatataggattcttctctgtgattaaaataacaattcatagtgataataatagctagcagccaggtatggtggctcacgcctgtaatcccagcactttgggaggcctaggcgggcagatctcttgagctgagaagtttgagaccagcctgtgcaacatagtgaaaccccatctctacaaaaaaatagaaaaattagccaggcgtggtggcacatgcctgtagtcccagctacttgggaggctgaggtggcaaagctgcagtgagttatgattgtgccactgcactccagcctgggcaagagtgagactgtgtctcaaaataataataataataacatctaacacatatagaaggtttattatgtttcaggttcattctaagggctttctatgcattatctcatttgattctcataaaaccctatgccgtatgttttatgattatcctcatctcacacgtgtggaagttaaggggcaaagatgtaaaggttacagtgccaaatttgtagtatttgttcttatcatacatagatggaagaggctattggccccactgttgtaatttgagggatagctgaaagctctcctcctgctgaaaatatttttagatagaagcattttggaatccaagagattactgttaaaaggatattactctgagaggggtgacaaattaaacctctgcctacctggaatgccttaatatgaaattatcaggttactctccctcctctatcaggacccttagagaaaataggagcggctgggccaggagaaagcaaaagggaggaagacgttaagaacaaagcccatgaccttgacaattttacctggagcctgccttgagcccaaattccagtggtcagtgccagaagaaagacaaacaaagctgcttttctttttttccaaacagacccagagatggaagatggtcctgacttgaaagtgccatttgtgtagttccagtgcccagagcttccttcctcactgatccctcctgtgggcttggactctggcacactggctgtgaagtgttttttgttttttccttgagacagggtcttactctgtcacccaggaggctggagtgcagtggcgctccagcacagcagatcgtagctcactgcagccttgacctcctgggctcaagtgatcctcccacctcagcctcccgagtagctagaactacaggtgtgcaccaccacttttggctaatgttttattttttgtgtatatggagttttactatgttggccaggctggtctcagactcctggcttcaagcaattcccccgccttggcctcccaaagtgctgagatgacaggtgtgagccactgtgcctggcctggctctgaagtcttgataatttcttgggatatcttagtgcaaaacttggaagccatatggagaaatgctggtgctgatggggcagttgctggccctgctgccaatcctgtgaccagccctgggtctccccttctgtcctgatgactattttggtccccaccaggatgtcatgaaagttctcagcccagctgagctaaagcccttggcaactcttcctttcttctgggctgtgctctgcaggaccaggcaaagaatcaaaaggccagacgagccagaccatagagctgtgaggggctgaagaatgtggagaagcactgtgtttactgcagcacagctgctatatggaaaagccagtgcagctccggctacactgacagctgtctgatgtctctcacacacagatggagaggctgaccccagacttccttgggcaggttacaccacagccgtgcatttgtttctagctacgcagttaatgggacatggaagaaccagacctgcctgagtacctaacatggcaaagggccttcggaacatgaagaatagcagagataagaatgttaagcttagaaaagacttgaggactttaaagctgctttcctatttgaaaggctgtctcatggaaaagagattggacttgtgtatgtgtgtgtgtttggtggggggcttcgagggtttgaacaaggaccagtggaacacgggtcagattggtagaaggaagtttcactaaaaaccaattggagaggcagtagtgtggacaggaacgcagagtctggagtcagactatttgtctccaaatcctactttctgtgcctcttaccttgtctgtgaaggcgagattaaaaagttgtacttatctcaaaaagttgttgtgaggaataagtaaattaatatgggtaaaatgctttaaatagcttggttcatgctaagtactcaataaatgtgaggtggaaatggaaacatctatgatttgataaataaaggcagcaagattcaaattgtatatggtgtaattccaattttgtttttaaaatgcatattattttggaagaatactcgaagaaaataccccaaaatattcacagtggtaatttctgaacagttggattatgagtgatttaaagtattacagtttttaatattgcatattttctagataagcatatattacttcataatggaaaaacatttttattttgctctctatttaaaaaggcatggcatacctaaaaatgtagtgagatcctagttaccaaaaaagataaaccatcctgttactaaaagtattcaaactcacatagctaatggacagttgggttattcatactgtttaatcccaaccatgtaaagaaagtagcacgtgaaaatgcagactggagggaaacaggtggcactggttatggttactctggggatgtggatgagaaattgtttgtttctgtattcttttctgtactttcagagttttctaaattacatgtgcattactttgaaaacggggaggagtgggattaattggaaatgaaaattaaactaaaaagacatttttaaaaaaggagttcagtccagattagcttgaagggccccatagacctgctgatctagtttccccgaccatgattctgtgaccacacaatggtggcgattacatgatgtgacatatccgcctccatctgccacacactacggcccagcggtggccatgcctccccctgttcaaaaatcaccccaggagttcaggtttgtttttgcatcacatcacagacctccccgctccccatcatgtggcttttagggcctcatattctggtcacctcactttccacctgtgtccccagtccacatctcttccatccagccaggtccacacctttgggaactcaccaacacctaccctctccctgtctggactgccgctgatccctgacttggaatgccccttcctcctgccagtccacattctacccattggttgaggttgctccaggggcactgggcttctgcaaacgccagttctttgcctgcaccaaataatttagcacaactgcattctttactgcttcgtgcctctcccctttggcatgagcttcgtgactgcagagccacattttctacttctcttttgcctcatatgccccagaccaaaacatctagcttgctgctgagagcggactcagaatccaaaacagcacgggctggatcactgttactcaatggccactgcatatggtctgatgccccgttccaaaataggccaagaaccgattaggccgacgttctttagatctggaaggatagtagacctgtgagttaaaggtgatttgtcagggcagccccacagttaagacacaatcctgccctggagagaaagaaacagttttctcactttgagcatttcagtgtttggtttagagagctgctgaggtcttggcagggcgatgaaaatgggaaaccgtttagaaagtggaataaaaataaaaagaatagggttaatttagttggagaaggagtggagatgaggccacacaagtctttaatacaccaagaaaaactgaggcagcatgcacgctactggtactacttctgctcttaagaacgtctcctgtccccaacctgcccctgacacccccagagctctcctcctgctcaaccagcctaggagccttccagctaacaagatctcttccagctctaaaaggttgttttgcaatgtcttaaacctgaaacttcaggctgtggagcatgtaaacaagagtgactgtgggatatcctgctcaggtgattttaaagaaaatagggacatagtttggaggatggtttaagcaagaccttttaaacccttttaactcttcagctcaccctgcattaaatcaaatgtgaagataaatgctcattaaacattaaatatatatttatttttctatgaaaacagttgaaagcatttttataattttgcttttgaaattatttggttacaagtaattcatttaattcatgacaagctacaatttcttgacttttattgtgtattcttgggaacatttgtgacgtgataaaactctaagatttacatgtgaaacaacaaggctgacatatagcacaattataacattgtcttagattcgctttctagtacatatattgattctcaaccattatccactaagaggtgttgagctgggtgtggtggctcttgcctgtaatcccagcactttgggaggctgaggtgggtagattgctggagcctaggaatttgaggtcagcctgggcaacatggtgaaaccccatctctacaaaaaatacagaaattacctgtgtgtggtggcatgttcatgtggtctcagctacttaggaggctgaggtgggaggatcacttaagcctgagaggcagaagttgcagtgagctgagatcacgccactgcaccccaggctgggcaacagagagagactccctctcaaaaacaaacaaacaaaaagaggcactgaaaggaaactgtcatttatagtagttagaatactaaaacttggaaatagcttacttctattaaaacaggtagagtcaaacttatacctatattaaaatcatttttactcatttgctttccaaaagatttcatgacgcaggggagaaagttgggagcagagggaggatgggttcatacaagcccatgagaaacatacattttggtgccgtctataatgtgggtgggggcggaaagagaaactcagaatgactgctctgatcattttgtgtgaaatgtcttacttcttttctaaaccatacatttcttgaggacagatgcagtaagttcatcgcacaatccagcagtgagcacaagggtctcattgaattgattggtgcacgtgatactccagatggagccacattgcaaatggcaccactgtccccatttcctccaggaaaagcagtggtggggtggggcggtcacaggaccatacctgtcactgcattcagttctgtgagggtggccagggactcctgtctgccccatttcaaaggggacacactgaggcccagggcaggcagcgatggaacccaaggttgggtgctgagtaggactctaggcctctgaccaagttgatctggggccttctgcagcaggacctgcctgtatcttttactgtgtgtgatccctgcctaagaacctgcccactccctcttctgcctctcaaccaagacttctggggacctttctttttaccctctggacaactcttagaaggaggctcaacctctgaactgtctcagcatgaatgagaggtcttctaggtcctgtgaaaagttctctggcctgaggatgaccatgaacccacagtaggttcagcccccaacaccacccgactggagacaacgccatccctgggtgctctggaatgaagggatcaagctggcatctcctttctcagtgacctttctgaacctaaagctaccaggcccataaattcccccctggtgctcacaagactctgatgatcaagaaagaaggcgggtcttccctcaccaacagccaagaggctgcttgagagtcaaggcagcttcttcagggctttgcctgggtttgttctgaatctgccctggcctctgtgggggtggggtggagtgaacgtctttcctctctgggtgtcttccaaacacacttctgcactaagagttgccactcccttcctttctcccctcagcctctccagaagcaaagcccatgctggctggggccaagggctgacttctaagagtggagaatcgtgactccacagcaggggagacctagctgctatgaaagcaacaacttctagggaggctgggacctcgggcctccagcaccatggaggaccatggagtgaccttaaggaatccttctggacaaatatccaaagggctgtgtgcctattcacctgggagagaggccttgggctgcccgtaccctgggaagggaagatgaggtgagggtagtttatccggcccaggctaccacagcctgttaggacagagcccaggtctattcaaggatgggtgaaaaactaaaatgtggggagggggaaggtctgggtaagcccttgtttggctcatggttttggccctctctgaggtgcctaatctgatccagtaaccacacaaactgggctgcaaaggaactaaccaatattctttctttctttctttctttttttttttttgagactgagtttcgctgttgttgctcaggctggagtgcaatggcatgatctcggctcacagcaacctccgcctcctgggttcaagcaattctcctgcctcagcctcccgagtagctggagttataggcatgcgccaccatgcccggctaattttgtatttttagtagagatggggtttctccatgttgttcaggctggtctcaaactcccgacctcgggtgatccacctgcctcagcctcccaaaatgttaggattacaggcgtgaaccaccgcacccagtgagctaaccaatatgctaatgacttcagttgatcaaccacagtgtccagtgaagaaaatcagggctcttctcagggtggtggtatctagaccctaaaaatagcctccctccccctccctaccctgctttcccaccaaccttgaagattctgatattttgttaaaaattcatgctagtttttcccacaagggagctggaatttattatcatctcctatgttcctaacactggttataaatgtttatttcatttaatcctcagaactggctcagaaaataggccacactctccccatctcatagaggagtcagaggctcagagagattaacttacttgcctgaggtcacacagctagttggtagaggagctcttccataagatagcaaggccacatcacctgcagggcagtgcctgctctgggaggtggcacaatgtgcccagtgatgacgatgacaataactatgaaaggattttatatttgcacagcattttgcagcagtgcccctcagctttgaacccagggcatgcactgagtccaagaaggggttcccctccccactccctccccagcacacatcaccttagccacttccggaggaacaggagaaatggcttgcccacttggctggctgcagtggtagcaggaggcttcctgaacagaggctgcccagactgcccacagcaagtgtcccactgctctgccaccgctggtgccgtgtgggagtcaaggctggggagcctgaatggtgggccaggccgggggccgtggggttcagaggcagagtggagaatacaaaatcgcaggtgagatcacagctctctcaagcctcattcctcgtgccccacacaggcagagtcttgagtcctccctttgttcctttcttgtttctctgggggtaatttggccttttagagaccacttcctttacccccaatcagcagacaccaccagctccctgcccatcttccttccctctgtttcctcctcttccctataggctgactgtgttgtgggggctccttaaagctccatctcagtcacaaggacagcaggggcttctccagctccctgaagtcccctctgtacacccttcccctttgggagcccagaggccaaggtcaagtttctggaggaggaggaggcactgtctggattgctctggcaggagcattttaagagccctgttcagccaggcgcggtggctcacgcctgtgatcccagcactttgggaggccaaggcgggcggatcacctgaggtcaggagttcgagaccagcctggccaacatgatgaaaccccgtctctactaaaaatacaaaaattagccaggcgtcatggcacgtgcctgtagtcccagctactcaggaggctgaggtaggagaatcacttgaacccgggaggcagaggttgcagtgagccgagatcgcgccaccgcagtccagcccggcgacagagcgagactctgtctcaaaaacaaaacaaaacaaaaaagagaagggcttttagaggttcacttgtctctcacaacctcagaagaaaaaccaggcgggatgactctccagctgaggagactgaggctgagggactgcctggtccttggctgtccagggaggggctcattccctgctgctctgctgccagactgttcagaggtgaaagcctcacattggcagaacccaggtatttggtatctagggaacccaggaaataacaatcaggccaaacactggccctgtcctgaatcctttagtccccatccttcagcacccccttgtgagggacaaccaggcacatcacaccctcatggatgcagatggcatggactccttcacttggttacaacccacactcacctggggtcttttctgccttctgtggacctattggaagatctaaggggggcatttgaaaatgaaaagggagcttgcagggagagcagccaactcagcccatccaagagcagacagacccctgcacgccctgctcacagctctgtccctgtgccgctgtggcctggcgctgcgtctggggagctcagtaaatatttgttgagtgaatgaatgaatgggatggcctgaccgcttgacattgcagaaggagaaggacaaagtggagaggctgaggtttgtttttgggtggggaagctcccatcttggattgtagtgggggtggaagcagaagcaaaaacctagtctagggtgtggattgagggagacccaggaaaacgacccactcacacacctgcctttcctgaaacactgagagctgcctgagattagggagctgccttactcctccttttgtcagcatgctggctggcgtgctaggctcccgtggggagggtatcccggcatggcttactaggtggttaacgccagggcagttgggaggtaaattaaggggcacaagctcaggaatccctcctttcagtcctgtcaccagccccaaatccaacccaccaagaatggtgggtataattcatcttaactatttcccaccaaaacaatatgacttttactctctgcctccttctggctgagctctgagaccaagagggctgtggatgttgggggtggggaaagaaactatggagctgccaagaaggttgaacaaccaggtaattaactgaaagaaaacgactggaggctggggaggggagggttaagagtcattgtgggccgccttccagaagcctccttccacggcccccactgccatccacacaccactctgacccctgcaaggacacaccaccatgctccgaggggcaggtggcctcagctctgctgctctcaagacagcaagagaacaggcattgtcaggccaaagaaattagcaacatggaaaagtgagtggaaagaaaacatgttttcatcacaagatcaagaaactggtttggttcttgcaccagccccctcggttgtcaaatgagaagtcaaattcagaagggacacaggacctgcccgaatcaccacagccagagagaggcaactctggggaaagtgccctggcctcggagggagaggaagtgctgcgggacatgagcaggtcacttaacctctcagagcactggagcaaaatcgagggactggacaatttcggagtgttgttgtgaagatcagctgagactgtttatgtgaaaatactttgtaaactgaaaaaaataaaaccaaagagtgtcagcagcagaactagcactaaagcccagatgacctcaggcccagccgccggtccagggcccgcctcgagtttgcggatagcatgatttggcaggcatgccactgacggcaagcagatctgtttcccacgcttcagaggccagtttctgctaccacatcctttcactctggcttatggggcttgctgcctgctgaggggtcagcagagaaaccccctgcaacccccaggaaagagctctggccacttatgcgggccactgcaagctgctctgatacctctgtgtgagttagaaatggcagctctgggtgggcatggtggctcgtgcctatgtaatcccagcactttggaagaccgaggtgggtggatcacctgaggtcaggagttcaagaccagtctggccaagatggtgcaaccccgtctctactaaaaacacaaaaattagccaggcgtggtggagggtgcctgtaatcccagctacttgggaggctgaggcaggagaatcacttgaaccccagagatggaggttgcagtgagtcgagatcatgccactgcactccagcctgggtgacagagcaagactccatttcaaaaaaaaaaaaaggaagaaaacggccgggtgtgatggttcacatctataattccagcactttgggaggccgaggtgtgtggatcacggggtcaggagttcaagaccagcctggccaagatggtgcaaccccatctctactaaaaatacaaaaattagccaggcatggtggtgggcgcctgtaatcccagctacttgggaggttcaggcagagaatcgcttgaattcgggaggtggaggttgcagtgagccgagatcgtgccactgcactccagcctgagagatagagtgagattccatctaaaacaaacaaaagaaaaaacgaagaaagaaaaggcagctccatggcaggcaggttcaggccagctgatgccccttcctccaggtgggcatccctggacccacactgccagggagcaggtacaggcaagtcccaggacccactggcagcctcagcctggcacctccatccaatgcttaaaccgcataaccttactggaggcactgaccaaagtaggctccgatctcagtctatgaggcaggcacaacccaccattccaacaacactaattgagtgccatttcatgacacaacagcattatcaaaaagaatgagtaccaggctagcagtgagaagtgtgggtcctactcccaccacactaccttgtttttttcgagacagggtctcactgtgttgtccaggctggagtgcagtggcacacgatcactgtgcactgtggcctcaaattcctgggctcaatcaatccttctgcctcagcctcctgagtagctgggattacaagtatctaccaccacatctgactaatttatttttagaattttttttgtagagatgggggtctcactatgttgcccaggtcagtattgaactcatggcctcaagcagtcttccccactcggcccccaaagggctgggattgcaagcatgagccactgtgtgccagccccacaatactactttctagctgtgttcccctgaggaactcattcaaactcagtttctccagctatcacatggaaataacaattgttaccccaaaaggtttgttaaaggcacaaatgagatgataatatgagcactctattgtaaagtggaaatcaggatacagctataagagatgatgatcatacattctaagaaaattttgaagataattttactgctaagatgtgttaaagaaaaataattcaatgatacctgttaaagcacagtaaggcagacttcattcaaaactgtcatgataggtagaaggatgattgcaatggggtcttgcagtgggacagaaagattgggctcaactccaagtacagcaagtgggcatttatgccaaggagcagagtagggggtcaatggatagaaaattcccaaaaagagtgagagggattctggctaaaccaacctaacaggactctagctgaacacaggccagggggatcagacctcacctgggggatggagtgggatgaggaccctgatcagacactgaggggaaccggatattgaaggttgatggttgtgctcaactaactgggcagagttctttgctaaacctggattttgcaagaaagtacacagatgggcctaggagaaagtttggaagcctgattaagtttttgtcaagcagggaatctttagcagttgacataatgacaatattgagagatttttgaaaaatattctctctgatggagcccaacaagtatttccctttctgcatgtgcgtgcgtgtttttatgtcacgtacgtgagtatgttcttgtagctcagacagctccgaataaaaacccagggaagcgagggtgtgctgagcccagggagggcctgccaggagggttttctgaaggatggctgtgggccgggcctcttctgagagggctgagggcagctgcttcccttgccgtttgattcattagtccacacctcgtggagaggtaacttgaaaggcagcgccgagaagcacgtaatggatttgtgaggttttaacaccggacagcagacaaaagactaataaaaatccggggcaggaatttcccaagagggaagtgtcacagtggaataaaaatgaaagagataaaggagagttcctagaaggatccaaccccccttccccaccccaaactctgcttataggttcttatatgataatttaaactatatatgatattaaattagcactccaatagcaaaaataaaagtgttcccacatcaccttctttgaaaatatttatttaaataggatgaaatgttattgagggcttttgtgtctagaaacagggttaattaaagatttcctgcctgctttgtgggtaggtgacactctcattgagatagcagcaatgccctatttagtggtctctcagctttctttctattcatctggtttggtagtggaattccatgggaagtttgaccctattcagtgatgagagaagcaaaatactgttgttcacctagaggctgtttgctcagaaaaacagggtgtcagagacatgggacgcaaacccagagtgacatagcgcagggacttggctcacttttctgagatctgtaaaatgtgatgtgactggctctcagaaaggaggctgaagggttcctgcccgattggttttcaaagggcaagagccccgctgctgaggagctgcggctttgttagacaaaagcccagggcagccccctcctgggctcagcgttttccccacctccccctttctcacaggcggtttccctgaaatgaaagaactgtgatgcatttgcgccttcaaaagcagtttttaaaatgcattaaacccaagattgaataccacccagttcggcctctgacctgtgcccgcgccgaggtttctgggcagccaggcccagggaggaagctggccttttggccccaggaggcagagccagtttagctgcctgtgcccccccaccaccccacccctttttttgaccttctggcccaaatagggaactgtggagcgctcatctttgtgtccttgctagtacacagcctccctgtgaaagcaagcaatgtccccaagcaaatccatatatccgggacctacggcggcggaaagatcgggtgcatttggaaggcacggggcctggcctcacatttccaaaagcagtattccagactctgcctgcaaagcttctccaccttccccgtcatctgacctcatctttcttaatttttcttctctcattctttctatcttcccctctctatctctttcttcctttagaaattatatttgaggccgggcgcggtggctcacgcctgtaagcccagcactttgggaggccgagttgggtggatcacgaggtcaggagtttgagaccatcctggccaacatggtgaaaccccatctctactaaaaatacaaaaattagctgggcttggtggcgcacgcctgtagtcccagctactccggaggctgaggcaggagaatcccttgaacctgcgaggcggaggttgcagcgagccgagatcgcgccactgcactccagcctgggcaacaagagcgagtctccgtctcaaaaaagaaaaaaaaattatttttgaaggtcgggtacagtgactcacgcctgtaatcccagccctttgggaggctgagacgggcagatcacttgaggtcaggaattcgagaccagccttcgtctctactaaaaatacaaaaattagcctggtggggtggtgggtgcctataattccagctactcaggacgctgaagcaggagaatcgtttgaacatgggcaggagaactgtttgaacatgggaggccgagattgcagtgagctgagatcacaccactacattccagtctgggttgacagagcaagactctgtctcaaaataataataaataataataataataataaataaaaagaaattatctttgaaagaactcatataagcaggctaaaattaatttgttaatttgtcacatttaaaatagtctattttattctatatttacaatttttgaaatcctagttttggcacgtcttgcctcttaaaaaatttatatcaccctttactcgttggaatggctacttgtttaaaaaacagaaaatcacaagtgttggtgaggatgtggagaaggaatgccgtgcactgtgggcggaaaggtaaaatggtacagctgttgtggaaaacggtttggtggttcctcagaaagttaaaaatagaactactggccgggcgcagtggctcatgcctgtaatcccagcactttgggaggccaaggcgagtggatcacctgaggtcgggagttcgagaccagcctgaccaacatggagaaaccctgtctctactaaaaatacaaaattagccggacatggtggcccatgcctgtaatcccagctactcgggaggctgaggcaagagaattgcttgaagccaggaagggaggttgcagtgagccaagatcatgccattgcactccagcctgggcaacaagagcgaaactccatctcaaaaaaaaaaaaaatagaactatcatatggtctagcaattctacttctggttctatacccaaaagaattgaaagcagggtctttaagagatatttgtgcacccatgtttatagcagcactgttcacaatcactaaaaggtggacgcaaccaagcactcattgacagatggatggatgagcaaaatgcggcagatgcatacagtggaatattatttggccttgaaaaggaaggaaattcagacacatgctaccacatggatgaaagttgagggcattaggctaagtgaaataagccagacacagaaagacaaatatggtatgatttcacttatatgagttacttaaagtagttaaaatcatagagacaaaaagtagaatagtggttgtcaggggctgggaggaggcgggaatggggagttatggtttcatgggtacagagtttcagtttcgcaaaatgaaaagaattctagagacggatggtggtgatggttgcgcaacaatatgaatgtacttgacatcactcaactgtgcgcttaaacatggctaagagggtaaattttatgttatgtgtattttaccaggcaaaaaaacaaacaaacaaaaaacctggaggaaaaattagcagcctgtgctatgaaaattgcctcaggtgtaagacagtcttgtcagtattggagcgtgctcacagttgacatgtgtgaaggaccaggagagccggaagaggtcagcaggctcagggggtgctgttagcctgtttcaccgacagaaaggcttaacccctgcggcgccaactagaccaggagaccttgcctctctattattctcccactggctgttgcttatttttgttagtccaatattttccactgctctcagagacaaaggtaggcaacagtttgcaaaatttagacgcttatgtgtgcacaaaggaaaaaaagaagaaagaaagaaaacaacagtctggtgagcttctgtgaagcttcttaactagcagggaggggaattttcctttctggtcacgtaggctgctgtcttcggcttcgattcgtaagccacctcccaagcccccattagccccaggtaggggacatcccatccccctaaacctccttcttgaactgacagttcacccctagaaggaggtgggaaaccactcagatccatctcaaagggatgcctaccagggtaggtgtgtgggaggaaggctgagcccatgctgtgttcaggggcccccccagaaggtgtcagcctggaggaacatgccccacagttataaaaggcatcattccaggagctatcatggcgtctgctaggggcagagaggaaggggaggcaggaaaggggctgagtattttggggctgtatgcttattgttctacttttctgttgaagttattgcagttgctgccctcaaatttttcctgcctttctccacccccaattttgccctattttccctaatttttctcctttttttttttttttttttttttgagatggagtgtcactctgtcgcccaggctggagtgcagtggtgcgatctcggctcactgcaactgccacctcctgggttcaagctattctcctgcctcagcctcctgagtagttgggattacaggtgtccaccactatgcccagctaagttttgcatttttagtagagacagggcttcaccatattacccaggctggtctcgaactcctgacttcaggcaatccgccagcctcggcctcccaaagtgctaggattacaggtgtgagccaccgcacctggccagtttttctccttttgtcccatcttcctttttccttctccatctgttcctttctgcttctcagaataagcatctctatccttagcttcaaatcataaacaacttagaaacagttacttagctgagtactgtctctgtgccaggccctgtgctgagggctgacattcattgtatctttgggtcctcacaacagccatatgagataggtgctattgtgcccattttatagttggggatactgaggcttaggaaagataaagtaacttgtccaagatcacacagctggaatgtggcagagctaggatttgaaccttgacagtctggctagaagggaccttactgatcatctctgtccaaatcctccataatgtacagaagaaaacaggaccagaggcatcaagtgacgtgtccgaggccccacagctagttaggggcagtgctgagaacaagaagctggcctcctaattctgagattcttcttgtttaagaagcattttccataggtgggcatctgctaggcttctttatctagaattattaattccaggaagcatgtgccctggtcaggcacagaatcagcaaaaaccccactggagacccaaaataccctatatgctctcaccattgcagaatctgttgtgtctgcaggtgcagcctccgggacccaggactttcttctcagggctctgctgagttgggtgggggaggctggaggctgcaaaatgatgacagagcttggggctatgatctggactgggtacccagagctaataggagaagaggacaagcagggggacagaactgagtcaggagacactttagacgatggagggttgggggatggaggtggctagtgaataaaacacttctgaagggtctttgctgcctgtgttgatggccatgatcaattcggatccccagggccagttcagcaaaacctctgtcaacaaatagaggatttgtttaatcttttctgaaagagtccgatgttatctaagtgaggactggccaggtaattggaacgttctagagactgttgggttgacttggatttggggtcaataaacatagcggctccactacactagtgtgaggaggacctcgggagaaatcgcatagctccctgggctgcagttttcccatctgtgatatggggataatgtcctcaccctgtcgacctcatggggctgctgtgagggtcagatgagaaaatgggtggggaggtaataattagtgaacagcaccattcaaagctacagtggtcttattgctgtgttttcctaattgtattttgcactgtggctttacacagcccatgtctctggattgttaaaaggatcaaaaaagatcatgagtagtgcattcctcggcattttgtatctcctataattcctggatacagataaatgtttattaaagaatgtgaaggtctcatcaaaaaccaagcatgagaggcaagacaattattacctcagatcacatacgccttggatttcagagctggaaagagggttagagacctattccaggactttactctacagcaaagcagtccgggttccagagagcccaggtgacttgccttggctgggctggactctgttctctccccacctggaccttgtgtccgaggagcagtgttggaccctcaattcagacaaagtgggaaggcagatcccaaggaggggagggctggtggcccaggtggctgcctggaagataccatcacttctcatgctgtcttaggtgaactttcaaagtccagcgtaagaaaaagtttccagcaacagcattgtggttagtattgcaggctttggagtgagacagtcctgggtttaaatcttggctgtctacctagtatctatgtggtctacgatatgttacataacctctctaagcctcagtttcttcaactgtaaaatgaggatatcctgaggttgttaccttacagtttgctgagaggaataaatgcaataatggacgggtgtgctcaccccagagcttgggactgggtaaatactcataaatgacagaggtgggagtagttgttacagtaacctaccagagggaagaagagtgtgctcccgtttaatccttatcacctacgcagtgcttggcatataggagcgcaacagatgtttcttgaacaaacatcactaagtaatgcctacttctgcccttattccccctcagcatgttccttgcccagctgctagaatgatcctgccaaaacatataatcatgtatcttttctgctccaagtccttgacctccatctcacttagagcaaaatgtccttcaagcttgtttgcaactgtcactctctccccaaacccccagaactcaatacgtctgacctcacctcctactggccttcccctcactcataccacctctttgcagttccaggaacatgccagtctgcactgccacctccgtcttctccaggttcccacttggcttgctcgctcacttccttctgggtttgactagaatgccaccatcttagcaaggacatccctgcataccctacccaaaactgtatccccacaccaccagcctgacacttcctatgcaccttctctgtgttatttttcttctcagcatgtatcacaactatctacatatttttcagtttacctcgtttattgcctgtctccgtctttaattgttagttctatatgggatctgggattttgttgctgctgtggttcagtttgttcatgattgtttcaaaagcacctagactgttcctgctacatagtaaataataaatattggttgaataaataaatgaatgaatagcattagtagtggtgtttgtgtgtttgttcattttgtatggcaagaattgtgaaataaagcagaaggaaggaaggtaggtaggtaggcaggtagtgagttgctcatcacagtagtgttcccagaagtctggatttccattcatcaaagaagctatcgagtgtgagttctgttggaagagaggttggactagatgattttgtaggtatcaccaaatgtctgactgctgcaacagcttgagtctgctggggtcacacaagaatcactagagccctgcaacccccctgctctttgggtcagtacttgaacctgcctgagaggggatctgcttaaaagcagcagcttgtctccggatcctgaagcaaggaggttttgcatctctctggccttgaagatctccatcccgtggagagtctgactctacagagcgggcagagagtaggaagaaggaacctagacgatctctggctgggccaagagagaaattagcaaggccagctgacaaactgggcctcctgcatggggctgagaagtgggtaagggttgggagggagaagggacataaccagggataaggcaagacaagaagtctaatcagggactgagtcggttagaagtttaaggattgttcctaaatggttatcagctccatctgttggacagcaggctggtggcaggggtgtgggtgacgtgtaccacatcacccaggagatctccatcagaaggagatagccctggaacttaggaatctttacggggaggcgggtgatgaaaaaagcaggccccggagagcggggacactgacagtgaggggagacctagcaaccctactgccaggagtgcattccaaagaaatagccacaaatgtgagcacagatgtatgcacaggaatgtccacagtgacactattcataatgcgtccaaacatgaagccatctaaatgtctgacaaaagacagtggtaaaataaattacggcattttacaggcactaaagttgatgtagagacatagttcatgacagggagagatgaccatgatttattgctaagtaaaaagaacagttacgaaataaaatgcacatatccaagcctagaaggacagtcaccaacatactaatcagtcttgggggtaacattttttaaaatgatttttattttctctttgttcttttctaccttttccaagttttccccaataagtatgctttgaccttgtaagatatgataaatatcatcttttaaagtgtggtgttttaggttctcaaagcagaaaataaagtccatttcattttaaataggatacagtgaaatcgctgactacaggtcctctttcgcttagttctcgttttctttagtattctagggcaggggaggctttcttagtggcaaattactactttcagggggagcattaaataaataagaaagtaaaggttgtaaatgttgttggtatttgatttggaaacagtatgagttaaaataagatataggatgaggatgcatcctggcacaacagaaaaagcactgggctgagagtcagtcctgggttacagagctagaaccgcaaactctccaaggaacaaactcagtactccctcttcaaggggaacctaaccctatccataacctgaattccacctacaatatctttctggctcagccaccagctttgtgattctgccatctcctttctgagggccagtgaaacaaaggagtcaaggcaaaggggatctccaaggttctttacccagcacagattccatgatgcccaagggagaagaaaaaagatgccaaaaaagcctcctttacggcttgacctcggactgtcctggccgcatagtttactgagggtctagacttttctccctggttcctgctacagatcttgctgtagatgggtgatggtgccatagcttgatcttggggaccctgggatgtggcatcttctgccagtcctgttctgttgtgtctcccccagtcctggccaaaggcagtggcttctgttgctgctcccgtcaagaagtgccttcctatcctgcccatctgctcacatttctatcactgcagctcacagacttcggttgtctttcacaccccaggtaagatcaactgctaaaaccaacaatgccttgacatccttctacatgaatccacatcttcctaacatctattttggaatgctcaggtccctcaggagtcagaagagcagggacactgggtgaggccaggtgaagagggcctcaagggagctgaagatgagcacaggcttcagggactgtcaaaagagtcttgcgatcagccacagacagacatggccactggcaccctcctccatggagatgcctcagacactctatttggcctttctacctttccattcagtcattcatttttgtaaaatgtacagtaatcgaaaacatttattacagtgctgctatgggcctagctccatctgggcccattacacacattttctttaattatcccaatgaccctgcaaggtaggtaatcttcattttataaagaagaggacagtttcagagaggtcaagaaacctgcccaagatcacgttgctgggtagtgataaagccaaaactttaatttaggtctgattgcctcatgaatctatgctctttgcactttctgctgaaactgacctccctcaaccttaccatctagacagaaatgcagatggcggacacaagaggcacttgcaaaccagggacacccagagtcaagtggttgctttctatggtttacggctgtcctccttgggaagaaccatcccaaaagccatgcgcacacggggctcctgaggacatcatttcagcttgtgtcaggaaagtgcttagcagtggatcaattgccagtcttctggtcaacctaatgagcaaaataaagtcagcctgaattgtccatcatggcctaatcatcacggagtgattgatcaacacaaatgatgactccaatccactggttctcaaccaggggcagattttgcccccaggaaacatttggcaacgtctaaagatattttgagttgtcacaacttggggagtgctactgtcatctagtgggtagaggtcagggatgctgctcaacattctacaatgcacagaacagcctccctggtgcccacagccacagagaattatctggccccaggtgttttagtgcagaggtcgagaaaccctgctccaagcattcgatcaagagggacttgacccagctggagactaaccaaataccagaaagagcagctgttttatttctgggaaattgttgctagggttaaactgtatagatttagccacgactgaaggtgtccacatcctgttaagctagatggtgggcattgtgtatttttttccagctgcccttattcaagagtggcccctggaatttacttagcctttctttgggttaaaatcaggaatggaaaatttaacctctaagaggaaaacaaacagaaaatgaaaagtaggcgtaataatggaagcttaggtgcaaattttagtgcagggtattccttcctgtaaggttactcaccccactcctccaggccacagatatgcatgcacagcctgcccacatgtaactgtgcagagggagagcttagatttgaatccagaagaatggaattcaaaccccaactctactgataaccaatcttgagcaaatcacttgccttcttgaagtttcagttcctctgtcagtaacagaggccatacccacacatccccgagggctgtggattttgcatacagtaatttacataaaagcactggcaaaactacaaagtgtgccataactgctcacctgacgacaatcacacacacagagggcttctcctccctggggcacgtgggttctctttattagatttttccacattatcactgcctatgtaaagcttctcctgggtgatattctatttcttatgctgcactggagaaatattctctatatcttgaaatggaaacgctgaacccaacttattttactcatgacctaaatgagattattgcttccaagaggacaatatatcgcactaaaatgagaatgctcaggatgattaggtggagagcatttatgatgcagctttccattctccatgtgatgaaaacttgacatgacccaatgctttattgtcctacagtaattcctgtcacttttatccagactcatattgctctttaattctagcctattttcatctttccttaacaggacatcagatcttggctttcacaatcaacacagtttcaaaggttatttataaaatagtttaaaataaaatatgccatgctttgattacaaccagcgcttctggtatgaattagagaggtggcctgtacacatatgtgttgtttattagcttttatctgatgatctcaaagcactgacatcaattctaacacacatggtttcttataattaccacccccctacacacacacccatttatgcagggcagaattattttgaggacaaatgagctacgtattgtgatgtgctgtgagtttctgagaatagaaactcctatgactaaactctccatgaacagagcaaatcagagaataacagcaaatgcttttatcgctcaggcagctcaatcacatttggttttccatttcactctagtaagagggttatcggccttgaggataccccccaagaaatgtttgtgatttttgttttaagctcagcccctgtaccatctgctcactgaggccaacttcccatcccagctgtgtggctgcctaagtcagcctggtgctatgggatgggaacaggcagaggtggggagaggcttacagactcattttcaaacagagatggaaaactgggagtcagaagaggtggaggtatatatggacccagccatccgacttctgatcctattgttcttttttttttttttttttttgaccgagttttgcacttgttgcccaggctggagtgcaatggcgcgatctcggctcaccacaacctccgcctcccgggttcaagccattctcctgcctcagcctcccgagtagctgggattacaggcatgccaccacacctggctaattttgtatttttttttttcagtagagacggggtttctccatgttggccaggctgatctcaaactcccgacctcgggtgatccacccgcctcggcctcccaaagtgttgggattacaggcgtaagccactgcgcccggcctcctattgttcttaaccaggggtcatacataccccaccttcctgcaatgacaaaagaaagtcaaggtcatccctgtacatctgtctggcctatacatctgttttgtaaacaagcaggtctcactagaattaacttttttcttaactaaaacacactcacacagttttcccttgcaattcagggctgaacccttctccagttcctcaaatgcttattggctacagaaagctgcagaaagaaatggtcaattcctagtgtctctttcaaggagaacgtatttgcagcatttcttaactcagaacagaactggagccacccaccccacaggtggagccctggcagctgtgacctggaaacacaactgtgtttgttcttccctcaccagccaaggagaccagaaggcaggaggggccagccacagctgccacctttgcctctcctcttctcagggtccgtatgccacttcagaccactgtatgtggagccgagatgtcagagctggagcagagaagaggagcacgcaggtagaactgtctaaaatccaaaacaagctctgcccgcttgaattgccactcagattcatttcaagactacaaaatgtgcaggcaatgtttttctgaagggcaaccccggtgctcccgagatgggaggcaccctcccttctgacacgcatttattccatcttccggagataaggaggggacagggctggctcagcaaccccacaatctccgtctgggccagtcatctcagcaggtgcttgacaggcaaccaggctggaagagaatgcctctgcagtatgctggaagtgtccttcccctaatgccacctaatggcaaagccctgtgcatttattgcatgtgaacgtgtcctcaacacccattgagccacggtgtggtgcacggccatcagcgttcaaaacgaataaattgagccaccctagaaacaactcccccagatagtcttggaagaagctgggaggcatattcttagatttaagcaagaaattacaatgttgactcaaatcaggatttttgcaagggacttgttacactgtgctagggaaggttcacaatctgtctgtacctctgaggtaccatctttaaaagggtgtcttacattgagttctgctagaagctgaccctgaaacaaagattagagtttagatagtttattttgagagatgattccagaaaccgttggtaggtgttatgggttgaactgtgtcccctcaaaagatattgaagtcctaacaccctctgaatgtcaccttatttggaaatagggtgctttcagattatcaagttaagatgaggtcattagggtgggctctaatccaatatgactggtgtccttataaaaagggaaaaattggacacagagacagccatgcacacacagggagaatgcagcatgaaaatgaaggcagagattgggatgatgcatctacaagccaaggaacaccaaagattgccagcaaccaccagaagctggggagaggcttgggacagattctcctgcacagccctcagaaggaaccaaccctgcagacaccttgactttggacttttagccttccgaactgtgagccaataaggttttgctccttaaaccactcagtttgtggcactttgttaaggcagccctaggaaatgaatacagtaagaacatgggaagtgaggcaggtgaaggaaggaatcattatgaggttagctactgtggttaacaactggaacttcatcctgctggcaagtcccaggaaactgtggaacagctacctcagccttacacaggaggggtggcagcttgcgtctgctcctgccggtattcaaaatgaaccgactttaggaggtccccctggggcatttgtcatcaggctgaggccatgccctgaattgcaaagtttcctcctcctcctttttgcattaaatcctacccattcatatcctacctcccaggatgctttcctttaatcctctagcccagctttctcataacttcctcttagagccctcactctgtattctgcaggtcacttaataggtgttccctgaaaaaccagatgccaagaggggtgaaattaatttccattgcattgcataactctatcttcctcccttccccctgggaacgtgtaatgcacatttgcagacagaagttttggaaaagtcctgcacttaaacaacaacaaacaaaacccttcttcagtgcacttaaactactgtttccaaaatgtacattccttcttttttgtagtatagtattaacatcttgctgaacatagattggggaagagtgcctttgttataaacgtcactgaacacattgtttaggagccaggtccttgggacaaggaagggtgacacatctgagcaggtggcaacagggtctgcctgggaccaggaaccatggggccaggtgaggacttggcctggaggaggggtaggctaccggttagggtgccaaaggccatgcccccctacccccgcctcttcatctagcctgagggtgggaagtgagtttcagggatggggtagggattagagtcacggctggtgtttcctggttttctggggcagaaaatcctattcctaccaccagatcttccctttgctaattcccttctccatgtggcagacaaacctcaactcctccctccaagtccgtgacaagcaaatatgagggagacccttacctctgggctcccggggtgctgtgtataggcaatgcggttcatggcggggggagcgagggcaggctgcctggggccaaaggctggctgtgctcctgctagccatggacccccagggctgaattccccacctatcaagtggggacatcaataaaagtgccacaggattagttgacctaatgcatgcaaacagcacataaaacaagccccggcatcacaagtgttcacagttaccacccctctatcactttaccagccaggcatatccctctcctctagaaatgtgagtactttgagagcagcaactgtaatgcagccgctgacatacaatcgcttgctcagaaaatacactgaaagtgaattaatgcgcagctatgttctgcattttatttctatctctgataatatttctgacgatgaaatgtatgattaaaacaggcactcttcactaacaggaaaattacttgtttttctctcattggttttagtcttctctccccagctggcatagcctaacaggacacaccatcactagtaaaggctagtttgcctgccaaggcctaagatcagtgggtcactgtccttatggttaccatggtcctggacagtcccagcagagaagcagagatgccattgatttattggcacaaagaggcatttatctgcctctccttgtcattaacgggacgctagggcagtggggcagtgggaatctcagttagaatgggcttcattaaaaagcccttaaaaggaaacccttctaaaacctagcgatcaatcttgcctaccttttgggatctcatccgttggtgaacaactgacaggaaaatctgggcacgtctctatttttgaaaagttaatatatctgtcgattctacaaaaatccaataaatgaaaattcatactcatgaaaacaagtagattagaagaagagtcctcacaataccaaataactcacgacagcttttctttaaatattctacctatatttacatattattataatattctcttgcacaaaaccttccaagggcttcctctggtgagtgaagattcccttgtacatagctgacattttcttttctttttctttttttagagacagggtcttgctctgtctcccagcctagactgcagtggtacgatcatagctcactgcagcctggaactcctgggctcaagcaatcctcctgcctcagcctcctgagtagctttttttgttgttgttgttgttgagatacggtttacataccataagacattgtctgagcctagatatactaataatacatggtatttttgtcacttcttcactcattaaacttttactgaacatctttatagactaaaagcactctggctaaatttacttgtatgtgtttgcatgtatgtgtgtgtctatagctttcttgctgcctgcctgcctgcctgcttcgtttctgaaaggattcaggtggaaggctaaattcatcttctctggaaggcagcatgagtgcagctcatgtggggcaaggcacaagggctgcccctcgccctccggcagcctgttgcccagcaggtaggcaggtcagggcctatggcacaacagggcaaaaaatctaacaacaatggccacttggcctgcagaagctggagtggagggagaccaaggtaggcttctcagcagcactgacagctatctggtagggggagtggggaggggtttcctcactgtggggatgatccaatgcctttttgtaccccctgaaacagttgaaagccatccccttcatggacaggatgagctaaggtggcccagccacctgcagctcttttgtggctgtcattctagtgtagggtctcatcacacacacctgagacccaagtggctggctccagaagtgccatttacttataacagggcagcttgtcagcccagaggacaggcagctagagcaagaatcaaaagtcctgggtttaagggctgaatttgccatttgcttatgacatggcaatttcttgatctgtattatttttctctagggccatcatttctcccctggtaaaatccagaagtggaacttgaaggtatctataatactttccaggtcaaatattccgagattctgacataccagcccagtcccactctggtcacagaaaatcttcccagagagacgccatctttcttttttcttttcttttcttttcttttccttttcttttcttttcttttcttttccttttcttttcttttcttttttcttttcttttcctttcctttcttttcttttcttttttctttctcctctccctcccctcccctccccttccctttctttttctctcactctgttgtccaggctaaagtgcagtagtattatcacggctcactgcaacctccgcctcccaggctcaagcatttctcccacctcaacctcccaaatagctgagactacaggggggtgtcaccgtgcccagcgaatattttctctctctctcttttttattttttttgtattttagaagagacaggtttttgctatgttgccaaggcttgctgtctactcttcttatcactgaaggtagaactaagtggcagcaaccctaacccctaccccagcctaatcacgatattgccacaggccacttctgactacaaagtagctacactttacatgagagatgcattcctaaagactttgcaaaattctgattaatttatcataggaataaatgtaaaatcttacattatcttgaatactacaaatagtgagaccttatgaatttttagattgcatttttttcaaatttacataattcagaactccattaaatatggcttattgtatgttccctctgattttttttttttttttttttttgagatggagtcttgctctgtcgcccaggctggagtgcaatggtgtgatcttggctcacggcaacccctgcatcccaggttcaagtgattctcctgcctcagcctcctgagtagctgggactacaggagcacaccaccatgcccagctaattttgttgtttgtttgtttttgtttttgtatttttagtagagatgtggttttgccatgttggccaggttgatctcaaactccggaccctgggtgatccacctgccttggcctcccaaagttctgagattacaggtgtaagccaccacgcctggcctgaattttttttttttttaaccttcaaagagaaggaatggtgattggagagagagatgatgacccagggtcaaagttggtagagaaagaccatgggtttgaaggactctacagggaaaacatggagagccaggtgaaccaggcctcttttctgaccccgtagagaggacccagcaactcaatactgtcttcctttgttgatcattccacatagaattttagatggttggccaattagaaggttagatttctattcttttctttcttaactgaaattattccagacttgaatgctgctattaaatgttcaactccaaatttaaaaatctctaaataggcagcgtggtggcttattcctgtaatcccagcactttgggaggccaaggctggtggattatatgagcccaggagtttccaaggccagccagggcaacgtagtgagaacctgtatctacaaaaaaagaaaaaattagtcaggcatgatggtgcacccctatggttccaatggctcaggaggctgaagtggtaggattgcttgagcccaggattttgaggctgcagtgagctgtgatcacacccctgcactccagcctgagtgaagaagggagaccctatcttaaaaaaaaaaaaatccctaaatagcaaattctctctatctcttggcatataggagccattttgtgctcttcaaaatggctgacaggaattttctgaggaagctatggtctgaaaccaaacgaggaattaggtcagcttcaagtctgagactttgtgtttacagccatagctaaaaactaacagatgtgtcttccaaaccgacaaaatcaagaaattgtcatgaagatcaaaaatggcttccaaaatcttaccctccgtgtcctccccaccagcccctttggactgcaagagcttgtggctataactctattcacagcccatttctggtttccaagtagctccctttccaacaagagattacaaagctttgaaaattagaggcaccccaccactcccaccccaaagagctattgcgcgacgagatgctccgttgaaatggaaggagtttgctttatagcagcctccctcatggaattatagatgggaacatttaacaatacagcatttgcaatgggcaggtgagagctggctaagtttttaaaggggatttcacaggccaggtcagcagggagatggatgggtgagcgatggtggatacaattatttgactttctgagctgttcttttgaagcctctatgtttaatagaaagaaaaaggataatcctctttgccaaccttttgtagctcaatctttattgttcccaatgaaacccaaagaaaacggacaagattcattttgtccagaaagcatttgtgtattttatgtaggtctgggctttgaagtgttgatagttaagtgggagaaaagacaaagatttctctcgactctgtggaaatcaaaggaggaatttctgaagctctcttggctgactcaaaagtcctgggtggtatcctccatatatgcttcctttgctactaaactcagcatggaaattagcacaggccccacacaatgatgaaaattagatgagaccataaagaagtgagcctgaagacaaatttagacttttttgcaaaaattgagaacatggtttccgggaccagggacactttcttgtgcttatgggctctcaatcatttaaccttcatcttcaaaacactggcctggccagtgggctggttgagccaaccatctacaggactgttggtttgatttggggcacatgagaggtgcttggtaaatatttactcaattggtaagtcaagtggcctgtcagatggtttaaataatcagatattaaaaatcatggctgggcgcggtggctcatgcctataatcccagcactttgggaggccgaggcaggtggatcacttgaggtcgggagtttgagaccagcctgaccaacatggagaaaccctgtctctactaaaaatacaaaattagccgggtgtgttggcacatgcctgtaatcccagctacacaggaggctgaggcaggagaatcacttgaacccaggatgggggttgtggtgagccgagatcgcgccattgcactccagcctagtcaacaagagcgaagcgaaactctgtctcaaaaaaaaaaaaaaaaaaaaagaaaagaaaagaaatcattatccatctggttatcttgatgggcaaagtaggtcattgggaaccaccttattggattgtttgccaacctattccgagggtgaaaaaaaaagaagattaaatgcgtgtttgcctattttagccaaaatacataggatggacactgtgggaagaactggtgagaatttggggagctgttgacattttccgctgacagataaatgttcctgaaactatctgggtgccgagtctcttctctgggaacgcctcactctagggaactatttctgttgggtttttgaccctgaattctgagaacaacaattttccacctgcttgtgtcactttaacgctggtaacaatgtcaacagtgggtctgggagatccccatacatctgggcttagaattaaggggtgaacagggtttccgcaggtgggggatggagtggcgtctgcattctaagtcgggagaattgagaggaaggaagctacaaaaaaggaaagaccccaggcttacttggaagatgagagacctctgacgggagtcaggccagaccaacctgaaaagtctatgcagctatgaagaagccactcacacctctccatgatccgacagaggttttcttgtctcccttctccacagaatccctggaacatgatctgtgacatctctgactttctgctcacctactcagaacccagactgccagccctgagttgaagtaatgtttgcccttccttctatggagctgtcctgctgccaccaaactcctcctaaacacacacaccatacatacaaaatcactcactgctgcacataaaaacacatccctgcagatgcaggcacacatccatcagcatacaggtgagcatacagtgcaccacacacaccaacacatgcacacctgcacatgcatgtcaggacacacctacaaacacacagcaccacatgcgccagcatatgcccacagggggcacagacacctgcaaccaccagagcctatgggtaaatacatgctggcgtgcacattgccaacacccacactgacctgcaacccctggggcttgggctcaggcttttcacgtgatgggtcacctggctcagctgccttctccctgcagcaggcagctcaggccagtaaacccaggggaacaggttgcaacctctaccccctcccccagcctgtcttttctactctttcccctatcatacttctctcccatcatgcccagcccagatgatgaaagggcaggtctaactgagggctgtcattcacattctgtcttggagccagtacaattttgcatggtggggaattagcaaaatacaagaagacacagtagactctagtatctacagcaaaagaggggggtaggggtttgttaatcttaaatggtgatgttggtttccattctgagccctcctccccacctgccatggcttggcaaaggcaacagcacctacagcccatcacagacatcctgctgcagcacttgaatacttcccctcttcccaaccctcctctcagccagctttgggggtggcccactaagagtctcagatattcacatctccagctgtttaatgcttcatgcatttgttctgagcaccagaaaaccatcttttgctttgctccagtcaacagcacaaggatttgcactacctgcaccgagcctgcaggtgaaccccaggctaaaatatgacgtaaataattgtgaatagattatagacatttgtcattcaaagataactctcccagtcctggaggagttagtgaaaaaacaaatctcaattcagagtctgtgcgtgacggtgtgctgttcttttagagaatctcatacacataaaacctttcacaccatatggagatccactcttaccaagcagattaattacaggcaatttattcagggcaaaacctctcaaatatgatttaatttacattttacttataacctctgcatacagtggggtggtgagcggtgtgcatacctgcacacacaggagtgggttgaactgcaaattgaggcgcatccctctaaggaagttccagaatagatgcattttctgagagtaaaatggaaactatggatttatcagctttggagaaaatgtaagttctccatttagaaccatcataatacgttctagaaaaacatatagttctatattaataacctaatattcatactcagcagaaaatgtatattaaatgagaatattcagcatcaaaataattattttttactgtaaaaattgagaggaaaagagtaagtgcttagtaaggggaatacctttagaagtaggcttcagaatccagtctttgggtatatgatggtgtacggacctgggcgagcggctgcacactgttcaaggtgcagaccctgtacgagggccccgagaaaccatgtttgaggcctggttctactcgtaggcaagtcaccagacctacgagcctcactttcttcatttacgagaagagatagatcctgctgctttttctgctatttgccataggatggttatgaggatccagtaaacaaaggcatggaaactcattttgcaactgtaaagggatggctgcactcagagaacggcggtctggactggcaagggtcctgcttgtctttgttctaatgctttctatttatttttttctccttgagcctgaaaattagttgctgagtagcacaaatcaaaacaggcaagcaaagtggacagtgcaaacgcctaacattttcaccactgcaatttggctgcttcgggcagtaatttgctttctcttcaagtctgttctcaccaaccgaagtccttgcacggcccccaataaatctgcagccgacgcacaagcagaagggatggactttgtccttggatttttcacagcagaggctcccacttagaatgttaaaaatattgtggtaaggtgagagcccagatttaaaaagtatttggagaggcaaggaagaaggaagttcaggctctgaattctgagagccaatacctgtggggtggggtaaggatcgggggctgagtcattaaatgttctttaaaactttgtaatttcaagaccacacacaactcattttgtagctaaaagggatgttcaatcctctcataatttatctcacagatgctaaaactaaagcctagagagaaatttctgcccaagtatacactgcaatgtaatgacagaggaagaaaaaaagcatgtcagtccagtgttcccccattattgcattgggaaaatgatattctattttgcagattgggaaactgaggcacacatgctaatggttctggctttccaagtgccttttgtgtttaggcacttccgaatcagatctccactccacagtcccctgcgtgaagaggcaccattgccgccatctcacagaggaagaacagggctctgaggtcgggaggggaaggcggctcaggacttctggctccagagcctcctctccttccaccatagtgcctgctccagaggagacacaaaggcttggagatggtaacagagagttagagaaacattttctttccttgatgggattgttttcaacagaagtctagagcatcctgcaaaatgctgttttactttaacctattctttcaaatgtcattcctggatttgcccaagaaagtaacaaaagctacatatgtaaagattttcttgtaggattagctaaaataacaaaaatcagaaatagtccaaatgtacaacaataaggaaatagtgaagaaaatacgatgcatggatgctatggaagcttacatagcaattaaaaacaatcacaaaggctaaacatgaaaacaatgcttacaataaaatattaagaaaaaaagcacttgaaactttttaatgatatgttttatgttttgattatgatatgacttatgtttttatgttaactataaaaagatagtaaaattttttacacttgtaaaaaatgttggattggaatataaagaagtgagaatgcaatattattgggctggcttggtaggaattttgaaaaaaatttaattaaattttaacttccgtcagtgatttttatatctttactaaaatatctcaaactaagagaacagaaaaatgttggctacctgaaatatttatttagtaacctggatcaaaccagactaatagtaagtatcttgcttttttttctttctatattttgaggaaactgggtgattggatactgtggtttatactataatccagtcttttgctacctgatgcctttcattagtttatttttagttcattagttaacaatctccaacagtgttagccttgcttattttccgctttcctccggtgttaaagcctaatcagaaaaaatgagcatatttctttatttttagttataatgttagttgaatcatatgaaattatcctttttgtagatctgaaataaacaaatagtggaaatttcatatggtccaaccagaaaactttaataatggcagggttttatcttaaaccatccttacaactcatttcaaataattctaatcactcaaactgccctgtcccctccactggtttaatttctggtttttgttttgtttttaaaataacattgtttaatactacgttctctagaggaaaggtccaaacaatgccaattcaatatacccaccaaataaaccattaaagttaatttaatcgtatgaaaacatctagatttccttcattcactcaccttttaattcattcaacaattcttattttattttattttatttatttttttgagatggaatcttgctctgtcgcccaggctggagtgcagtggtacgatctcagctcactgcaacctccgcctcccgggttcaagggattctcctgcctcagcctcccaagtagttgggactacaggcacgtgccaccatgcccagttaattttttgcattttttagtggagatggggtttcaccacattggccaggctggtctcaaattcctgacctcaggtgatccacccgtctcggcctcccagagtgcattcaacaattcttattgataattattgcacattgactctgctccaggtaccatgctaagtgctgggtagagctgtgagcgtgacaggggcgtctttgttttcagggaacttaaagttgttttttagaccggaagacatactatgtacatgcgctgactaaagcgatcattttgttttgattaacaggtctaatgaccggtttaatttttttttttaaccatattgaatgtttgttcaaagtgacgaacaccatcactttagtgttaataaaaattagccttggccgaagcagagctaagaaatttattttgaactatttccggtatttattaaatcaattatctgacctatataaggtcctaagccttagataaataaggcttgggagaaacgattcccaaagtgcgtgtttggacaactctaatctaagagagttccctcagggcaactggacccttctaagtaaagcacaagacacaatgctgggtaacttttgactggaaaagtatatatccaacaataattacatgtatttttttaaagaacaaaagcaaaaatacaaagaatttaaaattaaatacagcagtggttattcacctaagccagagctccccaggaccgtttctgggggatgcttagcagaagcagatgtgatctctaggctagtaagcctgagaaacgctaaaattgaaaaatgaaatagctcatttggatgagcagagctaggcgattggagggcgaaacaatctgatggtgaaaatgccattgatgaaaaatttgtactggtatcacttaaaagcttgcctcacattcacctcccagcaattttagcaaagatttagtgttcaagaagtttgcatttagatactcagtcgctgtgcacccacaatagccctttggcttcagaatctaggtggccacccggaccagtgatgactgggtggattttgtttctgattcctttcaaagtaatactttgaaaaacttttgtctatgagccttatctaagatagctaaaatgtcagtctccacagaggcaaagtaagtggcactgagaagtaaaaaaatccagccaatccccctgccccctatttgtggaaatggggcacagcccccatcttgcatatattttttcagacatgtttttacttcgggagaatattcccctacagagtaagtatctttaaaaaatgaaaatggtggatgtaacagtcatcctatgaccagccagagctttgctgctttttcactatcgggcctacctctgcaatcattgttatgtttctgtgctggtatgggtgtgcccagaaatcagaagagggatgagttggattgcaacagatggagaaaatgcccactgctgctttataacatattgaaagcaaatgaagaatcccagccatgggtttccatctcctgttttgagaacaagaagacagtccgagatgtaataatagtaatagtaaatacaatgtttacttattggctgtctactatgtattggacacattacattacttctcattgtcacatctctgcaaagaaggtattacaagtctttctttagaggtgagaaaactgaggcccagagaggttaagtaacttgcctaaggttgcacagctaggaagcggcagcactgggacaccacctgaaattagcctggctctttctaccacgtccagccaccttcctaaaagcagagccactcacaagcctggaagctttgcattccccaaggctgcatgtcagagctccatctcctcactgataaaagacaaacaccacactgaccgctgggtgcattcttggctactgcagagtagggagttagaggcactgagggctctgcaggcacaagtgtgcccatgccactaggcacgccatcttaggatcttctggcctcaagccctggtgactgtcttggtagattctctctcagggaggcctcctcatgtggacagaccaggtcatcatttgctttgatcctaataatctgggcatttccaaagaaatgcaaatgcaacagcttagtaaaaagtagacattttaaaagggatgtatgcaatgggtcacttaactgagcaagaaaagagagaagacctgactgaaattctatgtgcggcctttcctccggggagactgtggaggtgtcccctcaggcagcaaaagcaccatcgcagccctcggtgtcaaggcctctctgagtcgcgctttgccttaccgtacctcgtttctgggctaggatattttgaaacacttttgtctattagctttatctaaaatagctaaaatatcagtctccatagaggcaaagtaagtggcactgagaagcaaaaaatccagccaatgtgcagttttctcctcctgccccctatttgtggaaatgaggcacggcccccatcttgtctgctgggtggggttctgtttaccacgcttggcagccaccgccacccaacaatctttcatttttctttctaacttcactttgcccctaccttggtctctccaagccgaacacaaatggaccagtgaggaaactgcaggtaaagaccctgaaaggttatatgagctccctggtgtggtgtctcaagcctgaagctcagaggctggagctattgcccctggctgtctcccctgaagtcactaaattccagcgttctgggtccccttgtccccagcacacaaggatgggctgctctgagcaagctcaggcaccctcactctgccacactgtgtgtgtgacttagaccccacaaggcttttctgagaaaacagctgtgacctgacagaaacccctgcagctgcacgggcctcagaatcccccgaggcgctggcccgggctgtgcctggctccctggtgggagcagaagtgcccatggcctctcctgccctcccaacagggcccctaaacaaattcccacacccaggtgagttaccaggagcgatcaggtgggccgaggacatttgcttgcttcaccttccctgtttctttagattgaaattcagcctgccccacttctcaggaagatgccacgaggctgatccccctgagcagtttgtcctgtcctcttttcactggttttcttcctcattacctgggctagaaaacatggtggaagctaaaggcttgcagcaaagctgggctcccacgatcgggaatgaggtgaggagcaagcactcttgttggctgggcgctgctcgtggtggtgacttaaccaggcacatcgtctcatctgccccgtgttctgtcaatgccgggccctctggctgggctagatggccgcctaaggggcaggctggggtgagtcacggagcctgggatggtgcgtcacccggcagtcccaggcgtgggtgtggggacagccatgacaaggctgagcctagacacggacgcttggccatgaggtggcgaaggcgctgtggaggctgccacccggtgcttcctgcctgtgcccctctcctccttggttaccccacttactcccgggcccattggagtgtttcaggccatgaccttgactgaccaacaaaatcttctttgttggcaaaggaagaaagaaaggggctgagtgacggagccagccagagggtgaaagaagctgaagggactagaacgtcgcagcacgaaacatggcctggctgacattttccgatcctgtccagcttctgtgaaacactccctctccgtttctctaccctgggcctgcctcggttgctctcttgcttccttcttccttcctctcttatcactcgaaaaatctgtacctggaggagctgtgtattctagcagctggctctgaactgatgcccaactcggctgtgacggagcagatgccagcaccgggccggacccctcactgctcacttgcccattgatttgaggagggcaggatttgaaggagaccccagcccctcaccaccctccactacccacacccactcccctacacatacacaaagagtttctagaagttccctgccgtcgacacgtcggccctacctgtaatcggcaactgtgcctgcaggatggccgcggtgaaaagcgccttccacttcatcttgtcctttccctcagaaagaggctgggaggcagaggctgaggcagcggtggccgggacggttaggagaaaaggagtctctgctggttttattctgcagctacctccccaggaagtggaggactgtggggcctttgagaaagca

SEQ ID NO: 1590 - DNA, 87971 bp, Homo sapiens; identical to SEQ ID NO: 1589
  source 1..87971: mol_type = genomic DNA

SEQ ID NO: 1591 - DNA, 6834 bp, Homo sapiens
  source 1..6834: mol_type = genomic DNA
cggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacggtgaaaccccgtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgca

SEQ ID NO: 1592 - DNA, 12517 bp, Homo sapiens
  source 1..12517: mol_type = genomic DNA
gtggtaagaatctagtttattttacatgtgactaattggtctgtgctgcatggttatatactcctggattatagattagaagtctccgaagtcacctctgtgaaaagcaagctatcattaaacatgtctgtttatcaatcaatcaataaataaaatattgtttatttggggatacatgctgaaaatcattttattgatggggtacaaaataaaaaaaaaaagcagagactactgaattagaaatatacattttttcaggcacagatggaacatttacaaccacatactaggccatagagcaaatctcaaacaaatgccagaggattcatatgtattcattttctacagctgctacaacaaattaccacaaacttagtggttgaaaacaacccaaatgtattatgttacagctctacaggtcagaagtctaaaacaggcctcaccaggctacaatcagtgatggcaggtacagctgcccctggaggctgaagggtcaaatccatctccttgccccttccagcttctagaagccgcccacatactgaggctcatggccttcttcttccaacttcaaagtcagcaacatcttgatccttctcatgcagctgcctctctggcgctgtctcctctgcctctttgccacttacaaggatgcttgtgattacactgggtctacctggataatgcagaataatcacccattgcaaggccaaccttgattccatctgcagccttaactcccctttgccatattaacatgcagttcaggggcgcagatgtcctcgggggaccaacgtgctgcctgccatgctacacagacagagtgctcgggccacaataaatttaaaattaaaataataaacaacaaaaagttaagccccacagatctggaaaatttgtaatgcatttataaatgaaatataggtaaaaataaataataacgggaaaagcaaatcaacaataatgaaaaaaacaatatagcaaagctgatgagatgtagctaaagtagatcttcaagggaagtttatagccttaaatgcatatattagaaaataagaaatttctaaattaattaagcatccaatacattagaaaaagaatggcaaagtatgccgggtgcagtggctcacatctgtaatcccagcactttgagaggccaaggtaggtggatcacttgagctcaagagttcgagacaagcctgaccaacatggtgaaaccacgtctctactaacaatacaaaaattagccaggtgtggtggcgcacacctgtaatcccagctactaaggaggctgaggcaggagaatcacttgacctcaggaggaggaggttgcagtgagccaagatcatgccactgcactccagcctgggcaacagagcaagacagcctaaaaaaaataataataataacagtgaaacagctacacacaagcaaatcaagttctaccaggctttcaaggaacagattatccctattgtatataatctgtatataaaaaaataaaaaatagcacttaaaaaacaagtggtcaaagcaaggaaaatagaatcgtgtcacagaaaccaagggaagtaataattctcatgtaggtggagagctgccagatcccacatatctctgttaaactttgcttcctggatgaggcactccctaccccttaaatccccctattaggggtatagacacctatattgcaccccaactctctccttcatagcaataatgaccattactaactaattttaattttgttttgttttttgggttttgtgagatgaggtcttgctctatctcccaggcttgagtgcactggcatgatcatggctcactgcaacctcgaccccctgggctcaagtgatcctcccacctcagccttccgagtggctgggaccacaggcacgtgccaccacacccagttaatttatttttattatgtgtagagacggggtgtcactctgttgcccaggctggtcttaaactcctaggctcaagcaatccttccgcctcggcctcccaacgtgactgggattccaggtgtgagccgcctcacctggccaattttacatttgtctttgagattatatgatcgatgtctgactctcacactggtgtgtcaactccgtcagggcagaaaccacatatttgtctgtttgtttttcatctttgtgccccattacttggctggttcctaacacaaaatgaatgtgcaaaaaacgcttgtcaaatgaatgaggaggtctaaggggccttgagccctctgacgtttccattttataattgtggacagagccgctacagcacaaagctgagctggaccatccaatgtttagccagtgccttacgtgctaggagacactgggagctgtgctgggcttctgaggagtgggcagaggctggaaatacccatagttggtcagtctcctgtgtcacccagactggggaggtgcagaaatgaaaattacagagctgcgaggacccagaacctcattaatgagcttaactcactgtcctgaccaggtggcctctcaaagccttgctgggaaggaggctttaaggtggtgggggcagcagtgctggtggtggtcatcgaagaaagtgggagtcggggaggaagcaatggggagcaggggacaaagagggccagacaaactcagagcttcaggtgatgagactcaggaagcctaagtcaggaacagtgattgcggacatctttgtcccataacagaacttcctcctaaggaaaggtcttgcagagactggtcctgctgagcgctttaacaggttattgattcataaaaattggagaaaaaagacaaagtctgccacacctaacagccttctgtttagagctggtttagaggaaactttaagcaagtcttgtgtccaacaatttgggcctgaggcagggtacaggtaagggaacagacaggagacacggaggcaagaacaagactttagctgaaagagaaatcagagccagaggcagccacaagaacacccaacctactggaactcatgcaggtggacagcctgcccaggacttgccctgagtgggaagcaaagagcatcttatctagattttaaggagcagggtgcccctggctgacatctaggctacagtcactgggccaggtggagggttggtcaggccctctcaaaagtcatgagaggccaggcacagtggctcacgcttgtaatcccaacactttgggaggccgaggagggcagatcacttgaggccaggagtttgagaccagcctggccaacatagtgaaaccccgtctctactaaaaatacaaaaaattagccgggtatggtggccggtgcctataatcccagctacttgggaggctgatgtataagaatcgcttgaacctgggaggcaaaggttgcagtgagctgagatcatgccactgcactccagcctgggcaacagtgagagaccctttctcaaaaaaaaaaaaaaaaaaaagaaccaaaaaaagtcatgagagtcctcagagttctcaagaagggctgctgtgggcctgtttctggaaaggaaagaaaagcagggagctgttgagaaaataccatatgtttttatgccccagccaggcatgggggagaggctgaccccaaaagagaaagtggttgtgtgagatttcaaggaagatgtcagcgggctgcatcccagggcctctagacaaaaggaagggcccagccaggcatggtggctcgtgcctgtaatcccagcactttgggaggccgaggcaggcagatcacctgaggctaggtgttctggtccagcctggccaacatgacaaaaccccatctctactaaaaatacaaaaaataagctgggcgcggtggctctcccctgtaatcccagccaaggtgggcggatcaacttgaggccagcctgaccaacgtggcaaaactccatctctactaaaaatacaaaaattagctgagcgtggtggcacgcacctgtcatcccagttactcaggaggctgaggcgtgagaatggcttgagcctgggagacagaggttgcagtgagctgagattgcatcattgcactctagcctgggtgacagagtgaaatggagggaggaaaaaaaaaaaaaaggaaggtcccgtccagggagccagcctaggatggggaaggctcaccagaagtggatgcaaagagtgctggagatgagctcattctatttgcctaggaaagaaaaacgtccagaaacctggccttcctcctcttggccgaggccctccaggaaagccaggcagaccctgctcctgctctgaccccctggagaagtgatatgtagaaaagaggagatgggctttggcccagaggacagcagcgttaggctagtgagcagttcccagtcggttcaaggttgctaggctcagcgaactgcaagtccctgttcgacaagtttcttcctaaaggtccccagttcctcatgattcttctgagggtctcatccaccctcccagggcctgcagtcagctagccaccccactgccccatgcctgcagtgaacacatttaccacaacctggaaatggctggtgacagaaaagtcctcacggccacaacactctctgcggtgggaattcaggtgccttgcctgatggtgacaaagctggttttgcataaacagctctctgaatcacacccaaatgtggcttctgacttgagtggacccccatgaagagctgcagagggggctgggaaaagacaagagaatggagaaaatgaggagaaaggaaactacagagtgagatagagaacatatctgacaggtgtgaccacagcagtgtgacatttatgaacagtgtggaaacaacggcaaagcccctaaattaaaaacttcctggggaaataagccactccacatatcggttgctgaggaaagagtggaggaggctgttgacccgtgtgtgtccccatgactcaaagagggaaaagtctagctgtttccaatatcccgaaatcagtcttgctgggagaactgggaaaataaaaaagagatgacccccgtaggaagctacctttaatcccaagtgcccaaggctaggagagaagatgctccaggcgatccaggacaccagtgactgacacagccagaggtgggaaaggggaggataaagatggcacaaaagtgaggagtgagcaagggtctgagagggaaggccatgtgggcagtaggtggcacccacatcagagactgacatgaggattaaaggagagcataggtgatcggtcagagtgtgacagaagagaggcagctctacaccccttgcttgcaattctgagcattctgtagcaaactcgtttggccatcaaaccagacctcaattgagacaaggctatttaagcttcctcccagttggtgtaaatattcaatagttttgctgcagaaatgttgcgtttgattatgagactaccccaactccccaagggtgttttgtggtgctggtttctgtataaacctgaaaaattctgaattccaaaacttatctgacccccaaagtttcagataagagcttgtggacctgtgctcaattctggttctccttccttctttcaactgttgtctgtgaaaggagggatgcaggtatgggagacaggagtcctgcgaattcgtctgtaaactgtggacgggggggtgggtgggggggggtaacgtgggcacctttgtgcacaagtgcatgaataggaggggtgagcaactgtgtgtccatcacctttttgtcaaagaagcaggagtcagtgggctacgtgcttcatgagcaggagaggcggaaactaaggaaggctcatgtgttggaggaagcatgtttgaagagcagcaggtctcacagagtttgctctttaatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagcgcccagcttggaggtgctaactccagaggccagcatcagcaactgggcacagaaaggagccgcctgggcagggaccatggcacggccacatccctggtggctgtgcgttctggggaccctggtggggctctcagctactccagcccccaagagctgcccagagaggcactactgggctcagggaaagctgtgctgccagatgtgtgagccaggtaagagggggccttggtaagggccaggtgagtggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaaggctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccaacatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctgtaatcccagcactttgggaggccaaggcgggcggatcacgaggtcaggagattgagaccatcctggctaacacggtgaaaccccgtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcacacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcctgggatgggggttgggggatgaagcaagtggaccttgaaggtctccacaggtctgagtgtcctatgctccctgggcctctcttcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagatgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcattacagctgccccagggaggaggagggcagcaccatccccatccaggaggattaccgaaaaccggagcctgcctgctccccctgagccagcacctgcgggagctgcactacagccctggcctccacccccaccccgccgaccatccaagggagagtgagacctggcagccacaactgcagtcccatcctcttgtcagggccctttcctgt

SEQ ID NO: 1593 - DNA, 24801 bp, Homo sapiens
  source 1..24801: mol_type = genomic DNA
tgtgtttcagtatcactttaattgcagtatttaaacacatcactttgtattcagaaaaaatatctacccaatactctcttctctggaaatttctatttccaaccgtcattgaaaccaggatccctgctcaacccctctggaaagaaatcaacagcaaacaaggacctgggtcacccacagaagaggcagctggtgataagggttaggagctgatctgggctatgaccatatgggggtgcagagcaaggaaggggctcagggtgagggaggcagagacagaaaagcatctgttgggggactgaggcaacagctcaacccaggagtcggcaggagggaggaggaagccatggagatcagaggataaggctaggatccagcctcagaggaagaggatttttcggaagagtacaggtgagaggctcagctccaagacctggtcccatggtcctgcctactttgatccagagggagaaaaaggagcccaaaaagagtttctgtgtggccccagagagactagaactgagctgtttgtcctaaaacttgggaggcctgttctaggctccagccagaaaactgtgcaggactctgcaaatggtagagggggcacatggagctcagtggaacttagagaacaagggaggagctggtgaccaagtccacagtgtcttggaggagagatgagggaagtggttcaaggcaacacgtttttctggctatatcattacaagagagcaggtgcaaaaggttactttggtttcctcaaagtagagaaagaaaatacagggaagaaacggtaaaaatcaaagcttcctgggagaaaattgtagcctagaaaagctcatctttcccctgggggttcctgtattgcggcagagaggagggggtaggggaagggggtcctgtgtgagtgctgcaaggccatcgattgttcctgggagcttctccagaccttggctttcccccgtcacacgtttacccaaagaagaccagagtctggctccagggagccgaatgtgtaaaggacaggagtttacctgcccctcctcaaggtgtagggccccaagaacagcctctgaggtgtgtgcagtggggaagggttgggcgtaagagatgtcacctccagcatgggggtagcacgtggtcagatgcagagaggggtgctctctcggacactgcccagccttgccccacctagccgagtcacaattcggtatcagccaccacgtgttgtcttgctgaatggccgtttctggaggtggcctggccggtcccgttttcctgagcccctcggttcacactggcctttccctgagcctcaggggaggtcccaggtcctgagctatagccctggcctccaccgttttccgtgtaataagggtcttcgccctagacagtgtataaataaagtagcattatctggtaagcagggctgtgagacactggatgggagaggggcccaaacaggaagtgggggcaggggtgggagaagggggagggggaggtgggaggaaggatcggagggagggtgcagctgcatgtgcagactcctttcttcctgaagagtggtcagggttccagctcctagaggagaaaggacataggagaggcaccacaccatgccaccgcagctcggcagccagctcccgcaggaaaacgggcagttccaagaagggtgggatgacctccccagggtaggggacaggccagaggccaagattcagacctcagccttgtcctccctcatccagaatggcaaatggggattctccttccgtatacctccttttgagcaagggggcacccactgggcatttaacacggttgcaaatacagtgtggctgattaaacagcctgttctggtggccccaagctgaactatcccagaaaacataatgaatagatgacacgaatcatctgctaccacaccgagtaggtgggctggcaccattactgtcccctccccagtttgctacataatattttgaatcttccaccgattactgtgtgtgcacacatgcatatctttatgtaagctcacagaagggctttttctagtatttctcctcctgctccatgacatccactgaactccccagaaacccactatcttcctcatttcctttaccctggcccccagaactgaccagcctttctcctgtggggctccagctgcggcgattcatcaggaaatagccagtgatgcccaagacagccagcagggctcccgaggtgaccagtgcaatcagggtcttttgggaatagctctggtggcttgcaacatcttgctcagtgaaatctaggatccccagcttgaaaagaagacaaagaagatacagcctgtcacttgccaaaagtggagcccagcccgctccagccctctgtgtgtgactcaacagtgaacagatgcttgagggcattgacctcaggaatttttgaaatgggatttgagactgacgtctcttaattcagtcataccccaccatttttggttcaagactagaaaggagaagactcagagaaggatggtaggtagaactggggaagataatgacttccccccttactccagggagcccccctgccccggcattccctctcaggcccatcatctcagaggacttacctttttcaggtcagattggtgctttttcataagttggagtttgctggaaatttctagaattagaaacaagggttgctaaatctaaagagaaaccagcttatcctgctccaccctcccatgctgttctagaagatgctctgatggccagggtggtccatctcggggggaccgctcccaaagccagccaagtccttctccccagcacctgtggtctctctggatctaagatgccccatctccacccaggattctctaacctcagccctactccttccctgttcccccaggcagaggtgcaccttacctgttctgttggccaagaccagcagtagacactgaggcctcacctcagactgggcaaggagcagggagcatacctgggccccagcatcagcatcagcctgctcctccccacacagcactcgggccaggccctctcccctgtccttcttaaactccgcctgggaagacagagaaacatggagagcaagagatgaaattactgctctgccctaaactgcacccagagtctctgattacagtcatactcttaccccgtccgcaagaaggatccttgtttctaaaattccaacagaaaaaaaaaaaactgctaactgtatatgtgcaacaacacaataagaaaaaaacctaaataatctcccaggaccaaaatccatatcttctagtatctaagatgttagagaacaaacttaaaaaaattgtctcgttgaagcattgcccatgtacacatatgcaaattaaactcaaaagaaatggccaaaaacagaaaatattaataatgcaataataactaagagaaaatattctgtttcaagattacagcagtccccaatgatggaagaaaagccaagggaggtgaggaggagagaacaaatctataatatacactcagtggaaacctcagtggcctcctccctctttctacccaaaggagtctcaaaaagtgcattgctcaaactgaaatggcatttttgtctcgtcttccatctctgttttccattaaaagcatggaacccagttttaatgaagttcatagatttttcttcaggttgctgactgggccatcagacccaggaatttggactcagaagaaaaactctgataattcttcaatagtgagtcagaatttattccagcagcctccaatcagagtgtcctcctcccctgaacaggaaaggaattgaaactaagactttctcttcagtccggatggcagatggcagagaaggaaatgcctgaacagccctgacaactttcctgttaggggaaaactgctggggtgtgtgaccatcatcagaactgggtctctgtggaggagaaagcttcctgtttgcgggcagggccgctgcttgcaacaaggccacagggtcctcccagttggaatggagcctgggtattttcccactgctgtgacccaaggcaggaaaacccaggctcctttgctcctacacaaagcaaggtcaagattggcctcaggacccagctggaatttgaagcagctgagggaaaacaactgggcttggataaggccaggagagtgtggttagccaaactccaggtcacagagacacgagcccaaactggagcctcaaaaaacccccaggaaacaaggctacagagaaatgagttctcaggccactgctgcttcattcctcaggaaaaggagcaattctgcaggtctcccagtaagtccttggatagacgttctaactctggaaaaatccgtttttctgaacagcatttgaactaagtagtctgaatgccacactgaaccaatcaacagtctccacctctctaaacccagttgtctcaggggagccttacatggcttccccttgagcacccccgctccccagcaccgagagtctggatgaggaggagggggtttcttgcctggatgactctgggcttctgaagtatctccagttgaaataggtctgcttcccaagagaggcagagggacagggctcctgcaggttgtaaactagccaaaccaaatggcaccttcctccacctgctgagtgcaagaagccacaccttgacaatgtatcaagccctgaatataggacactgcgtgaaagcctctgtgcaagtgtcatgtgtatgtgtgttgtattcatgtgtcatgtgtaggggggtggggattgggaggtatctatgaattccaccttgtcaaagctttcagtttgcatgtacggcaattaaaatgatggatgccaaccaggcgcggtgactcatgcctgtcatcctagcactttgggaggctgaggtgggaggattacttcagcccaggaattcgagaccagcctgggcaacacagggaaaccctatctctataaaaaatttagaaattcaaccgggtgtggtggcatgcacttatagtaccagctacttggggggctgaggtgggagggtctctccaccctgagaggttgagtccactgtactccaccctgggtgacagagaccctggctcaaaaataaagaaataaaaaataaagtaacagatgcctatgatatccaggcacagttctgagtgctttccatatattaactcatttaggcctcacacgacctacgagattggtagagttattctactaattttgtagatgaagaaatggaggcgtgaagagactccagaggccagagctactgccatggtaagcaccataagaaaggtacaaccaaagtgctatggacatactaaggagcgtgaggacacgtctggttaaggttagcagacacatgtcactataggccttgaagaatggctggagggtgagcagaggaagccagtggggaagagcatttggaactgaggccccacctccaggaagcccaagatggggacagcatgcattattccacaaccctcatttcaaagagaatgaagaacactaccttctccctggtattcactatccttcaagactcaactcagtttctacctcctcaatgaagctggtcctaccttcaaccagactgggcatcaatccttactctgctctttactggattctttgcaagtcatgcaactagtctgagtgtcatgttcctcagctgtacactaggttgttgtggtgactaaatagatattgtatgaaagtgtccagttgggtgcagtggctcatgcctgtaatcccagcactttgggaggccgagatggacaaatcagatgaggccaagggttcgagaccagcctggccaaaatggtgaaactttgtctcttctaaaaaatgcaaaaattagctgggcatggtggtgggcatctgtaatcccagctactcggcaggctgaggcacgagaatcgcttgaacccaggagacagaggttgcagtgaactgagatcacaacactacactctgcactccggcctgggcaacagagcaagactctgtctcaaaaaaaaaaaagtgtccaatgtggtgttgagaatctagtgggcactagataaatagcagctgctactatcattattaataatagtaataccttatataccatatcatctagagtctacatattgatcatattctatgcattgttattgtcatttttctgtgactagattgtaagactcctaagtgtgtgttggggggagtgcacattatagcatttacaacccagactgcatgaaccgtggcaccaaacaaaagaactcagggaattgttgttcaacttaacatcccaaccagttggcctccacacagggtccctccaccccttgcacagtttcttggactagattcaagggaataatagcggccagcctcccactctggaatccaaccgcatcagtgaattgtgtttgggccccaagaggagcaggtggatcctgaacaaagcacaatgcttctccggacacttggaataaacatcctcccccaagagaggctgtgggcaaacatcacgggagagtgggcaggaggaagacacagcctcaccattttgttcatgagaatcagatttacaagctcctaactacatcagctcacacatgtttctctgcaaacacaataaacccatctaacctctctagagtagcattctcaaactttgcaaagactcttaacatcaagcattgcaatggggacggagatgggggtgagggagggacaggtatttttctaatgacctttaagatatttaagatattaagatcctagaacgctgagattctaggatcaatcatctcccccaaccccttttaatataattttatctattttggtgtgagtttgacaatgcaggtgaaaacgctattttcacatagaaaatggaataatgaagggacctgtttcaagtcacctaacaagtgggggcagctaacgaaggatgagaagtgagatcgtttccagattgcaggctttttccagtagacacaccatcttcataaatccttcatctgtaacttatgttttccgcatggaaactgacctttagtgcaagctggaggcagcctgcctcagatgaagtcaatgtgaataagagtaaagtgagctagctgagtaattacaaactctgcatataaacagatgtggtactaaagataggtatacaaattggcggacaaaggacttgactagacttttccccaaagaagatatacaaatggccaacaaacacatgaaagaggctcaacatcactaatcatcagggaaatgcaaatcaaaaccaccatgaaataccaccgcatacccattaggatggctgctattttaaaaacccagaaaataacacgtgttgatgaggatgagaagaaattggaacccttgtaccctactggtgggaatgtaaaacggtctggtggttcctcaaaaattcaaaaatagaattcccatgtggtccagccatttcacttttggatatatccccaaaaggactcaaatcaggttgccaaggagatatttgtacacttatgttaaaagcagtattattcacattagcctaaaggggaaaaagcccaagtgtccatcaacagatgaatggagaagcaaaacaaggtttacacttacaatggaatatcattcatccttaaaaaggaaggaaattctgacacgtgctacaacatggttggactttaaagacattatactgagtgaaatcaaccagtcacataacaagacaaacactatgactctactcatatgaggtacctagagtaggcaaagtcataggaacataggaacagaaagttgccagggtctggggagagcagggagttgtttcatgggtacacagtttcagtgatggaagatgcagacagttctagagattggttgtacaataatgtgaacgtacttactactactcaatggtacccttaaaagtggttaaggtgatgacttatgttatgtatattttaccacaattaaaaatattttggtgggtttctctggacaaatgggtgtagcataatagtataaagtaatcttacattttggaaactatttggggaaccacaaccacaaaaactaaattaagctgacactgctgccaaaagaatgacagttagactcaggaagacacatcctactaatgagggtgctgagatatggtaaaaggtgtttgagatgagagtggtatcaccttcccttcccctggctgcctagagatgatggctggggagcaaaaaaaaaagagtgattgggatagacatgtctacagaatgcacatacagaagacacgcctacagaatccacatagggtgagctaacatattggtactcactatgtgtcagtgcagaatgagtgtctggatagctagactcatgcacatatattcctgttatgggcatatattagatgaggagcataccaacatacatcaaggatgtgatgctcggggaaaccaaatccttcctgctcttcaccagggtattaggtagggcctgaggctcccaacattagaaccaataccttaaggccctctgacaccgaaagtacaaatccaacctaaggaaaattaggaggctctgcagcattcgcagcttttggaacagattgtttatcagacaagcagggagtagggaccaaggaaaggtcatcttggacataatcgggagctgtggctaaacattttggaacaggatagcaagctgaggataaattaccttggggagtagcaggaggctttgccgcatgggggctgaggatgaggagccctcaggaagaaaggggatcaacactggtggagagaccaggggaacaaaagcactcatatgagctgccacagagttgctttatgaaggggcagtgtggatggaagtcttctttggcataggaactggaggggagctgctctcttttcacatccccactcacagatactacctcaatcttagaggaacatgcagagaccttctcagctgtggcacgaagtaggccagacagcaaagaccacagcagagttaggaggaattatttctaaaagagcagtaagtttctggcacttttctcatacagtgacccaagttacatgtgagctttgaagagcaacagaaaggcaaaggctctgcagttaactctaaattccaggcacaaagaattagcattctggcacatacctgtgtgatacacagcaaaatgtatgctccaccaagtcgatggggttgcagggggaaagatcgtcattttccttggctacaactagcaaagaacttgacaattttttttctaatgagttgagttgaaaatcagcatcagaaacatgctgcatgttacttgtacattgtatgttcatgtttaagttaactattttgcagactgcatttagttattctactatgcaaactcatgtcttcactatttctgttgtttttagatgtcctaagttaaattctttcaggtataatttttacaaatttgtaagtcagagagacccaactgatgatcgtagtaaaactaccgagttagaatggaaaaaataagtaatttaagccctctacaggctgcgatctttccagtctatgcatgccagcacatcacatatgtgattcccttagatggatccccaacttgtaagaaaatgttttcttctgtaagtaaataccactctttccttcacctcatccttcctccagagccatgttactgttaggaaattagatttactgaaacaaagcaaggtctgccagaatcatttaaaataacacaattccctgtacattctttccaatgcagtaagacatgaaactgaaacaagaggcataactactaaacaggaggagaaaagcaatatattgtagtagataacaagatagcttaccttaaaattgaaaggaatcaactaaaaagctcctagaatcaataggcaaattcaagaaactggccaaacccaaaataattgttcaaaactctattaactttttaatctatcagtgacaatcaatttgaatatatagtgggagatctatgtgacaaataggcctatgacatccatcaaatctagagaaaaaagctaaagaaacaagatgctgagagatgcaaaagaaaaccagaaaaaatgaagaaattttagagcaattacaattcaaattttaaagcattttttttgcatttttttcaaaaagaaaaaaataatttacattttttacagtgtaataaaaaaagatctgcctgactggatattacaaatactgtagtaaaaacatacaataattttgaaaatttaaaataggcaaaagtacagacaaactgaacaaataaaatatgtctgaagagtatgccctaagacatataaaaacttaatataagctaaaggatacatcccatgcaacagaagagggagtcattcaacaaataatgttaggaaaaacggttacatggaaaatataacattacagcaaaataaattctatatggattaaagagttacgtgtaaatatttaataataataaatgaaataataaatgaactgacattttaggtgactagtttatatctggtgagtgagaaggactttcttaaccaaaaagcaacttaaatctgactctctcagatttaaaagtactacagaggaggggaaaatttaaaaagtactatagaggagggggaaaaagtactatagaggatggaaaaataacaaaatttattaataattaaaattgttattgtcttttttgcccaccagatggggcctcttactccctaaacagaaagctcagtattaaaggcaggctgaccaagctaaactccccggacccctactcaaatccagtgcaatccaagaaggtttaagggtgttcagaagggatggaggaaagggacaggggcgggaggaagaggttgggtggggggttgacttacacagctggaggtcttattttgctccaggcagatgccctgagtcaatttcacttctctgatgcctgaacatttgatttctgcctgtattaaaacaaaaacaataacaaaaacaaagtaaataagccagtatctttgctcctcatttctttcccaactttttccagtttgctttctgtgaggtgctctcttaggaggttttaaggaaaaggacatttaaaatttgtcaggggactagagatttctaatagtcatactctcgtctatttcatatctatcctcatcagatgacaaaacttttgttactagcctgggcttactggcaagcagctatttgcaaccttggtaaacactggcttggatggtgcaggactgggagaggggaggatcttttcccatttgggttgttttctctccagtcaatcacaaacttgcaggaaggccatataggcaaacagggataatggggtggaccagcagatgctggggtacctgttttttctcctggcctccaggactctccaaattcccattttggctcttttatttatttatttatttatttatttatttatttattttgagatcgagtcttgcccaggttagagttcagtggcatgatcttggctcactgcaacctccacctccctggttcaagtgattctcttgcctcagcctcctgggtagctgggactacaggtgcatgaccacacccagctaatttttgtatgttttggtagagacggggtttcaccatgttgcccgggctggtcttgaactcctgacctcaagtgatctgcccacttcaggctcccaaagtgttgggattacaggcatgagccaccacgcctggccctggctcctttaaaaacagaaagcagaaagatccctcgggcatatctcatgactgaggccctcatattttctgtcctgcatgctgaaagctgttgacagtcataggccctaaggctgagaaggccaggctgagctcaccatccctggtctgcccagttcctgccattgccaatgcccccctttactgcctctctgtgcctggcacaaccaccaaaccctctcatgtagaggaaatgttatttgtcctaaccattgtgggagaagcagccccagcaaataagcaatagttgccaaatattcccaaagggaaatggtgtcctggtcaaagccccactgataggtactagaaagaaccagaggattggatggatctctgagaatcccgtttactctctattccctaaaatgcaatacccaaagcctggatgggccttaccacctaactctacccctttcctcctctttctacttctcccagcaatatttaaactgtgtatttccgtgctgattcccacatgacccaaatcccactggcagggatgaggagaggggtggagggaaagaaacagcttgcctgcatacatatgaagtgaggggcaatctgccatttttggcccaattcacccaccttgatgtcacttaggataggagaagatgatgtatagggtttagtgggagatgttgcaaggctagtgctagtggttgaaaggtctgaaacatttccaggtgacaggctaggcttcaaggttgtctctggagttgaaacgttggctggggtggtgaacactgtgctgattacagaggtctgtgactggacagaagagtttgtgtttccataaactgaggttatcacagaggtagatgtgaatttgactgtcgtttctggaagagaccaaaacatgggtgtgcatgtgtgcatgtgctcatagatacacaaaatctcaggtcatgatatgggcatgcacttcaacacagaaaagggagtttggggagttaacagttacttcgtgtcccatccctgaccaaactcatttcaagctgttggaacaagagctagaatctagaatgtattagaggtgtcctgaaactgaaatagatgctggtctaccttagagaagccaaagacccccagtttggacctgtacccaccttctttcctttagaagagatcggagatctctattgagtcttctgatccttattttatcactaagctagactcagcatgagagaaggggtatggaggcattactgatcaggatcagctcccaagacatgggcctgagaaaactgtcactgaaggaagaattatctagaacttacttcagggcaccctaagcatgatactcaagtcattaatactagggacttgtataatttcctctgtggagaggggagcggtctgaaaacatcctaaatgctttacccaagcatcaccagcatctctccgggatctgacacaaatgctgtttttacctgtgatgtttgttgtggcctcattgccatgttgagacacagggtgcaggctggtacttccaagggtactaggtgttgtagtttcttggtaggatacatttgtagaaacatttgaaaatgttccctgggtaggtaactctggggtagcagtaccgttgttgtcaagactcatgaacccagaagctatagggaaacgaggaggaagaatcagaacctaaagatatcagcctggtgatatcacctgatgcaatttcctgacttcaggtagaattcgtctagaacattccctgctgccccttgttggcagcaacaagaacatactcctggacagtggattaatttcccactaccaaatttgccctgaggacatagggaaggaaagatttatatgcatacaaatgtctcatacagtattatttataggagggaaacgtgaacaactaaatgaattatgataggataagtgatatatgcacttaatataccataatcattatataatcatataaacaaacattagaaagaaaaaaattataaaaactgtagcaacgtggaactatgaggtgatgttcatagtatgtttagttacatactaaaatataaaattacacctgcataaatattgcaaagatctaatgtgtgcaaaaggtcatgcttcttttttcttttcactgtatcctcttttttggtcactctccatccagtatactaactcttggaataatcactagactcactgtctctatgcgatccccttaaaaatctatacttctcagacttcccattcccatactcccctcatccttttgctcatggccttcaaacccattcgcctttccttttcttcttttagcatgctctgacctaggaattcagctaatgaaccagggaacacaaggtctggtttctcatcaatgtagtgggaaggtagacaagctttgttctggctcttccaataactaaccatgtaatttaatgcatgtatgtatctcagctctcttacctcttaagtaagggtcttttctggctaccttacatggattgctgggataaacaatgagataacaaatgctaagttattatagtattatagtataatgttttggatctcatttttctctgaagatcttcatgagtgtctttgcacatctcttctgtatatcctgggatacatacttttttttttttttttttaagacagggtcttgctctgtcatcacagcacccaggctagaatgcagtggtgagatcatagctcactgtaaccttaagctcctggcctcaagtgatcctcctgtcttggcctcccaaagctctgggattacagatgttactcaccattcccagtcagtatcctcattagacacaggaaggagaagcttcttgactgaaccctatgcctcaaagagcccacaccctgtcctgcttcctgtgaggaccaatcaggatgtaccctctcttctaggtcatactgtggggaccagaagtcctagcacttcttgatcaaatggcactttgctcacatccacgatgggccgcttctcccagtccatcctgctaaggggaactgcagcacaagggtgtacacccccaaggcccagtggtggccaaatgatgactgcttgcagggagaagagttagtgcttagtgcttaagcctgtgggtggggtgtcccaggcacacatgcaattgccttgcaatgtgagccagagtcatgggtagaaagtagatgaagggaagtgggctggggccaggagccatctcttcctgctaagctgcactgtggcagtgaattccaagaatctgagcatcccaaattgaaacttggccttccaggtgatcacgaagatatgtttgtcaaggtaagaggatagaagatattttattagttagttggcctgacttacaaccttgaaatgtttagaaatatagtatgtaggcctctgttgtactcttgccttgggccttgtaaatgttaagggtgaacttggtatccagagttcataaaggcagttgcatcttcaaggaagagcctctgagggtcccaggccaccctaaagcttgtctctaaattttcctgattgggatctagatctgtacttttcagcgatttccaggtaaacagcaaggtagaatgacatctcttgtttccctcaggatcaagagggaagttagacttttggcttcacggccatcaacctggggccaagaacggtttccctaaaggtgatgacaagggtttcactctctcatatctgcttccttccacaacctgctgcaagcagattgctattaatggtgactgcagcaatcgtgtcttactgttatgtgtcaggtaagcagtggggagaaggaatatcactatctctgtcttagagatgaagagcctgaatcaccaaggtgctgcccaaaaggaaggccatagttcatgaagggaagcagcaatggaacactgacgtttagctgactcttgagtagatgcaacaaggaggttaggctgggtctaaactgccaaaaaatcggaatttattccccacatctctgtagagaaaaggatgggctcccatctggcttaaacaggaggtgggttgatcaaaataaattgatgcagaagccaatccaggcttctttcctgtttagatgggaccctctcaccactctgactttaaggtcagattcatctgaattcatccaagggggcagtattcagacactgaattaaaggatcaccttctcaagacaccattccaagactcctcttcttgcctgctctcttcctcttcgcccccagcatactgattactggggaccccatctggtccaccctggcccagcccttttctctctccagaggaagctgggcctgactgagatgatgtcatgcttttgaatcccctcccccgaagggcctccttcacctagacaaacacttttgaacttttccagatgtggagtgagacctgctgctagttctgaggacagaggtgcctgttccagaagagcaaagcaactctggacccaagccagctactgacccactggggccaggctcgcagctgcagcagcccctccacccaccaccaggccgagcgctgtggaatgagtagcaggatccacctgcaaatgagaaagggaccccaacttcagagtcagggctctgaccccagggtgagcagagcaccctctgagacaccagggggacaggacaagtgggagggcagaaagaccaaactgagtgactggaaatgcctgagctggtgcagagcaaggggacaccttagccaggggcctggagccaatcctggcataaacactgcggcacagcagggagagtgcatcttttaggttcacagtctctagagccctggaggaatgacatttatgagagtcaagactgaccacagatctctttttatcctgtcttcccacacacatccatggcattaaaccatcaaacactgacctttctttatctgaccttctgactcccaactctgtaggggagtagcaggagcctaccagtcagtgagagcttgtcacatcctaagagacaattgatgaaacctccactctttttcattctagatgggaggaacggtccctacccacaaggctacaagaattatagtacaatttaaagttgaataaaaagctctcttctgttgtttacttctcagtccatccttattaactgtgtttccctagggactccatttgacccttagttactctagttgatctcaacttatgaactgggagcaagggaggagacaaggtctcaagaaattagtaaaatgaggattctaagagatgtcacaaaattcatgtagtaaaagtcatgcactgaactttcaggtacttcttcagagtcaattattcttgttttacacataattctaataaccctggttatctgatatcctagctaaagttgaaacgtaggaagagcctattagaagcaaataataaggagaagcaacagctgaaaactaagaaacagaaataaatgaaaagcagacataagtatgaaaactcacaccagttttcttgaatcatttatggtaggagtgaataggttagatatctataccttaataagcattaatgatgtcactgagttgcaacatagccacgacatgttcatgatacatctgagtcataaagtccttttcgggggggtattctaagaaagcaaagacatgtgcaatacattttgaaaatatttctacctgccactagtaaattgaagactcttttgttctttaaagtgagtttgcaaatcctcagcgatccagaaagctctgctaccaaaataactaaatccccatattttaagagactgagttttcctatacttggtcttgcttttcacagccctccttagttttttcctggtgctgtttcctgatctcctagcctgccagtcttattttgcccatgctttcatattctagcacctggatcaagaggagtatctcgaaggagttcctgggaatcttagtccatagagttacagaactaggatgaagggacatgccagcctctgccaggaagtaggccgttgggagccacagactgtatcaccaggaaggcggtatagcccagagacaaagagctcaggctctgcagccagacaggccacattcaaaggcttctttaccatgttttagctgtggtttgggaagttacttcaactctgtaaacctcacctgtaaaacagagataaaagtagtccctatgtcttagctgttttgaggaacaaaggagctaagaagtagaagcagttatcctgtctggtaaaagttcaagaaatagtggatatcttttgttttaggccccttccttctgcttctcagtgggcatgagatacttatttctgtgactcatctgccacaaaatcatatatgctgcttcctcaggataggtctaactgtcacctcagtaagaatataaacttctaaagtgctggagccattcttattcttatgtgttttactcctggtgcttagcacaatccttggagtttaggaaaagcaataggattggaggacaactgtggcaggtgtgttcctgccagctacctctagtcatggcagtcttgttctcatgttatattttaagggggaattaattaaattggggagtgttcatgtgaagataaccaggattaggagagttctagaaaccaagtcatattgttgagggtctagtgttatttcatctagatggggggttggcaaactatggccagtgaacctaacctgactcaggggttgtgtttgtatggtcagtcagtaaagaatggcttttacattcctttctttctttttttcttgagacagtctcactctgttgcccaggctggagtgcagtggcacgatcttggctggctgcaaccactgcctcccaggttcaagacattctcctgcctcagcctcccaagtagctgagactacaggcatgtgccaccatgcccggctaatttttgtatttttagtagagacggggtttagccatattggccaagctggtctcaaactcctgacctcaggtgatctgcctgcctcggcctcccgaagtgctgggattgcaggcatgagccaccgtgcgtggccggcttttacatttctaaaagtgtcgtaagataagacaaagtagaccatccatcagaaaccatatatggcccctaaagcctacaatatttactctctggccctttatagaaaaagtttgctgacccctgatatggaaaagaagaatttggggaggaaaaataaataactttctttaagatgcatgttatttacactggttgagcacccctaatctgaaaatcagaaattctaaaatactccaaaatacgaaactttttgagtgccaacatgatgccgcaagtggaagattccacacctgacctcatgtgacaggtcacagtcaaaacacagtcaacactttgtttcatccacaagtttattaaaaatattgtctaaaattatcttcaggctatgtatataaggtatacaggaaacacaaattcatgcttagacttgggtcctattgctgagacatctcattatgtttacacagatattccaaaatctgaaaaaatctgaaatttgaaacacttctggtcctaagcattttggataagggatacattcattctgtgtattcattctcatttttctgcagtgccagtgatgtgcaaaggatctcgctcagtgctgtggagagtacaaaatgagagctggatctctttcctccattaggtgttagtgtcattgtcatttaaatcaatccctcaaggagtttgtaatctagtggggcccactagaaacatcttcaggtattgtcatgaaggaccagattaaatctgtaccagcccaaagaatagaattagaactaatgattagaagttatgggaaggccaatttcactgcaatccaaggaaaaagtgtaaaatgatgtagctatttataagaatgaaatgagccactttgggagacaagtgatccatccatgcttcctgcaaacactcaggaggcatccgtgttagggggctgtccaactctgaggcctaccatgaatttcagtcatcctagactagaacaagggactgagcagatgccttcttaagcttcaaaggctaagctaaggtgtgagtatatataaaccaagggtctgtggcctgagggttcccagtgtaccgagatttctgttttatattcaaatagcatgtcttggccagacaccatggctcacgcctgtaatcccaacattttgggaggccgatgtgggtggatcatctgaagtcaggagttcgagaccagcctgaccaatatagagaaaacccgtctctactaaaaatacaaaattagctgggcatggtggcgcatgcctgtaatcccagctacttaggaggctgaggaaggagaactgcttgaacctgggaggcagaggttgcggtgatccgagatcacaccattgtactccagcctgagcaacaagagagaaacttcttctcaaataaataaataaataaataaataaataaaatagcatgtcttggaccccatccacttactgtggaaccctaattattttgaagattctctgggcacctacatttctccctgtcacctcttcctccattttaccagcaccacagactcctgggttgtggctccatggctcaatggctccctgtccgcactagtataccacttcaccgtaagttagccaaggtaaagtaagttactttaccctccccagagagccactaacacaaggctagtgtgtgtagccagtatttactgaaaggttgagggcatggaacgagattacagggcagcccaggggagacaatggcataaccctgaaatattagacattactgtgctaatgaagccatgtattaaaaaaaaatttcctcccaggtcttttccatcctccacccaccactgtcctgctatgactccaggcacctctccaccctttatatgctcttcctgggctctggagtcctatcagccttgtgtctcttgtgcccacctaaacacaaggcttcacttcattttatcatgctcagcaattcagcctcctgcctacctttgctcatccaggattgtctggggttctaggctttgtcactcaaagacctcttaagacattttcttaaatcagctgcctagggatgccactcctctctaagaagtatcagtttgatttcatttttccaaataaagaagaagcctacttcccaattaagcccaaaggccttttccgttgcatctgaagggaagtaactcattccgacggactccaagagcacaggtactaagaagtacacctttatatgcatccctatttgtttgtctctccatctttccaacatgcacgcatctttctccttagcacaacgtccagctctgggactaaaagtcatagataatatgttttcatttattagctaaggagggaagagaatgttctcattagagaagtccaagcccacaaaaatatggaattctcacagccctggcgactgtgagaattttcttctggagggtggtgttgtgttctttttccataccttcttatttttaattctccacactgcaagccatttagttagatcaaccaaagtcaatgagagagggaggcccaagtacctgagagtggagttgggtaaccatccagccctgaaagtaaacccaggccctccagctcagggtctaaaggaaatcaggcaatgagaccaacggtaagaagtggaatttgttcctcattttcatttgttttcgtaggactctgcagctgagtttatctgctgcagtttggcacttcttgccctaagctttttgagacaaagattgcgaaggaaggagatgaggacaagggaatgaggaggcccaggaggtggagccaaagggataagaaaaagaggccccaggcccctgtgtgttttatcagccgaacagaaatgctgctgaagacatgcatctgcaaaggtggtgccaactgggttgggtctacaagtgcggagcactggggaccactgaattagtcagaggtccccaagcctgctcctcctctgtcgccatatggcagagattcaaagggtggagtcctctcccctctggaaaatagctgataaaattcttttcccttttatttttcccctcttacatgtagccctggacaggatatgggtgtggggtcagcaggcacgaaggacccaaaggaagaagaggaatgtgacggggagggcctgggggtgttgttagagtgaggatagggacaggccttggaaagcttggaggaaatagataccctgagcctgacaaaggggttccctaattacctgaaaggcttcctgctccagccagcactctggcagtgctgcctggtggcccttgagccccttaccctgactctgctctgtgatctcccccacttccaacaaagacagcccacttctggttagttgcagtgcctatgcacatgccaccttctcaaagggacagaaaaaaagaacttcccaaaacaagctctttgttggggtaaatgatgagaaaacaaaccacagaaatcccctctaccctaaattttacaataataatagcatttctgcaatggccctatggtagcatttcaaggtacactcagttatctcatttatcccacaatgtatcccaggactgaaaatgactcctagtattaacaaaacaaaacaaatccaagcaaaaaccctagaaagctcttgggaagggcataaaactacaattggctcaagtagtctggcaaggctgggaatggggccttgtgcctcatccctccccaccaaaagctgggatattctcagcatatcagtccaaagttttgccaaggttgtgttgctcccccaaccccaacctcggcaggccaaggcgagactggcacttaccagctgaggaaataagaaaagggtggacctcattcggctgaggaccaggtcatcacaagctgtgtagccaaaggagaatggagcatctgattggaatctgcaccactggccaactcacccctgtttttttgttttttgttttttgtttgtttgtttgttttgagaaggagtctcgctctgtctcccaggctggagtgcagtgccaggatcttggctcgctgcaacctccgcctcctgggttcaagggattctcctgcctcagcctcccgagtagctgggactataggggtgtgccaccatgcccagctaatttttgtaattttagtagagatggggtttcaccatgttggccaggatggtctcgatctcttgacctcatgatctgcctgcctcggcctcccaaagtgctgggattgcaagcgtgagccactgcgcccggccgactcactcctgttatgagggcctagtctagcacccactctagaattttgaaacctcattgatagcttttccttgccccaaagcacacatccaggactgccaaacagggcaacccaaaacttctctcagagcttcctccagcccaggggcagctgtccccagctgggcggacccaaagatggacaacagaggagactgggaacaaagaggtctagtccaggtcactctgcagggccacagtgggtggcccttaggatgtagtgagagtacagaattgggagccctagagtgctgtaagcaaaagggagagcaatgtacaaagtttcaaaagtttcaaaccttccaagtgcaaagagatgaggtggagaatgtcattccccaaggaaagtaatcgagtataaatatttaccgggtgcctattttttttttaaccgaagtgagagcaagaccttaagagtaaggatatgtgtaggtgagtgggggcagtgttctaacccatccactagctttagaacttggagcaggggcagaggaagaaaactccaaaaggtgacaagttttgaaatttgtgcaggggtgacggtttttggtaaggcgagcgaggctgggcgcagagcaaattctgtctacttctacctcctccgcggtggggttgctgaagtgggaattcaaactcagcttcccaatcttaaatgcaaggtttttgtttggttggttgtttggttttgtttttccttttcacggactgttcattccgaacacccctggcctgggacctggagcctcatccctgattcgcttccctcgaattccttaatgtccacttctggctctcccagtccctgtgcaaggtgggcacaccggccccttcccagcaatccgctccgtgtctatactttctgaatcaaccaagagccacaaaacttttcctgcttctctcctccccagtctcccggttctggctgcaacttcgcactccgcgcctctggcaaccagaagagaccctggcatctccaaagcgctttatctcagtccattggaaccagtcgtgctgaccgattcacacctcggctaacgcacactcgcgggggtgatggccttcccttcccctcccacccccgtcagctcccaggtgaggcgctggccccggggggaagcagctgtgggcggcagtgcgtgggttgggcaggggtcccttccctccgtgagactctgctctgctgttcagcctcccagaaagcctccaccctccccgcggcgaagccaagcggccgcggcgcgcgggcggtactcacgcagcaaactcagcaagcaaagcgcggtccagccccgcggcatcctgggccctgcgcgcgcgcccctgcggaccagcatccttcccgcgcggctcctagagagacgcaccgagtggaagacactactcggcttggccaggacgcgctcttcccgccccctccgcccgggagaggggtgggggattcttgcttttttcctctcttctcccctccctttttagtcttggcaaggcagcgcctctccttggctgctactaacttgagctcccctggttggtcccaaaggcggagggcgttaggagggaggctgggttgccgccgtcgaggccaaaaaagg

SEQ ID NO: 1594 - DNA, 24801 bp, Homo sapiens; identical to SEQ ID NO: 1593
  source 1..24801: mol_type = genomic DNA

SEQ ID NO: 1595 - DNA, 3671 bp, Homo sapiens
  source 1..3671: mol_type = genomic DNA
ctgagtgaaagaggatatatttattggctgagcaagaagggaaggtacagttggtaatggctgcttctagaagccaccagtctcaggttcacttgttccgagcccagtttcctccaaggtggctgtactgagcatcatctcgatctcggaggggctaagagaggagaagagaaaacggtcaggaggcagggttagaactcttcaaggaagggccccagcaggccctgacgatgagagctcctgcctgacctctccagtcacacccagcaatgaactccccagtaggacccttcccacgtgcaaacagcattcagtgtgagcctctctatccccacttaccctcccttcattcctgcctccttcccctcaacgctcacctgatagacctggtcattcctcaacagagcttgtgtgtcggcagctagaagaaccagagagagacatcaatggcctagcagatgggactgtgagatccaccctcccacaccctcagaagtctgcatgagtgatatgaacacacaagttctttcaacagtcaaagttctaggagtctttaggagattgcaagagtaactcccagctgagactaaacctaccaccagccccattccttagctggtgcataagctcactggtacacacacacacacacacacacacacacacacaaacacactctcatgctctgctcttccactaacccccagacagccttccagtctcatgtccagcaaagcagaagactcccaaagcaaggagcagagtggcaatgacatcagtgacaatgatgccagccacggtggctggatccagctccacacagctctggcacactgtgggggaagggaggagagaggagaggttgagagcctttaagatcagggaaccatcctctgcctcctagggcaacccttagatctcttatgccaaaacccaaacttcaataagaccctgggagaaaggcctggtgatgggcttgccacaccttcctccaccctgcatcctaaggaatccctgggaagagccaagaagtaatctcagcttttgggaccttgaacaaggtggtgggccaaacctctcacccaaccaaggctgcagtaacatgacccctactgctctgtcttgctgagttaagctctctcttccactttgaaggtccccaaatctggcttgtaccattacaatagtgacctcactttgtttagagaacagatgggttcaccatatccctctctagccagaaagttctcacatccagaagccctatccattccaacccaaagggttcaggaagcacgtacttcgataatgaacttgcacggtagattctttgtccttgtatatatctgtcccattacacctatatattcctcgtgggtccaggatgcgttttcccaggtccagtcttgtaatgtctgagagcagtgttcccaccgttccctctacccatgtgatgctggtattgcaattcacaaacactctgtcctcaagttcctctataggtatcttgaaggggctcactaaaggggaaaaaatatcacagttggagacagctctttgatctgcaccaagccctttgttctgcggaagctcatacttaacagagaccattttcctggtccaggacagtttatggcttccatcaagagagacagaagtcacaagaaaaagccttcagaaagttccccaccaactgcaggggtcaagggggacatgaggatgccattcaagcagaggacaggtcttggggccttggtgcaaaagaggacccctcagagcaggattgacccaagcaccttcctggaaatgaatccagaccactgatgaggagtagggggagcacggaccactgaagcacctggaagatgtggaaagacagaagaacattcctcgattggaaatgtctgcattttttcttcaaggaaacatctaattccacttcccagccatctacaacactcccacttcagcttcttatcctcatccttcctcattgcccctgctccattgacaaccaagaaagcggggctctcaacactgaagcctttcccagggccagggatggctgtgggtggagaccagctggtttaccagcccctgaattatcagccaagtggtccagaacgggaccagggcaaatcccatgtacagttttccacccttggttagaaggaggagaacaggaaaaaaattttattgaatccatccctagagctcctcacaagtcaagtcttgtgggagacttttagggctggaggtgagtgcagcaacattccagatgcagtgagttcctctgacagcctgagcacatctccacaggccacagaggcactacagtctatgcctccaaacacagggaaaagtggaggctacattcattcatcctgggcttcacactaagtcccaaatttggatacaagagcatcttctagaaaaccctgaaacagctgttgctcacacttctgaagcaggttggaagtatatgcatgtatcctcagggagacacatgcacatcaaatgcttcacgtcctacagtcgcgtcctcttcagggatctgtctccagtggaaatcctgagtgccctagtgcagccaactattaggtgaccattggacccagtttgcttagtgttgaaggggttcctcggacatgggactttccattttaaaactgaaattggcaaactgagatgagttaaaatcctaccatgtaacaacccctcaaatcttccctccgtcctgctcaacctaaagttaacttctcttaaagcattcacataagtgctaggacatgcctccagggatgacataatcatggccaaacaaacaagagtcctgattccagaggccatcaggcctaaaaggagtagtgcaggaagctgtgctcccatggccagtcccagattcaggtacatacgtactgagctattttctgcagatctctggcctaaggccttctgagagacattctaggcccacatgcacccatggctggagtcagtcaaagccaagagcctgtttcccagactctatgctacatcctgcccctgccctcctgacacccctggggtgcctggtgaactgaagctagcaccgagaagcacttttttttttttttgagataaggtctcacaggttgcctaggttggagggcagtggcatgatcacagctcactgaagccttgaaatcccgggctcaagtgaccctcctgcctcagcctctcaaatagctgggactacagttgtgcaccaccatgcctggctaattcttttgttttttgtaaagatagagtctcatcatgttgctcagactggtctcaaactcctggcctcaaaggatcctcccacttcggcctcccaaagctctgggattactggtgtgagccaccgtgcctggcaagaaacactttcaagtgggcctcactcccatcagtaatgtccctctcaggtcccttcccccacccacctggagtagccttaccttgcgagagaagggtagccagtaccaggccagagagaaacgtgctatgttccatctcccagcggaactcatccagtagataaagccaggtcaccgaactatcagcctgggtgagagctgccctcccctagctgactcacaggtaccggaaagaggagagtgggggaggaactagaagatgtctgcttctct

SEQ ID NO: 1596 - DNA, 3671 bp, Homo sapiens; identical to SEQ ID NO: 1595
  source 1..3671: mol_type = genomic DNA

SEQ ID NO: 1597 - DNA, 11596 bp, Homo sapiens
  source 1..11596: mol_type = genomic DNA
tattgtcagagtcctcttgtttggccttctaggaaggctgtgggacccagctttcttcaaccagtccaggtggaggcctctgccttgaacgtttccaagtgaggtaaaacccgcaggcccagaggcctctctacttcctgtgtggggttcagaaaccctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcaggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataagtcctctctacttcacagattaagaaattgatactcaaaaaagttaaataacttgttttaaaccacatagtaagtgccgaagccaatctgtgagaccaggactgtttgtactctaaatggctgcaccacatgaggcaaaatggctcgtgatggttttatttcaaagacctagaaaacactatcacagctggtgctcccgtctcagacccacagcaacgatgtctccacttcctgcttcatcttgggtttctcacgtcttgaatgtgcacacaaatcacctggggatcttgttaaaaatgcagcttctgtttcaaaagacccagactggaaatggagattccgcatgtctagtacgctctcaagtttattaatctgctgctggtcctaggaacatattgagtagcgaggggcaggatgtgactcctgtaaggagtggccaggcattttcttagagacctgtgttataaagtatgcttttccttaaaaaaaagaagaaggaggaggaggagaagggccaggtgcagtggcttacgcctgtaagcccagcattttgggggaccaaagtgggaagatcacttgagctcaggagttcaagaccagcctgggcaaagtagtgaaaccccatttctacaaaaaattaaaaattagccaggcaaggtggcacacacctatagttccagctacttgggaggctgaggtggaaggatcacttgagcccaggaggtcgaggctgcagtaagccatgatcaagccactgcactccagcctggagtgtctcaaaatagataaataaataaataaataaataaataaataaataaataaaagagacagtatcaaagacccaatcacctctagacatctggcatcataggaatgtgcccagtctgctctggggataggaaagtggggatcctgtctccccctgtgtagaggtttcagtaaaagaaaggcctaggtgtgcagaaagctttcaggcaatgccagggaaactgatcattgtaatgaatccagggtattgctgagtgagggcatcctggagggcccggtggaaatgtggtcaggctcttcaatgcacaggccctagttgatgagtaatcagggtttcaaatatttccatctctgtctcaagcagaaaacaaatggaaaaactgaaccaccagaaaagcagagccagagatggaacaagaatcccagtgtttgtacccaaccaagagcgtgtttttcttccacagacaccaatgttcaaaatggaggcttgggggcaaaattcttttgctatgtctctagtcgtccaaaaaatggtcctaactttttctgactcctgcttgtcaaaaattgtgggctcatagttaatgctagatgcttccttcctctatttccccccaaatttcctgggaacccctggtcaataccagcagtaagttccactgttctagggtgtagaaatggctgtgacccagcagcaagagggaaggacatcagatgtcatcagtggtcatactgcaacacagccctttttctgtttaggaatgcaggtacccacaacatttactaacactttttttttcttatttattttctagttggcgtttgggggcaagatggtgagatatgctttctttctttcttttttatgaaatcaccccatcattctttgtagttatgaatggagctttctcttaggcctcccacagaacttccacagaggtcaggaaaaggagtttctgccatctacccctttgactttcctcacaagtctggagatatttctagcccagaagagggaagcaacagaggcaggaaataatgagtcttaaccatacaaaagaaaaattgagacttaaatgaagttgaaagcactaacagttttcatttgtttgcatttcatatttgatgtgagattctgcagaggagacgtagccagaatgcatgcacagggttactctggataagctgctggggcaacatttggatgtgtgttcagaatcacatgtctgaatactctgaatatatgtgtgtacatgtgtatttatgcaagtgcacatgcatatgagtgtgcccggcctgaacttactctctcaaccacagcggtagagtcaggagtgttccaacattggaagcccctctattcaatcagctcttccaaactgagtgaaccaatgttgtatttaatggcaaccatggctggacaccatggctcacacctgtaatcccagcactttgggaggccgaggtgggcagatcacttgaggccaggagttcgagaccagcctggccaacatggcgaaaccccgtctctactaaaaataccaaaatcagccagacatggtggtgtacgcctgtagtcctagctactcgagaagctgaggcaggagaatcgcttgaacctgggaggcagaggttgtagtgagccgagatcacaccactgcactctagcctgggtgacacatcgagactgtctcaaaaataaaataaagacaaccattatgccagcctagattccgccatgctgcctaatttgtagtgtccttaggagccatttttgtaaatagtcatcagataagatgtaaggcccataacagctttttctatgcagctgagggaattggaagatccattgtttcctaagagttgagggaagagtcccaacccacgggagcagggtctgatcttcattgccgatagaaacattactaatggcttcttactgtttccttttcaggtaatgaagaaatgggtaagaagatttccactctatctagcaaaagttttcaaatatggaatgaaatgctcatagagtacaatcacagtaacaaaccctgagaactaaaactattaaagggaaaatacaagtatctttcaatgggatccgtatgaaacttgcctgtatttgttgctagctgtcatgtcagattatagctgtgcatatatgtatctctgatcatacacatatggatgtgggttggagctaccatgtgtttttgtataagccatgaaatctttgaaggcagacagagacagtgtctcatttacctagcccagtgtctggcacatagtaggtgctcaatgaatattttttgaatgaataaatgaacaaacatatgaacacattgctaattacctcccctcaagaagctgatggtcttgtgtgagagacaaataattgaaaatatagtgagttgcatgttataatatgggtagatacagagtaaaatgaagtataaagaggggagtggtcaactctactgagtgtcgttgggaaaggttccctgggggaggtggtccttgagctgaattttaaaggataagcttatgttttagggaagaaaaatattttatgcagaagagataaagctgtatagtatgaggataagagtctaactgagctagatcagaatgtttgaatcttggctcaactctctacttgctgggtgtgtttgagtaatttacctaacttttctgtgccacagcatcatcatggtacaatggaaataatagtgctacctaacttgtagggttattatgaggaccaaatgagtaattcatttaaggcacttagaacattatctgacataaaaggcagtaggagggccgggcatggtggctcacacctgtaatcccagcactttgagaagccgaggtgggaggatcacctgaggtcaggagttcgagaccggcctggccaacatggtgaaactccatctctgctaaaaatacaaaaattagccaggcatggtggcaggtgcctgtaatctcagctactcaggaggctgaggtaggagaattgcttgaacctgggaggcggaggttggagtgagctgagattgtgccattgcactccagcctgggcgacagagcaagactctgtctcaaaacaaacaaacaaacaaacagacagtaggtgaattttagctattaatacatggaaagcatgctgactatagatgataagcattaaagtttactgagcatgtatgttttaggcattgctctaaatattttacttgaatttcctcatttaattcttccaacacccctactgtacagttaaggaaacaaagcctcaaataaatacagaaataaacaaaaataagtaaacaatccagtcctggggatataaatgcagatttaggccaagtgccatggttcatgcctataatcccaacactttgggaggccaaggcaggaggctcgcttgagctcagaaggttgaggctgcattgagcaaagattgtgccactgtactcgagcctctgtggcagagaaagaccctgtctctgaaaaaattaataaatagaaatttaaaaataaaaaaattttaatgcagatttatatgataccgaagttcattttctcaaccattatgaaatactgtttctggatatgtataaaatctttgtgagcacacatatctttttttaacttaactttcattttaaattcaggggtacatgtgcaggtttgttatataggtaaacttgtgccatgggggtttgttgtatagattatttcatcacccaggcattaagcctggtacctgttagttatttttcctgatcctctccctcctcccaccctccaccttctgagaggtcccagtgtgtgtcatttccctctgtgttcatgtgttctcatcatttagctcccacttctaaatgagaacatgtggtatttggttttctgtcactgtgttagtttgctaaagataatggcctccagtcccatccatgttcctgcaaaggacgtgatctcattcttttttatggctgcgtagtattccatggtgtatatgcagcacatttttttatccagtctaccactgacaggcatttaggttgattccatgtctttgctattgtgaatagtgcacaatgaacatacgtggagcacatttctgtctaagcacagacatctagacccttgtgtgagcatgagttaagtctaagctctgctactgaatttgtgccaataaaagttgtgagcaattttctttacatttttttcaaacaaacacacccagcagagtataatgtctatgtactttatttatgatttctagttcatttaacatgtctaagaaacatccgtgttgaaaaattatttataaattaaaataatataaactatctactgtccttatactcaactcccaattataagcaggtggaaaaacctggagaatgttttgtttacattctgtgcagtctttgtcagagggctgcctgagcaactgggtcagagtttagttctgctctgggagtagcaggacctcaagaaggaaaggaggaaaggaagtaactttttcttgagcacctgctatgtgtcattcactttcaccttcataatccatttaattttcgcaaaaactttgtgaggttggtgttttatctccatttccctgataaagaagttgaggttcagcaaagttaaatgacttgccctcagtcacacagactagggcagatccaggattcaaactcagggcttctgactcttgagtccagagctctgtccctgacagcagcagcactgcctctcctctcttccagctgttatgtccagactgtagcagaacccagtgttccagccacaagttttccaggaaataataaaggactcctagctccacctcccagggcaaaaatggctgctgtgggaaacacaggctggacctacgaatggcattagtggtttattagttgatttcagttgtccacactaataggcctccctctaacaaaaataattgagagctgattatgctcagatataatgtaaagtgaagccactttttattggaagaagcattccctcaaaacgtgtagagtatttcacattatttaaaggcaaatagagagaaaattatatggaataagaacaaagatgtttcttctctattatgagggactcagttctgagaaaggattttaaattgtaagaaataggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagaggtaatccaggtctccagaacaggtaccaccggctctttagggaggaccattcaaaagggcattctcagtgattttccctaacccagctcacagtgcccaggcgtctttgcgcttcctcccacactcaatcctgggactctctggtaccacacggcatcagtgttttctggaatatagattaaacaccaatatgaggcttctgggtaaccccagtctgtgcgagatctaaaatagcaactccctaagagacaggactgggtcatttgcaccgcatcacacccaggttcatagcacaccaacatgagtttatctaatgcttcctccagagataaatttttcagaaaggtttgcaaaaaacactcaaggccactatagtaaaatggcataagctaaggtataataataaaataataacaatacttaacatttattgagtgcttattaagtctcaagcactgtctgtacccaacacttatcaaggattctttttcatgtaatcctctcaacaactatatgggttaagtatcattttattcccatgagtaaagggatgaggaaacagagggtttgtgagttgaaaacacatttcacgcttctcacagctagtgagtaataaagctgggactcaaacccagggctgtttgactccagtgcctctacccacggccaccactctttgcttgtcaatgttgttctaaacatattgaagggggggctctgaccgtggcaagcgtgtgagtagtaaggggagaatggccttcatgcactccctcctcacctccagcgccttgtgttttccttgcttagtgatttcccctctccccaccccaccccccacagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggtaaggctgtggagtccagtcagaggagattcctgccaagggggacgaccagcctgggccagggtgggtggcaagtccacagctaggtcagaacagcttctctagagcttctatgcacagcttctattactgtgatgacaagatctcaacagacggtttcaaatctcacatcactcccctccttcccatcctagaaaagtgcaaaaaagtttatgaaagtgatgggcttcctcacatacctgtcaatgcctgcagtcatccgattccgcccctaagctgtgggaagagagactttgatatattagctcctgccttttcctttcccttcccctatggagagaaacaatgggaggatcttgagctgaggaaagtcacaaaatgatgagaagagtgtagggtccttagagatgaatgaaagaaaaaaaaagagaaaggacgtctgaacagaaaagggagcggtagaggagagaacaatggggtttgccattctctatctgggtctcactggcacagacagtgctgcaagattggttccctcatgggaatgaaatgtttcccctccttcctccgcaggacaaaacaaggagaggccaccacctgttcccaacccagactatgaggtaacgtgggatagaaatgggccaggacgctggaggggatgtccctccaggggggaaggaaacagatgggatggcccatcttgtctgccagatgcctcaaagcccctcactcagggcttccattacaaccctctatgtgccacctctgcgtccttcatggtaaaacaggactgtctcaaaggctgcatggcttccacaaccatggagaggtggaagcttgcaggagacatactcctctttctctggcttattcattgactgggatacagccatggagaatattatatatgcaaattctaacacaataaattctgggctgatattccaccagcatgcaccagtatagcgagttattgaaatattaaaattatataaatattatataaaagttattgaaatattaaaatactcattgggaaatagccccaaactttgctcaccccaacccacccttacacacacacatacacacacacacacacacacacacacacacacacacacacgtgaccagacatcccagtccctcccctaccgggctgcctcttgagttggggtaacaaagagttaatgcctggcatggcagaggatcaccaggattgttctagttgattggtatgtgtgcactcctagttgttaaatattttcactatcacacctggatatactcaacaaatatttgttgagccaaatactcaacaccagccaaacacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaaga

SEQ ID NO: 1598 - DNA, 9439 bp, Homo sapiens
  source 1..9439: mol_type = genomic DNA
agtctagctgctgcacaggctggctggctggctggctgctaagggctgctccacgcttttgccggaggacagagactgacatggaacaggggaagggcctggctgtcctcatcctggctatcattcttcttcaaggtaagggcctactaggggtctggaagcctggggaagggctcaagggaagagcccatcactagtgagacaggaatattggtatccctaaccttcagcctacctctgctgtcaccttagagttcaaagaagggcaaaatggaggctcttaactgttctctgctagagagaaacagtgtcccatggaggagaaggaatccttgtctctgaaaaatgcaaacagagtacttaaatggctgaagagaggaccctgttaccgccatcttagatttgaatgcagcccaaaagggcataggccaagaaactaaaaggaaaaagtatatgttccctacttcagagctgggggctagcagtcgacctaggaaatgtccattcactcagttgggcagttggccaattggtcaacaaagatgggtgagaccctaatatgtgatatgccatgaggaaataaaaatgaataaaacacttatgctctacagaactcatagtctcattggagagattagttttcatggtgccagactgagtgtacagtatagtatgggtgcctgcatgaatactccattggactatccaataggaagtggatgaactgggttgatgcctggagtctggacatcctgggaaagttaaaaccatggaatttgctgaagtcacacaagtactatgtgaggaagagggagctgaagatggaacagtgagggcaccaattttaaggggcagttagagaaaaaaaaacattccaggaaagagataaaaggagaatcaaagagctgaaataatcaaatgtatgcactaccttggaaaccaagagagtagagagcttctagaagaagagaattaccaagagtataaaatgttaaagagagcccactaatataagaatatatttaaaagtttaagtctgcgggatgtggcagaatatgcatcatgggtgatttagcacagtttcagcagggtattgtgagtggaagccaagtgaaaattggtagaaggtgaaggtcaggtgatgaggtcagcaagtgtagactattctttaaagacatttggatgaggagggagaaaagactgggtggtaggtagaggaggaagtagagtctaagaataaatgtttttgagggtgagagaaacttgagcacatttctaggctaaaggagaagatgatgagtagagcaaggtcctggagttgatggtggaaggacagagtcaagagtggggtcaagagcacagagaggaaggcaacgttaccctctaagaccaggagaaaggaagtgcaaacggcactggccacaaataggtttataaagggaaaggaagctaaaggagaaaggacaataacaacttccgtgttctaaaaaatccaggtgggaggcaatgccacctgctgaaactgagctgggtgatgaccggttgggagacttgaagaggacagtgagagtttagaatagaattatttctgagagaaatgcaaggaaaagtcaggtaaagacaacacaggttgaggagcaactctcaagcctgggtgaggtggctgcatatcatggaaagagcatttgagttcagcagtagaaaacctgagctctggatccagcttggacaccaatgagctatgtgtacttgaacaactcctccactgtctgggagttctcatgccagccaatccagaaatgtggcagggacgggcatggtggctcatgcctgtaatcccagcactttgggaggtcgaggcaggtggatcacctgaggtcaggagttcgagaccatcctggtcaacatggtgaaactctatctctactaaaaatattttaaaaattagtggggtgtggtggtgggtgcctgtaatcccagctactcaggaggctgaggcaggagaattgcttgaacccaggagatggaggttgcagtgagccaacacggtgccactgcactccagcctgggcgacagagtgagactccgtctcaaaaaacaaaacaaaaaaaaaagaaatgtggctatatgaactcttaagtcctaaaaggaaacctcactcagatatgcaacattaaaagatgtcaatcagccaggcacagtggctcatggctataatcccaacactttgggaggctagggagggaggatcatttgagcccaggagttcaagaccaacctgggcaaaatagggataccctgtgtctacaaaaactacgaaaattagccaggcatgttggcatgcacttatgccagctacttgggaggctgaagtgggaggattgcttgagcccaggagcttgaggctgcagtgagccatgatcacaccactgcacttcagcctgagtgacagagcaagaaaaaaaaaaaaagatgtctcaaaaaaaaaaaaaaaaactatgtcaatgatcagtgcaatctccttccctgaatccaatttagaatgaggggtctctgtcttctctcggtcttctgaccaggtggtcaggagaaaaactagttagaaacctctttaactgtttgtcttgccttttctcccatttgctcatttattcatttgcacattcattcaacaaataaagttcctaccatgttccagacactgcactggatactgttcaaaaataatcccgccctgcatgaggttctaagacagttcacttcttgtatttccattatactttgactcatgaccgcctctccctatcacacacactccacctctagccacactacctctcttgtccttttccaaagctgcatcttattcagctattctttctactcagaatgactttctctatctggtatattcttgcttactcttcaaggcccagacaaatgtcgtttcctctattaagctttccctgatcctcacccttggacaaaattaatagcttctacccttttttcatatgcagtcatataagcactaaaagataatgtatacattctattaaattaattgcatatatgttttaattttttcacttcattcataaactttggaagcagcagttgattcttcatatcagcactcttttctttcataatatctaattattttaggtcataatagtcctcgttaaatgtttggattaaatctaattgaattgaattcaagtgccagatctctgtaatatgtctaccatgcaactctactaccctaaggttttgtttgtctgtttgtttgtttttatttttttgagacagctttaacacctaggctggagtgcagtggtgcaatcttggctcactgcaacctccacctcccaggctcaaccattcctcccacctcctgagtagctgggactacaggtgcataccaccatgcccggctaatttttttgtattgtctgtagagacagggtttcgccatgttgtccaggctggtgtctaactcctgggctcaggcaatctgcccacctcagcatcccaaagtgctgggattacaggtgtgagccactgctgccagtcaactctgagttatgagacagatttgaggactaattgaaaagctaacttccctgggacatccagggtttttataataaaaggatcaccaaggctgaatattttataaggaactcagcctaaaggttttggatagtgcacacccactccttgccagggcattagctgctcaagaagcagagtgttctggactggataggcaatatccttacttacatatactacaatacaattctgatgctaaccccccaaattagtgtcagaccctacaggttaagagcatggttcccaaccagattgccctcactttaaatgccagctacaagttcagggtaccccagaccactcacatttctgacaaactgcctgcaatcttaaggattcccatgaccctcctcattgataatttgctagaataactcacagaatttaagaaagtgctgtacttcctatttcagttttattaaaaaataaaataaaatcagaaccagctaaatgaaaagggcaaggtctaggagggtcccgaacacagagcctccgtgccctctccccgtggaattagaacacatcgcccccagcactctcccacactctgccagcacattgatgggttcaccaaccaggaagctccaccaagtttttattgaggtatctttacataggcatgattgattgaatcattggccgcttgactgatctcaatctctaggatcccttcctggggctgataccactagtttcaaagctgcaatcctcttaccatatggttggtcttgaccagcaccatcctgagtcattgccatgcataaactcaggtatggtctaaggatccaccacagataacaaagccactcctgtcactcatgaaattccaacggttagaaacaccctcccaggataccaggacaaagatgagacaaattgtttattatcaccttgaattcaattgagtgatttagtctacaatccggaaaactaagtatagatactaccattttcatggatttggatctttcttcatcttggcctcaaataaccatggaaatacttcagggcatctgaacaactccatgcccagctaatactctatctctcttctgtctttacaggtactttggcccagtcaatcaaaggtaggagaaatggcttctttctatactcagactcagaatattgacggaaatttggcttcctacaacagtagtcctacaggagcgaacagtttagaatgaatgaaatgacggggatagagaggtgatgtctctattgtcaaccaaatcagtgacctgacataacctgttccgggcagcttgcctgtagctaagcatttaactggtctcttacaggagaagcaggaccctagtagctagggacacatctcaaactgtgacccatgaaccagtaggtattggcgtcacctgggatcctgacgttagtctctgtcaatccttctctttagttcatctattctacccaaagtgatctcatcatctggtatgctgttagcagtttcttacctgtatagtatcttccaaataacatgccccaaaatcccaaagttttacccctactaattacagcaatgtctcttttattcttcaccccctgacgcagatattggcgtcacccgagagcatgttagtaatgcagaatctcccctccccagaactactaaatagcacctgaaattttaacaagatccccatgtgattcatgtgcacatcaaagtttgagaaacactactctaatgatctcctggtatgcagaagcagggagaatttcagaggcaagatccttaatagaaccacggcttttctcatttcaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaagtatgtaatcccctttggtctgtttgttgtgaaattaatcagtatttgctgttctggtgagctttttatctggggtgaaagtggaaatagatcctcaacagtaatattatcgcctgttctcttaatttcagcttgcctcttttaaaatactgtaagatacttccctcaccctattgaaaaactacagccagtcctgtaaaattttgtttacctttgggtgggctccatggattcaagcaattcagcactgagttgaatgaaggggttggggagacagaggtgatcataaggtgagcagcagtgagaactggagcgcagtggagcatgaagagtatctagtcttccttctgttccagatacttcctggtagttagactacatgggcttccccaggaatcctgggggacttaagagcatcaagatgcattgagttttggcgcaaggatcttcccttgccctgccacccacagaggaaaagcctgctgccctccacagcggcattattgcagacaggcaggagaaaacgaaccaggaaaaacaactttcgcaacctgaaggtttgtctctccttttccctacagtgtgtcagaactgcattgaactaaatgcagccaccatatctggctttctctttgctgaaatcgtcagcattttcgtccttgctgttggggtctacttcattgctggacaggatggagttcgccagtcgagaggtaaaagaatgctcttagatgagagatgggaccacctgagaccctcagctttcctcctaccattatgtacccaatggaagagactgagttggtgcttcttgctagtgtgcatagttgggtgaggctgtatttctctgagacaggagaaaggatacttggtgttatcacagcatgttcacctgtctcaagatacagctccctctgtgaaaaaaaaaaaaaacaaaaacaggcgcagtggctcacgcctgtaatcacaacactttgggaggccgaggcgggcagatcacgaggtcaggagatcgagaccatcctggctagcacggtgaaaccccgtctttactaaaaatacaaaaaattagccgggcgtggtggcgggtgcctgtagtcccagctactctggaggctgaggcaggagaatggcatgaacccgggaggcggagcttgcgtgagccgagatcgtgccactgcactccagcctgggcgacagagcaagactccgtctcaaaaaaaaaaaaaaaaaaaactattttaagtaaacccttacatacagaaaagtgaatcacaagcatacagctcaaaaaaaaaattcacagagcaaatacacccatgcagccagcacataatttaagaaagacaatattaccaatgccattgaagcccctcttgtggtcacttccagccactacccatcctcaagagtgagcattgtcctgacttctaacaacaaggattaactttgcttgtttttgtcctttatgtaaatggactcatatactaagtattcttgtgagtagcttctttcactcaacaacatgtttatgtgctttatccatactcttgtgtatatataaaactcttattgttatttagtattccattttgtgaatataacccaatttattatgcattctaccttgtgtggattctgtttcttttttgtgcagcttcagacaagcagactctgttgcccaatgaccagctctaccaggtaaggggatgaagaataaaagagacattgctgtaattagtgggggtaaatctttgggattgaggggcatgttatttggaagatcctatacaggtaagaaactgctaacagcataccagatgatgagatcagtttgggtagaataaatgaactaaagagaaggattgacagagactgaggtcaggatctagtgagcacaagttgaagaacacactgagagggacacacgaagaaactctcgacaggctgggcactcactatagacaggccatggctcatgcctgtaatcccagcactttgggaagccaaaacaggtgaatcacctgaggtcaggaattcgagacaagcctggccaacatgatgaaactctgtctctactaaaaatacaaaaaaaattaaccaggcgtggaggcgcgcgcctgtagtcccagctactcaggaggctgaggcaggaggaccacttgaacccaggaggtcgaggttgcagtgagctgcgattgtgccactgcactccagcctgggcaacagagaaagactccgtctcaaaaaaaaaaaagagagagagagaaaaagaaaaaagacagagcctccatctccttgtcctctttccatcctcaggaccatgaagtacccactccaaattctcacatataaaaaacattcaataaacatgcatcaaattaattaatagaggatggaaaaaatgacttatgactgtgctgtcctttccagcccctcaaggatcgagaagatgaccagtacagccaccttcaaggaaaccagttgaggaggaattgaactcaggactcagagtaggtgggttcttcaatgccaattctaataaaggacccttgcatcaactgccctcgcaattgcttctaagtctagctcccttccctaagcggctataagcatcagactctggggatcagggattgggacgtggtttggggtactcttttctaaaaattctggggccatactgattgtcttggcctaggtaaatatgaattttatgtatctgtaaatcctgtcagagcagggcctcaagccatagagatgctgaatattaatcttaacctacatttgaatttctcattatctacactattaacattttgggctaattaattatttgtgatgaggggctagcctgtgcattgtaggagttatggaagcatccctggcctctctccaccagatgctggtagattgtccagtgtgacaatcaaaaatgtgtccagacattaccaaatgtgtccaaacatcacctccagggcaaaatcacccttagttaagaaccactaacccatattaaccttccaatcaataaatcaatcagtcagaagttatgatttaattaatctatctgaagtttctatcaggaagacagggttgaaagcattatttgttttttttgaacaaattgcaatttttcttttttcagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgtaaaagaaaaatgaaaagatcaaataaccccctggatttgaatataattttttgtgttgtaatttttatttcgtttttgtataggttataattcacatggctcaaatattcagtgaaagctctccctccaccgccatcccctgctacccagtgaccctgttgccctcttcagagacaaattagtttctcttttttttttttttttttttttttttgagacagtctggctctgtcacccaggctgaaatgcagtggcaccatctcggctcactgcaacctctgcctcctgggttcaagcgattctcctgcctcagcctcccgggcagctgggattacaggcacacactaccacacctggctaatttttgtatttttagtagagacagggttttgctctgttggccaagctggtctcgaactcctgacctcaagtgatccgcccgcctc

SEQ ID NO: 1599 - DNA, 11479 bp, Homo sapiens
  source 1..11479: mol_type = genomic DNA
gccaaggctggggcaggggagtcagcagaggcctcgctcgggcgcccagtggtcctgccgcctggtctcacctcgctatggttcgtctgcctctgcagtgcgtcctctggggctgcttgctgaccgctgtgagttgtttttgccccgaccagacgggagttgggagtggggaatgagaaggaaagggaaggaagacttcggggaagaggccttcctggctgatttttgtgggggcaggagggtgggtgggagctgggcaaggtgcccccgctcctggctgaatggggtgggctgcctctctcttctcccgggctggggtcccgggagcggcctacaggggccgctcagggaaggcactggctgcccaagcgtgcctagacggcctggacgggtttagggagcctcagaggctggccacacagagactggtagggggttcagagggcgggaagtgaggcggaccaagggaaggggcgggtctggcccgtttcctgtccccttcttattgtggacagatgccagcctctgtaagtagttatcatctccttgccagctggggctgccttcttccagggcatcttgtgggaacaagagatgggtgcagaggcccaggtacttttgtgagaaggcaaggagcttttaacatcgccttccaccccgaaccgtatcttgggtgttccaacctaggaggaatccccagggctttgcctttttctcctgaatttaagatgacataggagacccctggggagatgaacagtttatgggacacaataaagggttaggagaccagagttctggttggctctgacagggctggtgatcagagggctggagaaaccaggggtttctccaggcaccagaggggctcagagccaaccaagcatatctccgggattttcagaagcctacacttgactcactttttgtttaaatgtatttttgtagttcctcattctggaggctgggaatcccccaagtacctggctccttcatcccagcccctctggcctccccctactttagagggctgtagattcctgcctgaagcctgggcaggaatgacccatggtatcaaggaaagcaagggaagcagcaagggaagagagggagtggggaggctgctttggtcccacagctttcactttcacctgaagcaatggctcttagggaacagggaggcagggggagggcggagctggaaagaggtaaaggggggcccttgtggtaggagtggagaaagagccagaggaggtggggtgaagggtgtgatccaggcttctcaagagcagagtttgccctcataactcccaactttggctccaggtagaggctgggctgtgacaacaatgtcagaagctatctattgagggcttcttgtgtgtcaggctctgagccaaacactgcctgttttctttgtctgatttctcacaactcccccattatacagatgggcaaattgaggctcagaaagggggattgtcttgccaaaggtctcatagctagctaatggaagaacctggttgtgaatctacatctgcatgattcccgagcctgcctctcagatagtgagagtctccaagctctggtcctgagctgttttgtggcagaaggaccagaactatggggagtgagaactggagattgacagacttttaggggagcgttttatttctcatgtgtttgaagatggtatcaaggactttcctatctttgggagtgtgggagctccacgttcacaggatggtgtcttgcaatgagctggtggggggcagtagccttttctacttcctttcccattttgggtaagacacatttctgtaagtaatttgctgagatacccaggttgaatgagagccaccagttaggtaggattctggacagccagccaggtagccgggctgcttgccatatatcatgcaagcagaaacaaatgaatgatgattaaaattgccatttaatgagcacctactatgttcctgacactgtgctaggccatatacatgtattctttcttatcttcgtaatccaacctgcagggcaggcattattactcccattttagagatagagaaactgaggctaagagaagcaaaataactagtaagtgttacaaagtcaggactggagtctaaagctgtctgactctcaaacttgtgttcttttcactggctgttcccaaactgtgggacagttttaaggagcacatggacatagaattaaacatacacttactttacagttcttttaaaaatccttctcattttttcaaagaggaagtctctggagctagaatagagttaatgcctctcaaaggcttgctaatccttcttttaaaacaaaaatcaagagcaggcctgggagggccttcaacaagcaaacaaccagctgggttttaataaccttgttttgtttccccagaatttatttttagggttaccttttatttatgagaagtgatactggttcttgtctcttggcaatgatgtgaggtttacatttaaagtaaatgtaccggccaggcacggtggcttgtgcctgtaatcccagcactttgggaggccaaggcagtcagatcacttgaggtcaggagttttagatcagcctggccaacatggtgaaaccctgtctctactaaaaatacataaattagccgggcatagtggtacacacctgtaatcccagctactcaggaggctgaggctggagaattgcttgaacccaggagatagaggttgcagtgggctgagatgatgccactgcactccagcctgggcgatggagcgagactctgtctcaaaaaataaaataaaagtattgaaattaacaataagtaattaatagcatgggtggtacctggatgtagtaaaatggtgaagatgaaacacaagttgatggagagaggagcattgagacctgagttctcatttggactctgtcactgtgagactctgggcaagtgaccctcctctttggtgctcagtctcaactatctgtaaaatgaaagtgtgagtttacccttccagctttacattctagcattttatgagggaagggctggatgaacagatgatgaggagttggaggaagaaaacatgatgggctttggaaaggagcaggaagggaagcagaagaataggaggaagaggccaagtgctaaacatagccccaaacagcactgggaccagctgaagtcagccagcttcaggactccaggggagctgctggagtccccatatcctatgggatctttgggaagaggaatgactcaggcatcaagccccaaggaattctgttctgttcagagaatattgtgagtttacagtaccattgctttgtaaaaataccagaatgattctctgggtgcgattataatcagctcagttgacaatttacttgaaaacaaacatgccaaatatcatgcaggttccactttctgttttgacttgcacttcagtttgcagcctctgtcctggatgacttttacctttctgctgaagaagttgcaacggagatttcaagatcccttcaaattgcacaattctgtttttaggtccatccagaaccacccactgcatgcagagaaaaacagtacctaataaacagtcagtgctgttctttgtgccagccaggtgagatgccaaccctctagccccatcatggagtccccctttgctttggtggcagacgcagaccccatatgttaactgtaaactcaaatctgaaacgacccatttcccagccctgcttcactgtcagaatgttctggttccctctctaccaggtaaaactctgtctaccctgaactagggatcccagcttctccatcttcctcgcctgattatgaaggatccaagactttcatctttgaatcccctaccctaaagcctggcctgatcattgtgtggttagtgtctgactcatggagttggccagagccctccctcatttcctgatgttttccaggacagaaactggtgagtgactgcacagagttcactgaaacggaatgccttccttgcggtgaaagcgaattcctagacacctggaacagagagacacactgccaccagcacaaatactgcgaccccagtgcgtgcgctgttgggaaagggacgcttgggaaccgggctgatattcccgacaatgcagccattctaattttatgtagccagggtctgctctgattggttggagtccgggctgtactgatcattaaatgatttgattgccatctctacttggaagagggtctgaggaagaaagagcaggcaatgtggggagtgaggctcagagcatggcccagcagggggttcccatccttcctgcccttctcttctcagacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattggtaagtggctcatctgggaatcagttttggagggggacagaggagcttagggcccaaggtgaggggctgggcagtgggcacttagccccagaggcagaggaagcagaggctccaacctatgtcggtatccccactggagtgagctgcagacgggaccttgttcattctgccttctgccatggggatctgcctttgaagggcaatgggagaagtcctcctggggactgcagctgtcgggggcagtaccacatcgggggaagagtgctcaaggcaggagctcttcccgtcctgcctggccactggctgccttgtgagccggacaggtggtccactgtgatggttaatgtccccctccccacccactcccagctacaggggtttctgataccatctgcgagccctgcccagtcggcttcttctccaatgtgtcatctgctttcgaaaaatgtcacccttggacaaggtataagcactcatcccttgtgtttcctgctctaagagtggcatggagctgcctccattctctccagccacctgtcctgtccctgctcccagaggtccacacacactcatgtacttgtgaagcatctgcagagtggcctcatggccaaccagacaggcacatttccacattttttttgcctgctgtctctttgaggtaatagacactgttgatctctcgcttcatgagagcctcctatcttgggggtattgggacacttattttagctttccttctgcccctcctgcttctcctcagttttcctcgtcttgctttcaccttacctggctttctagggctttctgggctctgggtgctcaccctgagggcctccctctcttacctccaactccaaacccacaccaggtcctgccactggctgtctacgtgttttgggaacttactgtctccactgttgtcactttagtttgggcctcatcactgtggtctgggtgatgccttttctgcctcctggcctccctgcctctgtctctcccctcctgctggttctgtctccatcctcttgccaacatgagcgttcgacagtttctttcaaatcatgacactctcctatttgagatgcttcctgtctctctgttggaactaagactccttagcatggcacccaaccttcctgttgcatttcctgctctctttcctgcatcgcatagcttcatgctacttgcaatcctctgaacacactgttcattctcttccatcaaactcatctgcctggaataccttaaacatgggccccaggccaggcgcggtggctcttgcctgtaatctcagcactttggatgccaaggcgggtggatcacttgaggtcaggagttcaagaccagccagcacaacatggtaaaaacccatctctactaaaaataccaaaaaattagctgggtgtggtggtgggcgcctgtaatcccagctcctcgggaggctgaggcaggagaatcacttgaacccggaaggtggagtttgcagtgagccaagatagcgccactgcactccagcctgggcaacagagcgacattctgtctcaaaaaacaaacacctgccccattaactttttgcatttgatttttaaaaatgggcaagataggcacatgggacagaaggcacaaaagagccaaagtgatgtctttctcccatccctgccccttaggctcccagttctttctggagggagccattgttccttgcatatccttccagagattctacatataaacaaaccaacacacacacacacacacacaaacacacacaaaatttccctccttttacttttgcacaaataggagtatacattttatttgttaactgtctgcctttccctaatagattgaaaattccttaaatgtagaaacttggccttttttttttcttccattgatacatcccctatacctggaacagtacctgacgcatggtaggtgcttaaatttttactgataaatgttgactgataactggaggcaccactggtatagtttttttttttttttttttttttttttttttttgagacagagtctcactctgtcgcccaggctggagtgcagtggcgcaatctcggctcactgcaagctctgcctcccaggttcacgccattctcctgcctcagcctcctgagtagctgggactataggcgcccgccaccacacccggctaatttttttgtatttttagtagagacggcgtttcaccgtgttagccaggatggtcttgatctcctgacctcgtgatccgtctgccttggcctcccaaagtgctgggattacaggcgtgagccaccgtgcccggccaccagtggtatagtattaatggaatcagtgcattggcttacgtatctgattacagctcagtaagtgtgtgaccctcactgagcctcagtctcctcatctgaaaaatgggaatgaccttcatttcacaaggcttgagctaaaaacatgtaaagtgtattgtaaattcctgaatgctctactcatgtaagactaaagtaggccgggcgtggtggctcacacctgtaattgcagcactttgggaggccgaggagggcagatcatgaggtcaagagatcgagaccatcctggctaatatggtaaaaccctgtctctactaaaaatacaaaaattagctgggcgtggtggcgcacatctgtagtcccagctactcaggaggcggaggcaggagaattgcttgaacctgggaggtggaggttgcagtgagctgagatcgcgccactgcattccagccagtctggcgaaagagcaagactctgtctcaaaaaaaaaaaaaaaaaaaaaaaaagactaaagtacatggtttcttcaaagcttctctctctttctcccaccttagatgatttttcctttgcaatgtcctgtgtccattccgccccactcctcctggggccacctggaccaggtcttcatcatctcatatctatatgtttgctgtgtctcctggctggccactcttctgtaatttctcctcctctgagctctctgggcagctgaatcttctcactagtgaagtcgcctggttggatgctgatgagactgaccagctgaatccagttgaaaacttcacacttggcagtgatctggttctaaagacacaattttccatagtttcctaacaccatcctgcatgccacctgccttatttccccacatcacatcgtcccacttagcgggactgcactgctgatccaaattttacatcctttagggcccactcaggtcatatgtcctcagggaagtctttctggaagaaccttaaaccagaggttctcaacagggggcagttttgctccctgtggaacgtttgccaatgtctggacacatttcattcgtcacaaacggagagggggatgctacagggatctggcggatagaggccagggatgctgctgaacatctgcaatgcataggacagcccacccccacccccacacccccagtaaataatgatccagcccaagtgtcactggtgctgacgttgagtaaccctatcttaagctgaactcatcatctctccattccagccttggtggattctgtctcctctgaaccattcccatctcactttagcctacctagatcacaaagcttggcactcattatagactcccctatttattactccttcaagatgtgcaagaatcttttctctgcacttttaagttctgtaagaagagtctgtgtcgttcctataataaccagcataggacgttgcacgtgttgtgtgctcagtgaacctggatttgttgattgttgactgactcactctagagttggaaatcttatgcttggggaaacttaatatctctttctttctctgtgtgtgtgcatttgtgcacgtgtctgtgcatagctgtgagaccaaagacctggttgtgcaacaggcaggcacaaacaagactgatgttgtctgtggtgagtcctggacaatgggccctggagaaagcctaggaaggtgggaactgaagggggagatgaggcacacaggaacactggatgggaaaaaggggaggggaggcagtttgggggtgtggtatcacagctctgccacttatcttgggagtctgggcaaatcacttcccctctcttagcctcagtttcttcatctgtaaaatgggatgataacagcacttccttagtaggttttgattttagagtgagaaggttggcctacagtaaagatcagataatgtaaatcagtgaaaaaggtcaggggtaagaaaattacattctctttacctaacgctaaatgaccagttaatgggtgcagcacaccaacatggtacatgtatacatatgtaacaaacctgcacattatgcacatgtaccctaaagcttaaagtataataataataaaatttaaaaaaacgaaaaatacattctctttgctttttctcaaaatgtactttcctctttgtagggctgggactagaatgaggtgagcaaggcacttgccctcgggcgcaatatttaagaaggtgccataaaagtgtagtaatcaaggtaaattcattttgatgcaatatttttaaaaataaaaattaatgcaaagaaatccatgatgagcaagatagcaacattttaaataaagaacaggatccgaccctgtgtttgcatgaccctgcctcactcacctcaccctaatcctggccctggttccagtaaaaggaataggcagccagcctgcaggccgtagtttgctgacttggtgtccgcctgatgattttcaaaatatggcattaaaagaatgtttaccttgatgactgagtgttttggacatccttttcaattttgtcctgaaacaatttcatcccttgcctcacgctagtctccgccctgccttttggtctttcttttattttcccactttgaaaaaaaaattcggcatgagaaatactttacctttcccctccactcttctataccaaaagcaacatgcagacatgaatcatgctagacctcggcattgggcagagagcagggagtggcggggagcatggtgagcaggtggtgacagccactgccaccactcgcttctagatggttcccaggtggggaggctgccaactggaacccagtcttcccagtttgtaagagaaatcagatgtctaggtttgaatatgtgatctcccagtttaaaaatgtcggcaaatatttccaaacgttaagaaaatgttctggctcctttaaagacatctgccagccacatttccccaaggaccgcggtttgaaccttctgatgtagatgagctctgacattggaagattctggagtctgacaagtcacagcaggttgagggtagggagaaactgcaggtgaggggtgcatgctgaagtcctgatttctccaggtccccaggatcggctgagagccctggtggtgatccccatcatcttcgggatcctgtttgccatcctcttggtgctggtctttatcagtgagtcctcaggtggggaggtgttgggggagggaggggagaccacctgtttcttatctggcctctccaactccccatcctttttttttttttttttttttttagaaaaggtggccaagaagccaaccaataaggtaggtcacccctgagaacccgggacagagttttgacaaactgggaagatggcctcacggttgcctatggggcagtaaaactgattcagagtctgtctctgcagccagtggggtggcagcagaattggggactgtcatccccacccaccatgctccttccatccagagctcaatcccccacagaactgcccctggcaccactggcagagcctaacactggctgttcttcactcctttcctggcattcaacgcgtggggagctgcatctttgggccttggggctgggtcaaatgggtgggagcaaatgtggcagccccttaagcccactggctcccactctggaagctcttcgtcgcccttggtgtggccagcagggggcaggaggcacccgaggaatcagcactgacccgccgtctgggaaaggggggagggcttggggaagggatccgcttcccagggaggggctcctcagaggcacagctgcccctgctgctgggggtgacctcacaccttgcctctccaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgctgtggcgtgagggtgaggggctggcactgactgggcatagctccccgcttctgcctgcacccctgcagtttgagacaggagacctggcactggatgcagaaacagttcaccttgaagaacctctcacttcaccctggagcccatccagtctcccaacttgtattaaagacagaggcagaagtttggtggtggtggtgttggggtatggtttagtaatatccaccagaccttccgatccagcagtttggtgcccagagaggcatcatggtggcttccctgcgcccaggaagccatatacacagatgcccattgcagcattgtttgtgatagtgaacaactggaagctgcttaactgtccatcagcaggagactggctaaataaaattagaatatatttatacaacagaatctcaaaaacactgttgagtaaggaaaaaaaggcatgctgctgaatgatgggtatggaactttttaaaaaagtacatgcttttatgtatgtatattgcctatggatatatgtataaatacaatatgcatcatatattgatataacaagggttctggaagggtacacagaaaacccacagctcgaagagtggtgacgtctggggtggggaagaagggtctggggg

SEQ ID NO: 1600 - DNA, 11479 bp, Homo sapiens; identical to SEQ ID NO: 1599
  source 1..11479: mol_type = genomic DNA

SEQ ID NO: 1601 - DNA, 12214 bp, Homo sapiens
  source 1..12214: mol_type = genomic DNA
actttgacagtcttctcatgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaaggtaagatgaaccacaagcctttattaactaaatttggggtccttactaattcataggttggttctacccaaatgatggatgatggtagaaaccaaatagaagaatggtcttgtggcataatgtttgttgcctagtcaatgaagtctcatattcttgtctctggttaggatcttgggatctggagtcagactgcctgggttcaaatcttggctctgcccataccatctctgttatcctggggcaagtgcctcagtttccacatctgagaaatggggatggtattggtgtccatttcatagattaagtgagtttagccttgtaaaaagcttaggagggggtctgatacatagtaagcactatgtacgcactagctataattatttgctaaagttctgctttaaaagtaagctatttttttatggagacagcttttttcttttaaatttccagctaggcaagaagagcgtcaatttgatctaaaatttcataatgcttcagattaacatagacatggataagtcccagaatttgcagtcttttagtaaaagtagcattttctgtgtaattcttcacaagcactgattgtagttgcaggatgctcagtctccctctgagatgttttacatttttaaatggttagacttgcaggaacaaaagagcagagtaacttagtaggctgttttgcattcttaggaaaagaaaaccatcaggacttattttgttttcatgtattttttcacttccactgaggagtataattggctggtgttgacaaaataccaatcatagatgtaaaggagaaagttgattagttttctggctgttcctaaaattctggatgcaggaactgtggctagaaagcatctggatgattgcactttatcagggatacttgagtgtcctctcttaggatctggacctagaattaatgtcatgagatttttctaacaggataaggtgaggtagtgagggctgaagtcatccactgggttatccaaatattaggtttcactgctgacaaaagagggggcttctggtctggttggttatttgtgtttggcctgatgtgctctgtcaatcaaatgtatggacataggcctagcttctaaaggggcaatagtgacctcagtggactgatatttaccgtactatttacatgtgctcttaattacagcagaagctgccagctaactgaatcttgttttgaatctaaaaaatctactcttaaagcaagaaaatggtataaaattagttgataatgcaagtgaattctgtacatttaattattctaagacattggaaaataaaatatcttgttactttgaggataaaagatgatttctttaaaaatgcaaatgttttctacaaatactaaagttaaaagggagagagatgtaattagaactcgttaactgacacattgcaaattaacttctttttataaagcactgcatcacaaacactaaaatgaagtgggcaaattagctctgcagaaaactattttctaggctgatgtttataatgaccaatcattactgaagcaatgagaaatgtgacaattacagaatattgctgctatagtatgttgaaaaaatatgcattttgtagtgaacatttagtagaatagctctgatttctacctggagtttctgataacatgacatcttaattgctgtcttttatagatttttaaactgcaaatacaaaatagcaatcagccaatataataacttattattctccatttatgcctgaaagtcctcctcttgttgatgccgtggaaatgaatgtagaggcagatatcattagctgtattctccttccgaatgacatttatcatatccttgttattccaaaatagatagaagatgaaaggaatcttcatgaagattttgtattcatgaaaacgatacagagatgcaacacaggagaaagatccttatccttactgaactgtgaggagattaaaagccagtttgaaggctttgtgaaggtaagcagcttaattactggtaaaagtgtcattgaaatattttactacatttgctagatcgggaaactgacaatgccaatgtttaaagattggttatagacacagacacacagacacacacacacatatatatgcatgcagatatacacacatacatgggtgtgtgtgtgggggttaaaaaaaaaaaacacaaagacactctctggggaaaatacacccttaggggcacagtcacacatatttgtcagcttacatatgcagctaccactaggcaaaatgatgaagtccaccaagcttggtttttgcattgctgtgtctccccatccaaaccttgatgctctcgcactggggacccagagtctgatccccatttcccagggaagcaatagccgtcaacagctgccgtggcagcaggccacaagtgaagggacacctgaagactggtaacagtctctggtgcttctctgatgatggaattttaggtgtcctgacagtgagatctttcccttttactggggagagaggtgcagggaataagtaatagacattctcagtgtcgctcaaaccagactccatataatatcacttgctcatgaagcccgcccactctatggccggtcatgaccagaggcacagagggttcaaagccttttagcccaccaggctggtagctagcatgaagtcactgcagtgactgtggcttataacagatacctaaaacaagaatttttagaacctttacattaattccatcatcacagacatagggtctaggggctctttctcctgaggcagaacatcaagagttctttctgcctatgtccctttcagaacactgagtcaaatacccttgggcctcggctcacttaggggtcatttctaggaggcagcactccacattgaggacagttctgggccaggtgggtgggtatctgggtaaaccaacaggaattagttctcacatatagatgatgtgtaatttaatgcaggcgtaaaagggttaagatcttatttctgatcttatttctgccctcctgtactgtcaccgaggtgccatttaattcattagtgaagactctaacagcttattcctgagtcacctacggagaacagaatgtggctcaaatccgctgcttgctttcaggttctttacactaatctaggctttagatgaaactcctaaaccctttctttgcaagactggccagctaggaaaatgatttgagtttcttcggttcttcgaggatttgggccagtattacagagtattggaagatgttaccagtttaaatgtgaataaaggcactttcaaaacaatggctaataatccaaataacagactgaatgtgcttggctatgtgactttgggtaaataacttcacctttctgggcctcagttttgtcatctataacatgagaagacagattatctgtaagggcactatcagctctgacattctacaattatgtgataagccttcagttccctccaatggcagtgagagtggcttgtcagtccccctcgtttcttacggagacttttacggttgaattgtcaattcctcacgtcattatttcaggttggctatgtatgtaaagctcccaaaatcagctaccgaggataggagtaaagaaaacagtcagtttggcctccctgcttatgcttgtatgaaaaaagtgacagctccaaagtttcatattcttaaaaggcagatcttctcaggcatgtcagccagggccccagggatctcctccttacatgcaactaaggaggctccttgtctctactgcagcaggtgtggaaccctagtcaacaccacctatacctaggattacgtacaatgagtagatacaaagtcctccagctacccaatcctcccccaatgacggatcccctttccaatacgctttcccccaaatttctcaccctaaaacaaaattcgagactttgaaaaaactcaataggacaattatagaatagctccagattagattcatattttcttagctaatgttagtaggctttctttccgggccacagtctggctgcacctaagcaacctcaagtttgaatttggagtctttgaatcaggtcttgatggggtcttagaagtcatcagatccaattctcaatccacaacttcagtcttctctccacctcctgactaagtggtcatccaatctctgtttgaacatctctagtgacaaggaactcattatctctggaggcaggtagcactaatctgtcattttgggggaaagatggtattcagggctcaagtgagggtaagcagaggtattattttgaatagtataatttcatattaaaacttacaacccaccacacctctgctagatgttcagttccatgattatttgcccaccaatgcctgcgatgcctttgagagagccaaagcatttctatttcaagttaaagggcaacctgtccatacctgccacatggaactcccactaagagagaaataacccattctggattttctgaaagtccactttaaaaagtatttcagttgaggtggggagtgaagcaagaaaaaaaaaaggctctggggagtgtggttgggcgaaagttcacggaaaggctaggctgggctcatgaaacacgagctttgctgacttcatgttttcatcttggccaggcctcaacaccaatgcaacaacttagcctaaaagtatctcaaccttgatcaccacactctactttttgaaaagacactaaatagtcatttgtttacttgtgatctcacaaacattttcctgtcaccacatcttcatagtgccgcgcttcagctcaaatggaaagttgaagctctggggcccatgtgagtgttctgaggctcaggttcccctggaggctctatgaactacgcccttaaatctggcaactgagctgggcctacagccagcactcaacagtgacagcacaaattccttctggaggaggaaataaaaggaagggtcctatagacaactgattccaggagtgggaaggagcacaggactttgattatcataagatgtgaaaatactactgtcttcttcccttgtgtgcagaggatagacagatggaattagctaagcccagcctatgaatgccatctcacagtttccactcttggtttaaacctcagcttctttgggtgacctcataatgaccagttaagccctccaggccttttgttcagtctctttaaaatggcagcaacagcctttatcatcttccaacctgtgttgatggaagttcctgttagcttctttaaatacctctagacttccttcagtttataagtgaaaagaaaccttttaagaagtgtcgcacttgcctttgaacatcaacaccattgggagatggcctgtgtttccgaaatgctgattattctaagtaaatacagtgcaactatcaataagagaatctcttcagcccattgaaagggatagcaaaattaaaaatgtctgagggtcttttcatagtctggcatttctccccaaggtcaaacttactattatcttttcctacaggatttcagaccaaatttattctaatagatacacaccatgctttatgtttaataatattccatataccagttcccagggtagaatcatctccccattcggcattatttgtcaatatctgtcaaagccaaggaggttgaggtcataggaagggtcaggatcacagcctctggtctggagagagcactggaatggagataataaggcctggattttacttccagattctcccctgggctttctgggttgttggctcatctgtcagatccatggactcccaattggcatgatggaattaatgacaggatctgagtctatatgataatcctcaccagaaacagacaacagagtaatgacagatgcaaaacgaatgataattttaaaaccccacagcagagcccctgtcaaaatgacctcttgcaatgcttcttattttaggatataatgttaaacaaagaggagacgaagaaagaaaacagctttgaaatgcaaaaaggtaggtttgctatttgctaatttctatgaatgcctaaaaactaaaaggaagctttaggctgatcatattgaacaacccagtgttgttgcatcagggaacttttagccctggaaataaaacaggaacacaattgtcaaattgacaccttctctggtccctgtgatttggaaagactttgtacatatatatttatgaaaaaaggatgtgttcctttaatgccgatgataccaaatctgaagaaatcccattatgttcaataccttaatagaagcaaccatacagcctgataccacctacagtggaataagaagacaggaaagtcatcatttggtaacagtggcattcatcactcattgataacagtttttcatggggcacagtggccggtggagcctctgggatcaaggagtgacaatgtcacagtgttctattatttgcccggttcttaaagtgagagcatcctgaacatctcagggttggaagagaacttgagagttctcaaatccagcaccatccccacaacaaaaatctccttcacaataacactgaccgtccagcctctgatcaaacatgtcgagggatgaggcaccttccacctcataaggcagcctgatccgtctttgaatggctctaataataccaagattactatactactccagagaagtctttcctcctcaagtcaaactttgttcctataatctccactcattggtcccagttctgctctttgaggccctagtaaacaaagtataattgctctcctacccagcagctgtccagatatggaagacagcaatcatggtggccaagccttgactgagctttttcttctccaggctaaagatccctgatgtcttccactgtttctcctatgaccctttccaggacctttcttctgccactcacctccttttcttggacacactaacgttttcctgttcttttagaatgtggcatcgcaaaccaatacaataatgcgtgaagtgacttcagcagcagattatgggaaagacggggtgttgttagagagaattttatatcacaaagttggtgaacatgatgttatggcttctgcaaatttaatacacacaaaaacatacatacatacagggatagagatactattttctgaggcaaagagagtactcagaccttgccttaactgttgttctggatactaaatggtcatccgacttccatgaaggttttatcttcagaatgactgcaagatatgttgagtaatagtaccacgctgtctgttaattacagagaaatctgaggaaacagtttatgtagatgctgcctagaagtcttcagggaaatgataatattaaccaaactggtcatttaggtcatgcaatttaactcaacatttatagggcacttacaaagtgcccaatatcaggctcataactggacaaaaagaaacttccacacagtctctgcccttagaagattgacacatctcattagggagcagggctttaacacaagaaataattaaagacagatacaatagttcagccagttgcttgaccaattcagaaaccataagaatcttactaagtgtgcagactttggagcccactaaaatccccagtgtatggagttgttcctaaaagcaagattcacggtatgtttaatgaagaccagtgtttttagcctgtgtcaatctatgcaaaatggaatcgagtattgatcaactgttaggagaatgagaccgatggaaacagccaattcaattactcagatattagaaaccaacttttccttcagtgggagagatgtcagaccattttatctttccttttatataatctatttttgcacagtctctattacacagttgtagaactggaccagatagttttgtgggcagtttttgcattattttagcctgacagtttttggttccatttcaggtgatcagaatcctcaaattgcggcacatgtcataagtgaggccagcagtaaaacaacatctggtaagtcacacagcatctgagcggtagccacccaaggggaaaggctgggatgccgaagtcatgttacctaatggttaaactcctcttttcccctgggacccaatttacaaacctacccctacacttctcctattcccttctttgtcttcaaagtgagttcaaatgcacagatgggacttagagggacaaaaggaggtggaatgcaatctggatgttctcattatgttcttgctcaatggctgattctaaatgatgaattactgggtggagggaccattgttctgacaacatagaagaaatggcatgtagtgacctcctgactgggagcatccctcctcctaacccatcttcactgtgtggaaatgggcctcatggggtatttcctgccatctgtcaatccctgtatgattaagctcagcctcactgaggccaacctcagggaaagtaaaggtaaaatcattctgtaaagatcaataggtcccaagacgttacattttccaatgaagtaacaacagacgacatattgtgatcttttcaactctgaacgattttatttccatatacgttctgccaccattctagcctttagatattttttcccaaatgtgcatcttgcgataactggtgccaaagaatatgtcgtatctgataaatggatggaaacatgcacgctaacataaagtctcccatcaacataaaggcaagagcgtcagaggagtctttgaaaaattctacagagtgctccggaatggagttctaagcagtgcatgtgtgtgtgcatatgtgtatgtgtgtgacagggagagaaagagagatggacagagagagaaaaaagacactgcttcatctctgaagtggcttgggcttctcagtaggcgtaacacatggacagttatcattatcatggatcatggtaccaaagtaagagcactgaatagggagtttttgaacactgggattcaaggaccatgaccactgcttgctgggtgaccttgagcaagaccctttacctatgcagcagttttctacttcacctactttacagggtggctttgagcatcaaatcagctaatgtggccgaaagtgatgctgtcgagtgctgtacaaccgtaaggtgacactacttagtttacttcaccatggcttagatgtcaaaagggtgacataaagcccctcactaataccagttagttacacaatatttaataattttgtcaagtaccccttctctcttctggatcagatgacaacaacagagaaatctcctagaagaatagcttcccactggtctttttttgcctgtatctaaacccttgatcttggatatatttcatagagctcagattctcccaaaaggcttgtaatggatatcagtcctacaatatcttacagtctgcatcacaataggtttccaggggatcagatgggaagacagtaacattccacccccaccccagtcccaaacctcttcttcctacctagccatgctgctaaaatcttgccctacatcccacagcaagtactaaaattaggtaaggacgtaccaaagtaaacttactgaactaaaagattgagaacctgccctttttttctcaataaaatggttcaaaagggcaaacattctaatgaagcattgtttctggagtggtctggagggcccggatctgtcaggcatttcaggatgcctccctattagtaaagggcgagtcttaccaggtgggatcttgtgccctgatagacctaagactatcgaataggaattattttttaaaaagctcaaggaagcaaacacatcagtactttcacttttcctcaaccctcacccccatcagtcagtctagctttctgtgggagctgagatttcaagtcgggtgcacacactactttgaacccactcaacatctcagccgagaaaatggcacactgttggtgggtactctggcttagccacaagaatactggtactttcaagttggtggcgcccactacaatgggagatcaaaacataccgtgaaatgagcacacagtttattttcatacttccttgcctaattttagtccttgctgggggaggcagatcaggtttgcaacagcatgatcaggtaggaagaaatggggtcttttctctgtgctgaggctgagctaggtagactgacaactctctgactttgtaaaattcaaggcaagcaaggtattcatggtaatattagcaaaaatttggtccgagtaatttggtatgtataatttatgatgtcaaattttgaaatcatttgtgccttcttaagttcaaggcaaattggctataagaactctaacgagagaaagaaactcactgtgatctcttactttatttaatcttcacaagtctctgaaatatgctccaatatgagccccgtgttgcagatgaggaactgaagctcatggagatttagagacttgcccaagcttaaatagagcctagattggaacatggctctgtctgactctgaagcccatggaaggggccttgagaatccatccctatacaaagccaatatccaacattaaactatattttttgtcagaatgtgaaccatgctctgcttcacctcaccacaaactttccctttctttgtaacagtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacatta

SEQ ID NO: 1602 - DNA, 39495 bp, Homo sapiens
  source 1..39495: mol_type = genomic DNA
agcgagctcctcctccttcccctccccactctccccgagtctagggcccccggggcgtatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgagtaggggcccggcggccggggaagcccctgggctgggtgggaggtccaagtcggtctctgagacacgcacaggggccggcgacttggcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtaagttcttcatctttttagaaaagttctgggaatggaatgtatcttaaatttatttttatatacctttggagtgactagtaattgatagttctctagcgttactaaaccccagggtataccctgttggcacgtcacactccagctaattgaagacatttaccaccctgagtaggtcctgctgcttcattaagagtttttcttcctaacactgtacctcttgaacgaactagtagagaaaataaacaataggtattgtttagggagtaaacatataaaatatatttggcaattgccttgagacacatagcgtaaatgatatgttttcttaagtattttataaagtaggacttaccaaatacaactctgtggtggcatttttaaaagctctcaatatttacttcaaaatctgttatacttgtacatatttatagggtacatgtgatattctggcacatgcatacagtgtgtcatgatcaatcagggtaattggatagccagtacctcaaacacttggtgtttgtgtggagaatattccaaatcttctcttcttgctactttgaaaaaatatatgtatatatataaattgggatatatatatagggagagagatatatataattgggatatatatatataaggagatatataattgggatatatataaggagatatatatagggagagatatatatatatagggagatatatatatatagggagagagatatatatagggagagagagatgtataaactgggatatagacaggtagataggttgattgttaaaaatgaataagaggcccagtgaagagttgtttgggggctaacacagtaaccgtgtttgatactgatacctagtagaattaaaagaaatgaagatttcttgttttaggtgaatatacatacagtcatccacaccttatgtgccctttgatttcataaaatatatattggcattatcttggaggaaaaaaatctgttacttacatagccctgtattagctttgagatatatgagtagagataaagataaagagacccgataacctgactttgaacaacttaaatcaatagaagctactgtaaatacagaaattggcacaaatacctttagaagccatgcgtgaaataggctttaactttttatttttatccacaatagaggcagtaggatgaagtacatagtctttgcacatgtatcatgttttaactcttccccatgttattactttatccaatcctccaaacaaccttatgaggtaagttggggctcttacactctttttatggcggaggagacagaccccagtagtttaataacttcctcaagagcagcagcttttacgccaaaaccaaggtgtaaacttgggtcttctgactacaaatccaatgatgacccttccacttgaccatgcctctctagattcacatttgtgggcaatctgtttacagatgtaaatactttatgtatacaatttgtgggcaatctgtttacaggtgtaaatactttatgtatacaattgactcatccttgcccccagggctcatgggaattaaatgagtttgtacgtaaataaatattagctgctattattgttgtgcaggacattagtccaggggtctggaaataccctattcctgtactgtatggtgctgtgtagttctttagggcagggtaaggaaaccaacatttattgaatgccagaactgggccaggcaacttaaatttttttttttttttaagtggggatagtgatatgtgtgtaccaactctacttcctaagcctctagtaactaggaaacaaagtatacatgtgaatacatttgctacattgcaagtgccatggtgatattaatatagttaagtactaaatatgcgcaaagcagtaaagaaagggggttattagggtccagataattaaatatagattataaaacaaaaattgatactacattttttgttgctgcttttgttaatacttttaggtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaagtgagtaaaattttttaaagtattttcaaccatctggtgtttgggggaaatagtatcccttccttcattcatgctagaactctatgtgtatatattattatataggatgtttcttgataggaccatgagtgtcaatttattttgaattagactaaatatttatgtggtaggaatacttattcattcaaaaatttcacatttaattagtttgaggttacctaaaataaaacaagtatatattctaaattcgttgctttttcaaaacttattataaagagaaattagaattaaagaagtctaagggtcaggcatggtggctcatacctgtaatcccagcactttgggagacagaggcaggtggaccacttgaggtcaggagattgagagtagcctggccaacatgatgaaaccctgactctactaaaaatacaaaaactagctgggtgtggtggcgcatgcctgtaatcccagcttcttggaaggctgaggcaggagaatcccttgaacctgggaggcagaggttgcagtgagctgagattatgtcaccgcgctccagcctgggcaacagagcaaaactccatctcaaaaaaaaaaaaaaaaaagtctaaggataagaaatatcaatggttcagatgatgaatttacatatatgtgcttgataattttttcaaaatttttacctgagctttattgaggtataatcgacaaatattatcttaggtgtacaacatgatgttttgatatatgtgcacattgtgaaatgattaacacagtcaagctaattaacatatctaccacctcacatagttaccttctttgtgtgtatgcctgataatttaattttaaaaaatcaatttgtattctattctagagaaatcatgccctaatccgggagaaatacgaaatggtcagattgatgtaccaggtggcatattatttggtgcaaccatctccttctcatgtaacacagggtaagtttgggcatactaaaaccctgtatttaggaaatgagaaaacaaattaggacttaaggtgagattgttagtttcatgactggtattcacagctagtagcaattaaaacaatccctctcctcaaagacccttcatcatgagctcatcacagttaaatttagtaaaatgggggcaagaaaggaagatttcttaaaccaccagaattctctaaattctgatttcagtaaatatgtgattcaatataaaattttaaatgtgattaataaaaaaatttgagatgatgatacttgcagaaatcttcaaatgttaaatactaaaccaatctttagttgacctaaataatgaatttgcatgagtttttctatatgcaaacaagctgttacaaaacagcatgagttaaagacattcctagtgtgaaagtattctaagttctttgataagttctctgtatagggagaaggaactcattcattgagtaccatcaatgtctcagacactgttgaaaactttacatttattttctcatttcatatctgtaaattaaataattctattttactctgtgtgtgtccctattctttataaagtaaaaatatcagtatcacttgtctcctatacgaaacacagatattggttaggtcatgaacacaaaatctgggaagtactttgaaccctttaaatataagtacattctattattctgtgaagcccatatttagaactcagaggtataaaatgttcaatcatctatgtcatttaaaaatgtttaaaacacttttatgctttctaacatattccccatgcaaataaaaaatgtacatgtcttatctgtttttactctttggatgtcacgtttttaaacttaatttttcttttcctttaaactactgtgtggacttttatcaactactgttttatattcacctaattgtgtagtaaatattttaagataataacctggagaatttgaggaaagtcaaatatgtgtgaatgtaacaaactcttttttcttcccctgttgctttaggtacaaattatttggctcgacttctagtttttgtcttatttcaggcagctctgtccagtggagtgacccgttgccagagtgcagaggtaagagttaaaaaatctaagcactcagattgtgaggctgagtactcaatgataaattaatttctgccccttaagaatattagcacagtgtgtatttgtagcaaacccacctttcaatatatgagtgctttgctaattttaagaccttttctagtgatgttccttcatttagcagctgtgaagataaaccagcaagttttctgagtcccaattcccaaattgtagaatgaggattaaaaacaaacttaggtttgtattgcacttggtcatttattgtctaaccattacttctaaagtcaagtatgataggtgaaagatttccgccccacaattttgtgtaagaaaatagtgtcaatcagagggtctgtaagacttgaccccatatcctaaaacaagtggcaatggaaggcatttaaccaggtctcttatttcaaacccagcatttttctaaaatccagtgttgcctacatgctgcttcttaggattaaaataattaaccgagataattatctagaggggttttaaggtgtgatatattcttatcattagagagataagcttataccgtcaagaagaaatactgtgtctgtatttgagaatcttctcaaagaaagatatggtgcagaaataatattataaatggatatatatccagtcaaatttatgtcaattagagacacatgtctcttggaaattgagaggaataaaatacatgcaacattttaaaatgtaggcttgctttctttccatccttctctctctccacacacaatgtgccctcctgcaaatgacttctgaaggccctattgtcaaaattattgataagttaaagtttttgtatgttactaggggaagaaaactagagtagatttagtgtaatttatcaagcatttatcgattgacactctggtaggcaacgtgtacggtcaactgacacgaagacaaataaaatgaagccgtgccattaaggagcctgtccctgccacacccaccatgtgcccttctttttgagatgtcatactactaccttttttttctcattgtagttgtttttaaatttttcatcattgctacccagtagcacctttcccattttcgttgtccagtaagagacattgtaaatgatagtaaattaaagatagaaaacaaggaaaagctgggccatatcttttgtttgacccaggcaacatgtcacaaagttcagacaaacagtctcccatctgaagccagtattttcacaagcacctgctgtgtcatgaatttgacagaaatgcaaacccactttatcttcctgcttgcacatctaggccacagccttgcttccctatctggtgtcttgaactccatgctgaatattctgatgttcatgttttcctccttgactcttctatcctctctgtgactcagcaaccactgacatctgcatcctgtaggaaagagcccctgttcttaagcaatcccagtgccttcaaatatccctataaggccttacttctttcaggatcattttgattttccacataacttgttttgaccataccaaaaagattgaatggaaagtgaattcttaaacaatgtactgcttcacctcaagtatgtagccctagactataaacacatgaggttgcttcagtgtccatgcgtgaatatggatacgaagaaggaaagaacagtggacacattcactaattgtctatagttatacagaaaacagaggtgctgctagtttacctctgaatagagcctcactgtcagaggacctgtttgcttatctctctgccaatgttttctttttcaaaattttagttgactgatggtatctgctaacctagaatcaatccctgctatatgactatcatgccagacccttctctttatcttaactccccacatctcatccctaaatcattgtgctttacctcctcaatctgtttttcaaacttgtgttttgctctccatctgtatatttctagcatagtttattattcctcctgtggactattgcaattagggccacccctaacattttcagggcccaggcaagaatataaatggaggtcgctggcctaagacccaccttgtatcaaatagcccttcctcttcccacactgtatgggttctctggtgcacataagcggacaactcagcctacatacccaagacatgtccaccacatccaccataacttgtatccaccctccattgtctgttgggttagaggtgagtatatcagcaggatagaccaccctcaagaacatggaccagtgggagggaccctctcaggccctggaaggggtgttggcacagggaattctgggtgctagttcctggagcatgttctggaatggaggagaagtcgtaggacaggctgtcattgagtatatgctatcagcctacaaacatcccaccaacaggggagaaatgcatccagaggagggccagagcacagccttttaaaatgtggggtttgaggcagcaatcttagttgcctgagttcaagagtgacactgatagcaatggcctcctgcctccattctttcactctattaatgtttcatccatattttacccagagcgatctgaaacacagatgtgacttagacatctatttcctccttagagcttattcatatctcctatcacttaaaaagcccaaattccttagtatagtgtacaaggcagccatggtctacctactgcttgacactcaggtcttgccttcatgttttatgccttatacatgcaaactgctgtggtttccatgtacctcttttttttcttttttttaaattgagacagggtctcactctgttgcccaggctgaagtgcagtggtgcgatcacagctcactgcagcctcaacctccttggcccaagtgatcctcccacctcagcctcccttgtagctgggactataggtgcacaccaccatgcccagctaatttatgtattttttgcatagacagggcttcctcatgttgtccaggctggtctcgaactcctgggctcaagcagtctgcccgcctcagcctcccaaagttctgggattacaggtgtgaaccaccatgccccgctgccccttctttacttagctatattttccttactaagagttagttccctagcccatcagaaagattcccaggctggctacttcgggatgacccttgcattttttattgaaatcatttctgaatcttttttcccactagcttttaagacataggaactatatcttgttcagctttgcgcttccaattataaaaaaatgcctggcgtgtgttaggcactcagaaaatgtttgaactgaaccaatggtgtgtgtgtctctgcacactctaagttagtgtaaatcagaacagcttgttgttgctgcttgttttgatccaagaccaaagagtgattgataaatgtgctaagtattttctgtgttcttaagtatgtttggtgtaacataatttggcatacacacatattaaattgccttcattcttaaaaaaaaaaaaaaggacaacaacatcatgcctttagattatgtggaaccattgaattttttctcagggtaactgccagggagtggtccctttttacagtataactaaaaaaacttctgcttgtatttattttgtaagttcagctgctcagtaagattgttttgagtgaagtctctgtgagtccatatgtgctaaaaatttttactctagaagtcaaaatgtaatcctgacatttaagatctctgctgtatccaaaatgatctatacttaactcttaaacatgctgcttgaattttcaactccttgcatttgctagcgtttccctcttagagtgaagagcaacgctttctccgctgttctctctcaaaagcatggtacatattaggtttaaactcaagttctatttccctgcccaagtcttctctgactacactgctttcatctctaaaatcctgcagcattcacttttcctagcaccgttttgatatgcacacatcttactataatttttcttttacatacatgttctgaatcttattatttctatgaattggtctcaaggttagcatttgtcttctacaccatttgcattcaaagctcccacatactaccaattacttaataggcatttataagcatctcttgttggtaatgctgaatttagaaaaatgatattttgatttctttaaaatataatctttaacatgttttgatcttatttgtaaaaatactttactagttttatttatttaaaagatgttggaattgttttttaagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggtaatcactttggatagttatatttttgctttattcttaccctcaggtctatatgtgggttgcagacattcaatgaaccccctaagaaaaaaatgtaaaatgtttacatatacatatttgtatttttctgtgggacacaatttttctacagcttctcagaagggtctatggcttgtatacacacacacacacacatactcacacatattatgatgtgtatatataaaataggcctcatatttttggcaaatttgcttacatttgctgttttataccatgttgctttcagtaagttaatataggtactttgtttatacaaagagatataaagtggtttattggagggagaatcttagattgaaggctctagatagtgatcatacctgttgcaacaactgggaaactcttgccatctgttgacttcactgaattaacattcaattcttttctgcctccagaatttctattattatccattctccttcatccttctagacgtttttctttcaatgtctttttatacccagaaggtactctcagaatccttcgaactgctttttaaatatattttaaaagaaatatttagaagatcagtgaagctggactaaacattgcctagtatcaataggtggcgtttaagtagtggtgaataccaacatgactcaagcatttgagtatttacttttataattataattgaaattttattagtatgaattttaaaaattccttattaaaatagatttttattataagtgttatacatagacataatgacataatattaaagccagggagatgagtacaaaatgggaagtgaaagtctcttctctatcactagtcctactcggagaggtaacaattttttacaaattcttttgttttattctagaatataaataaacatacaaatattttttatttattatatcaatggtgtgggtattcatttatctaaccagtcctctattgatgacaatttaggttttttgttctagtttgattttttttatgaactattattacaaatgatgctataatattcttgtacatctgtcactgcacatatatgcaagtacatttgtacaataaattccttgtagtataattatttataacaaaggtatgtgaattacatttttcatgcccattagtagcactgctttttaaaagactgtaccaatttagtctcccactgatacaacatcattgtggtgtttgcacctttaatgataatgattgttagggagatttgacaatgtaaatggtaaaaatttgtattatttgaattcatttaattatgaagtttagtgtgtgtgcttttttaatttggccatttgatccagttcatatttatttttccaagttttattaaatgatcagttatttagagcttaaaaaaccatatggaagtacccaagtaggtcatggcaggctgatgcttccattaaaacgactataaaatctcaatagattaccaaaaaattatattttttaaggcataagatacagctgtggaagcaacaaggtctgaatgaactaaaattcctgggggcaggtggtgaaggcaacccatcctgatgtaaggcagttttccctagggacctttgctgattctgaacctggactaaggattcaccttgacccagacaaaagaccacttctaggaaagagaaaccagcaaagctttaatggttatggagggatagggtaatacactggaaattgaggccctcaaatgcagaaccaatttttcctaaaggccatttgcaaattttggggctgcatgtgaggctgggaaggttgacccagagcttctaaagtacaaaatgaaatctctcagaacctgatggtatttggatagcatatacccaccagaggaacaggcttttatctagcataccacaggtctcccctttagcacatctgtgctcattttgaaactgtatagggaaggacattaggtggctgggagaactctgaaggacagacctggatctcctgccaccttccaaaggtgaaacaacaaaaatccgccaggctttcagtcagaagcccggaagggccactcccaaggaacagaggcaagagcagaagtagatggagtcttactgaaactgaaacccagctcaattcctaataggttgaagatatgattacctcaatgcagtctgcttatcagaaaggcatatcatatcatccggatggtttatatacaatgtttggcatacaacaaaagactgttagatatggaaggaagcaagaaaatgtgaccaaatcaagagaaaacaaaaccaaataaagaatatccagataattgagttagcaaatgagaaccttaaaataactgattaacaagtttaagatgataaaagaaaagagaacttcagttggaatctgcaaaaatggtgtaaaatgaatattctacaactggaaaatatctgaaattaagaacacaatagataggtttagctattcaggcagagcaggaaacagtattaggaactgaaagatcggttaaaaatacccaaactgatgcacaaagagaaaaaggaatgtgaaatatagataaaagtttgagacatttgagacatgttaaactgtgctaacacattaggaaaaagagaaagtgagacaaaaaggaagaggggaaggaggaggaggagaagagaaataggagcagaagaaatatttaaaatgatacttactcagaattttccaaaactgataaagtacattagccaacagattcaagaagctctctgactctaagctgaataaaaataaaaccactttagcaaaaaatctaactctaagctgaacaaaaataaaaccactcgtagcaaaaacaaacaacaaaaacttcaaagaagcaacagtataactgattactgctcagcaaaaaatgatgcaaaccaaaagacaataagaagaaatctttaaaatactgtaagaaaattactgttcacctagaattttatacccagttaatatatccttcaaaactgaatgcaaaatagagatgtattcagacaaaaaccaagaaaactttgcactagcagaccaaacatgcacagaatgagaaactaaaggaaattcttcaagtagaatgaaaataatgccaggtaaaacatgaaaatacaaaaggaaatgaacagtgacaaggataaatgaatactgagtttacaaacagtgaatgtaatgtcctgtggggtctgaattatacatagaatacaaatgcacaataacaatgcgaaaggcagaaagaggtaaattcatttaaaggttacacagttctagcagtactgaaaaggtggtaaaagtgatagtttgcataattgacttatagtctaataaatattgtgatctctagggttgctacaaatgaatgacagaagaatacataaatcacaagctaataaaagaataataatggatatttaatccaaaagagaacgagagagagagaagcagaaaggaacacagaatagatgggagaaatagaaaactaataaggttgttgatataaacccaagtatgtcagtaattatgttaagtgcaatttgaccaagattgtcagacttaaaaagattttaaaaagaacctagttctttactatttacaagagacacagtttaattacaagaacacagaatagttgaaagtaaaggatggaaaaatataccatgcaaatattaacccttcaaaataagctgacacagttacattaatatcaatgtatattttaagatgaaacagttcataatgataaggaggccaactcaacagtaatatatcataatctggaatctatatgtacttgataaaatagcttcaatctatatgtagcaaaaatggacagaaaaaatagacaaatacacactcatagttagaaaattccacacctatctcaatagctaataggacaagcaaccaaaaatcagtgagactaaagatctgagcaacaattaaacatatatacatatgagaccattgaatctattaggaccgatgacaggtatgttttttcaagtgcgcatgggctatttaccaaaattgaccctttgctgggctctaagctacaatacattgcaaaagattgaagttattcagagcataccttctagccacagtggaattaaactagatgtcagtaacgaaaagataactaaaaaattaacttctaggaaatttaaactctaaggtagtatatacattctctggatcaaaactgagaactaacttgatagaacaaagaataatttagaatagtttttatataggagggtcttagaatgaaaagttcataaaaaaactttacttatcttaataatgattatcattgtttgagtgcctgctaaatgctgttacctgctaggcgttttactcaatttatcccttatagcagcctgtgagataggttaggaggcagaaaaaaatgaccgataccatctgagttcctagggcatcccgtgtgtgatggggctggcaacagtcatcctggatgatgtaatctcttgcttcagggacagacactgtgaaatagcttactcaattatttcccttaatccttcctcaataataattactcaatctgttctgcttttatcctcattttacagatgaggaaactatagcttagaagggttagggacttgctagagctcactaatacgtggtgaaatcaggcttcggcactacccaatactgcctcaacaggggactttgtataagtgacccaatggcagttgggctctgaagactgaaaaagttgctctgctgttagatttatgcttttcagaatatgttcttaatgaaagtttcacctgacttgttatctagtctgaaatctaaagaggaactggtgtatggaaagttggtaaccagcacaagagaattaaaaggagttatttttactcagactcgagtatcactttaaacaagacgtgaaacaaaacaaattctcaggctcattaaggttaagtgatagaaaaggctgtgactgtctctgttggcttagttgttctagaacaacatcctgttgttctttagtattagcacaaaagataatttgggagacaaaatagagatgtgccacagaataagatcactagtgactctttgatttgtttatttcacaagaagcagcttaagcacctcagtatactttggtataagtcttctttagttacccataggtataatttatatcaaagcaaacgcaacttagaacttcagctccttgagaaatactcaataagagttggtttcctgaaagtcatacctaggtgtttgtggggagagagaaaggatagccacagagcaagcaatggctaagaatgttaatgtggccagcaatatttagctaacttgtttctcaaccttttctttcacaggaaaatctctaacttccaaggtcccaccaacagttcagaaacctaccacagtaaatgttccaactacagaagtctcaccaacttctcagaaaaccaccacaaaaaccaccacaccaaatgctcaaggtacagagactccatcagttcttcaaaaacacaccacagaaaatgtttcagctacaagaaccccaccaactcctcagaaacccaccacagtaaatgtcccagctacaatagtcacaccaacaccttagaaacccaccacaataaatgttccagctacaggagtctcatcaacacctcaaagacacaccatagtaaatgtttcagctacaggaaccctaccaactcttcagaaacccaccagagcaaatgattcagccaccaaatccccagcagcagctcagacatctttcatatcaaaaaccctatctacaaagaccccttctgcagctcagaatcccatgatgacaaatgcttctgctacacaggccacactaacagcccaaaaattcaccacagcaaaagttgcatttacgcagagtccttcagcagcacgtaagtccactaatgtacattccccagtgactaatggtctcaagagtacacaaagattcccttctgctcatattacagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggtaaaaaaaaaaaaattctgtttcctgtagtagttttagggagtcaacgaattattcaagaccccttcaaagaaccaaatatgtactgtctttaaggctgagtcctgggtctggttcattgatagagatccatccctcaaagtatgctaaggaatcttcccggattccctagagttgcagatctgctaaagcatctcaatagtgtcgtctaagtaattgaaaatacagagatcctttcaaatagttcgtattattacaaggctctataaacgataggttctcagtggcaccaagtaattgtgttttatctatagttttacccattatgaccgtattttcaaaatgattttatatatttcataattgttaccttgaagcctattttgccagcacctggatatttttaagaatttaaacattatggatgttatcgttaaagttcccttaaaacatttccccagcccatttttctccctctaaggcaattactgccctgaaactgatgtgcttacttcctgtctgttttcattcttatactccatgtttccataagtagtacataataatgtttcatatttttaaaataatttacagaaactgtgtatgtttcattacctcttagcactcagcattggttttgtggcttacattgattaatttagatttactatactaattttaattctttatgtggtttttttacttctttacaattttatgacttctcttggtctaaaatttctaggttgaacacgtccagtttttaatagggcaaggcaaagagaaataagcatcacttataaatttgttatagaactaactttattgacatatttccttctgtaaaaagtataagataatttaagacatttaaactgaacctgatgagtcaattataatatatcaatatttgggatcaaattttactcttaggtacaattaatttactctttcagggcacaatataaaaaaattgtagccaccacttactgagtatatactatagtgatatgttccgttcaccttctgtttgatgccactcgtctgtaccacaaccttgcaaagtatcttcagattgattttatagatgaggaattagaggcttagagattaattcatccagttcatatccagtgcacagtttaatcctgcactttttctgctgagtaatattgcttgttctaaatggcactcttgagtcaatgtgttcacctcgcttaggagagcagcttatttattgttataaatatgcttatctgaaagtaaatttatttttgcaatgccccatccgtagtcattgaaagatataaataataaggtgatatggcatttttgagttttgatatagtctgctaaaagggacttagtcgtcttatagtttcttgttagtaggattggatcagcaattatttactgtttaagttttcaaacatgtttcttgccctcaagtcctataaccaaatttaaatggcatttgttttggtaatcaataactctttatcataatttatatttacagtgttgattctgttgaacaggtatagacagtaatgtttacattctacttgattaagttaatgtgtaattgtttttataaatttataattatttcatttgtggaaatttgagttgctttcgagttttctagtgtagtttattgatagtatatgaaattgctagcaaatcaatgactttaacaaatttttgttgttaatcctttttttccccttcgtctgtaggtactacccgtcttctatctggtaagtttggctctcaggccattaaaagaaattgttttcactgtgggatatacaatccatattcctgggagataatattgtcttcttgtttttaaaaaaatgtatcctgcaatttatttttaaactttttagtatggaaaactttaaacgtcactcaaatagggaaaatagtacagtgaatcctcatatactcgctcggattcagcaattttcaactcatggatacccacttcacccacactccctggattatttggaagataatcccagacatcgtatcatttccttcataaacatttcactaagtaacctttataaaaacataaccatgtagcatacctaaaaaaatccagtaattccttaatatcagcaaatatttagtcaatatccaaacttccctgattatcttataattttttaattgatacataatgttttatatatttatgaggtacatgtgatattttgttacatgcatggactgtgtgattctcaagttggtatttggggtattcatcaccttgagtattatttttgtgtgttggaaacattttaggtcctttcttctagtgactatgaaaaatatatcacacattattgctaactatactcaccctactctgctattgaatattagaatgtaatccttctatctaattgtatgtttatacccatcggccaaagtctcttcatcctccctcctactcacacacttttctcagcctctggtatctaacattcttctctctacctccatgagaacttttttaggtctcacatgtgagtaagagcatgtgatatttgtcttttttgcttggcttatttcatttaatataatggcctctagttccattcatgttgctgcaaatgacataactttattctttttatggctgaatgtatttcattctatatatgctagatttgttttctttcttttcttttttttatttttattttttttttgagacaggttctcgtcctgtcacccaggctggtatgcggtggtgtgatcgtagctcactgcagtctcgaactcctgggttcaagcgatccttccacttcagcctcccaagtagctggtactacaggtgtgtgccacgacacccggctaagtttttgaaatttattttttgtagagacaggattttcctatgttgcccaggctggtttcaaactcctggccgtaagcgatttttccggcctcccaaaacgttgcgattataagtgtgagccactgcacctggccccacattttctttatccatttgtacattgatggacacttaagatgattccatatctttgctattgtgaatagtgcttcaataaatatgtgaatgcacatatctttttgatatattggttttattttcctttggataaatacccagtagtgggattgctggatcctaagatagttatatttttttatgttttcaggaacctccatattgttttccacagtggttgtactaatttacattctcaccaacagtatataagatttcccttttcttcacgtcctcaccagcgtctgttattttttgtctaaaaatggccattctaactgaggttaagaactgatagctcattgtggagcttgatttgcatttccatgatgattagtgatgagcagtttttcatatacctgctgagaaatgtctgttcatgtcttttgcccactttttagtgtgattatttgtttttcgctagtaagttgagttcgttgtatattctggatattagtacctttacagatgaatagtttatagatattttcttccatttagcaggttgtctcttcactctgttgattgtttcctttgctgtacacaagctttttagtttaatatagtcctatttatctatttttgtttttattgtctatgcttttgaggttttagccattaaacctttgcctagactaatgtcctgtagcatcttcctgatgttttcttctagtatttttatagttgtggatcttatgtttaagtttttaatcatctcgatttgatttttgtacatggtgaggggcagaggtccagtttcattcttctgtattttcccagcactatttattgaagaaggtatccattttccaatgtatgttcttggcacctttgtaaaaaaatcagttagctataaatatgtggatttatttctgggttctctattctgttccattattctgtgtgcctgtttttataccaataccatgctgtttttggttactataaccttatattttgaagtcaggtagcgtgatgctgccagctttgtttttgctcgggttgtgttagctctttggactcttttggttccacaatcattttaggacttttttttttctatttctgtgaaaaatggcattgatatcttgataggggttgtactgaatctttagattgctttggcagtgtagtcattttaacaataatagctcttccagtccgtgagcatgggatgtctttccctttgtgccctcttcgatttcttttatctatgttttgtagttttccttgtaggggtctttcacctccttagttaaatctgttcctaggtattttatttatttttttagttattgtcaatggaattgccttcttgatttctttctcagtttgttcattattgtatagaaatgttattgatttttgtatgttgatcttgtttcctgcaactgtactgaatttatcagatctaagagtttttggtgaagtctttaaggatttttttttacatataaaatcgtatcattaaaaaagagggacaatttgacttcctctattccagtttggatgccttttatttctttcttttgcctggctgcaagttaataaatgaaaacttggttctctatgagccaaatgaaacttggttcttcaatgaaatggaaactagggcttacagcattatgttgaatagaagtggtgaaagtagacatccttctcttgatccagttcttagaagaaaggctttcagcttttcctcattcaacagaatattagctgtgggtttgtcatgtatgacctttatgatgttaatatgcttcttctatgcctagtttgttgagagttttattgatttctatgtgttgaatcatccttgcatccctggtcgaaatcccacttggtcttggcatactaattttttgatgtggtgttggatttggtttgctaatactttgctgagaatttttgtgtctatattcatcaagagtattggcctgtgattttgttgttcttgttgtgttcttgtctggttttggtatcagggtaatgctggccttatagaatgagttagggaaagtttcctcctcttcaattttttggaattgtttcaggagaattggtattagttctcttttgtatgtttggtagcatttggctttgaatccatccagtcctgggcttttctttgtcaggagactttttattacaattcagtcttactactcattattggtctgttcagattttctgtttcttcctgactcagtcttgatagggagcatgtctccaagaatttattcatttcctctaggttttccagtttgtcaatgtataggtgtttataatagtctctgatattttgtatttctgtggtatcagttgtaatgtctcttttttcatttctgattttatttggggcttctctctttttttcttggttagtctagcaagtactttatcagtttggtttatcttttcaaaaaaacaagttttcactttattgttttttagtctctattttgtttagctctgctctgatttttcttacttctttccttctgctaattttggggttggtttgttcttccttctctagttccttaagatgcattgttagattgtttatttgaaatctttctacttttttgatgtaatcatttattgctgtaaacttccctgttagcactgcttttgctatgtctgataagttttgctacactgttgccatttctattttttcaagaaattttttgtctaatcctgaatttctcccttgacctaatggtcattcagaagcatgttgtttaattttcatttatttgtacggtttccaaagttcctgttgttattaatttctagtttaattccattatggtttgagaagatacttgatacaattttgactttttcaaatttattgagacttgtttggtatcctaacatatgttctattctggagattgtttcatgtgccattgagaaaattctgtagctattgggtgaactcttctgttagtgtctgttaggtccatttggtctaatgtgcaatttaaatccaatgtttctttgtgaattttttgtccagatgagctaatgctgacagtgggatgttgaagttcttaacaattattgtattggagtctatccctttagattggacaatatttgctttatatgtttgggtactccaggattgggtgcatacatacttagaattgttatatcctcttgctgaattgatctctttgtcaattatataatgacctcctttgtctctttttactgttttttacctaaagtctgtttcatctgatataagtacagctactcctgtttgtttttggtttgtgttagcatggagtatctttttccatctctttactttcagtcacaatgtgttttcacagatgagatgaatttcttgaaagaaacgtatagttgggttgtgtttttgcatccattcagccagtatacatcttttaagaggaaagtttaatctgtttacattcagggttattgatatgtgaggaattattcctgtcatcttattaattgatttctggttgttttgttccttttgttctctcttattattgtgatgtagagtttttctttcataacattttagtcttttctcttctttgtgtgtttgctctaccagtggtttttaaaatttctgtgtgttttcatgattgtagatatcattctttctcttctgggtatagcactcccttaagcatttcttgtaagccatctcatggtgatgaattccatcatggtgattaattccatcagctttcttttgtctgggaaagacattgtttctccttcatttatgaaggataactttcctaatccttggttggtagtctttttctttcagcgctttgagtatatcatcccgttctctcctggcctgtaaggtttctgctgagaaatccattgttagtctgatgggtttcctttataagtgactagatgcttttcccttgctgtttttagaactctctctgtctttgacttttgacagtttgagtatagtttgtcatggagaaaacctttttttttttttggttttgagacagagtctcattctgtcactcagcctggagtacagtggcgcaatctcagctcactgcagcctctgcctcccaagttcaagcgattctcccacctcagcctcctgagtagtagctgggattacaggtgtgtgttaccacacccatctaatttttgtatttttaatagagacagggtttcaccatgttggccagtctggtctcgaactcctgacctcaggtgatccacctgcctcggcctcccaaagtgctgggattacaggcatgagccaccgcaccgggccagagaagacctttttaaattgtatctacttggtgatctctgagcctcctgtgtcaggatgtctacatttcttgttagacttgagaaattttcctctgttgttttagtaatagattttctaatcctttcactttctcttcaccttctgagactcctaaaatttgaatagttggccactttagggtgtcccatatgtcatgtaaactttgcccatttttttattcttttttccttattcttatctgactgtgttatctcaaaagacctgtcttcaagttctgagattctttcttctgcttgatctagcctattattgatgctttcaagtatattatgtatttaatatttcatcaagtatattatgtatttcatcaataaattatttccagaagttgtttggttcttttatatgtatctttttttgataaacatctcattaatatcctgaattgtttttctgatttctttgtatttttttaaaacaaattttaaagtttgtatctcacctccctgagcttttttaatatcacaactttgaattcttttcccagaattttgtaagtttacttttgattgggatctgttgctggagaattattgtgttcctttggtggtatcatattttcttgttttttcacgtttcctgcatcctgaagttgatatctgtgcatctgatgtgatatttgctgtttctaatttttcaaatttgcttttgtaggggaggacttttcctgaagatgtatttatggtgtcagttaggtggggcactttggctttaattctgggtgcatgcagtagtgtagtttctgtatgactttcagctgtaaatatcatcagtggtatctgtcatttcctcagtgctttaggatgcggttactagtggagatttgctagggaataggatgccatgtgggccaatgttcggacccaagtgttggcagtggtgggctgagtttgcctgtccttgggcccagggtgatgttgctggcaccagtgttagcaagcccaatcaggccagttattgggtctccaggtggctcacttgggtgccagaaatggcgggtgacctggttctcaggctacttggcagcaagtgggggcatgggtgatggcagtagtagtggtgggacaaccctgtgggacacaagcagtctgtgccagtgttggctgtgggtgcggtgattgggtggatcagtttccaggtctgcaggtggcttaccagctgtgatgttagtggcaggttgagtgggcctgacttcagacaccaggaagagtgctcagctgctattggtggtggactggctgagcatccgggtacctgatggcaggcttgtgtactgagagggtgacgctgggccagatggacttgtcctcaggcctccctgtggtgcatgtgagtgctggctgtggtaggaagaggtagagtattcctaggctactggtggaatgcttaggtgaggacagtgtggctgtgctgtggaccagctacttgggacagcagtgttgttttcagttgggagcagccacagagaggtggctggggcacatgcagtttgctcatgcctcagcccaaagcagccagcagcagccatagccgcatgcactggaatttgtcctcagggaaccagaaaatgcctggctgctcctctattgggggtgtcaggtcgctgccagtggctcctgctttggcttaggcaacagtggccacagagcaagatgcagtctgggaggggctgggctctcaaaatagtcttgtgctgtggctgcttaggactcagtggtttatagtactcagtgtgaacttactctctggagtaatgccatcacactgtctccaggcagcttcctatgttagatctagagcctacgagaatcaagggactcctgtagctaggattgtgggagtcttcagagggaatgtggactgctggggttctctcacttactcttttcctgcattagggagtctctccaggcttccaggcaatctcagccaaacaggctgccttgcttctgtctccttccttgctttggtgcatcctgtcacttgtttgttaaattctagtgttctctctttgatgatctcttcaaaatgtgattatgtaattcctgcttaggtttctctccatggaagaggagaagaccagaggcatctagtcagacatcttgaagccactccccatgatactgtcttaggaaaacaatcaacatgtagcattcatggataccaaagggaaaatgggtaaacacatttttttttttttagacggaatctcgctctgtcacccaggctggagtgcagtggcgtgatctcggctcactgcaagctctgcctcccgggttcacgccattctcctgcctcagcctcccaagtagctgggactataggcgcctgccaccacacccggctaattttttgtatttttcagtagagacggtgtttcaccgtgttatccaggatggtcttgatctcctggcctcgagatctgcctgcctcggcctcccaaagtgctgggattacaggcgtgagccaccgcacctggccaggtaaacacattttttttcttccaccttttattttaggtttgggaggtacaggtgaaggtttgttacatgggtaaattgtgtgtcattagggttgagtgtacataatatttcatcacccaggtagtgagcttagtacccaataggtagtttattgattctcaccctcctcccaccttccattctcaaataagccctggtggccattgttcccttctttgcatccatgtgtactcattgtttagttcccacttataggtgagaagatgcagtatttggttttctgttcctgcattaattcacttaggataatggtttccagctgcatccatattactgcaaaggacatgatttcattcctttctatgtttgtgtaatatcccgtggtgtatatataccacattttctttatccagttcaccactgatgtgcatctaggttgattccatgttattgtgaaaagtgctgatgaacatatgtgtgcatatgtctttatggtagaatgatttttgttggtttgggtatatacccaataatgagattgctaggtcacatggtggttctaagttctttgagaaatctccaaactgctttccacagaggctgaactaattacattcccaccagcaatgtataagtgttctctgttttccacaaccttaccaacatttgttattttttcactttttaataatagccattctgtctgctatgagatggtatctcattgtggttttgattgcatttctctaatgattagtgatgttgagcatttttttcatatgcttgttggcctcatgtatgtcttcttttgagaagtgtctgtttatgtcctttgcccattttttaagggttggtttgatttttgtttgttgatttgtttaagttccttagagattttgaatattagaactttgttagatgcatagtttgcaaatattttctccttttctgtaggttgtctgttttctctgttgatatatatttttttgccatgcagaagcactttagtttaattatgtcccacttgtcaatttttgtttttgttgcaattgcttttggagacctcatcatgaaatatttaccaacacctatgtcagaatggtatttcctaggttttcttctagagtttttatacttttaggttttaagtttaattctttaatccatattgagttgatttttgtatatggtgaaaggtaggggtccattttcaatcttctgcatatggctagccagttatagcatttattgaatagagaatccattccccattgcttgttattgtcgacttcattgaagatcagatggttgtaggggtgtggctttatatctgggttttctaacctcttccattggtctatgtgtctatttttgtaccagtaccatgctgttttggttactgtagccttgtaatatagtttgaaatcaggtagtgtgatgcttccagctttgttctttttacttacggttgttttggctatttgggttcttttttgattccatatgaattttagaatgtatattttttaattctctgaaagatatcattggtagtttgataggaatagcattggatctataaattgctttaggcagtatggccctttttaaaaattttgtattaattttttttttttttgagacagagtctcactctgtcactcaggctggagtgcagtggcatgatcttggttcactgcaacctccgtctcctgggttcaagtgattctcttgcctcagcctcccaagtagctacgattacaggtgcacaccaccacacccagctaatttttgtatttctagtagagatgaggtttcaccatgttggccaagctagtctcaaactcctgacctcaagtgatccacctgcctcagccttgcaaagtgctgggattacaggcatgagccaccatgcccgcagtatggcccttttaaaaatatttattcttcctatgcatgagcatggaatatttttccatttgtttgtattgtctctgtcttctttgttttgtatttctctatagagatcattcacctccctggttagctgtattcataggtattttatccttttgtggctattgtgaataggattgcattcttgatttggctgtcagcttgacattgttggtgtatagaaatgcttctgatttttgtaccccgaagctttactgatgttgtttaacagttctaaaagcttttgggcagactatggagtattctaggtttaaactcatatcatctgtgaagagagatagtttacttcctctcttcctatatggatgccttttatttccttgcctgattgctgtggctaggatttccagtaccatgttgaataggaatgataataatggacatccttgtcttgtactggttttcaaggtgaatgcttccagcttttgctcattcagtatgatgttggctgtgggtttttcctggcggctcttattattttgtggtatgttcctttgatgcctagtttgttgatgacttttaacatgaagggatgttgaatgttgtcaaaagccttttctacaacaattgagatgatcatgtggtttttttgtttgtagttctgtttatgtgatgaatcacatttattgatttggatatgttgagccaaccttgcatcccaggaataaagcctacttgatcgtggtaagttaggtatttgatgtgctgctggatttgatctgctagtattttgttgaggatttttgcatttactttcatcagggatgttggcctgaagttttctttttttgtcctgtctctttgccagattttggtatcagtgtgatgctggccttatagaatgaggagtccctcctccttgatttttggcatagtttcagtatgattggtaccggctcttgtttgtatgtttggtggaatttgtctgtgaatccatctggtacagggctctttctggttggtaggttttttaaattactgattcaatttaagaacttgttattggtctgttcaggtatttaatttcttcctggttcaatcttaggaggttgtatttttccaagaatttaccatttcttctacgttttctagtttatgtacatagaggtgttcaaaatagtctctgagggtgttttgtatttctgtggggttggtggtaatgtcccctttgtcatctgagattgtgtttatttggatgttctctctctttattaatctagctagttgtctatcaatcttatttattctttcaaaaaaccagctttggttttgttgatcttttgtatggatttttgcatctcaattttattcagttcagctctgattttggttattttttttcttctgctagcttttgggttggtttgctcttgttttttctacatcctctagaggtgatgttactttgttaatttgagatttttctaacattttgatgtaggtgtttaatgctacaaactttcctcttgacattgttctggctgtgtcccagacactctggtatgttgtatctttgttttcactagtttcaaagaatttcttgatttctgccttaattttcagaatgccaaaagtcattcaggattaggttgtttaatttccatgttattgtatagttttaagagatcttcctggtattgatttatattttatgctgtggcctaagagtatggttagtatgattttggttttttgaatttgtttaaaattgctttatggttgagcatgtggtcaatcttagagtatgtgctatgtgcagatgagaagaatgtatatcctgttgttcttgggtgtaatgttatgtagatgtctgttaagtccatttggtcaagtgtcaagtttaggtcatgaatatctttgttagttttctgccttgattatgtgtctaacattgtcaatggggtgttgaagtctcccactatattgtgtggttatttccatctcttcataggtctttaagaacttgtcttatgaatctggatgatccagtgttggatctgaaaagagtaataaaaacattatcattactatcattattatttattgtggttattttatattttgaatgaacttctaagctaaaagatttatcttgaaagattccaactgttggaattcactttgttttaaatagaaataaatgtgtttcaaatgaaagtctgatgatttaatgatcacaaaagtgatgagtttaataaatgagttttttctcacctgctcaatggcactcaatgaaggtttgaaatgcctttttttcctgaaattctttaagtattataccctttgattttctagaaaactttccttagtcggcattccagcttgtgttaaaaaataaagaggaagtccttccttcttaaactggacatatggcaacattttttgtgtgtgatttcatatttgtaggacataaacctgaaaattatattcattaaatttattatgtgaatgaggttactcttctttaaagataaattaactctactgcaagaaaattgtttcatcaattacactgcaatgtaagtaaaatgatacagatgatctttgaattttggaagtatttgatttttttttcctattctgctaaggaagaaagactgactaatgttacagaactttctaatttgccttgtaaatgaagcatgtgttgtgaattttaaatcttttcttccgttggctttgtataagtgtttcccaatttttttttgtggggggtggggggtgcgttaattcttgctctcttctcaccaaagacctttttagacatttttttttgatcatcctccaccacacatatactgtaaatcagtttatgtatcacatatatatctgcactctgtacttaaaaaaggaaaatttttttttaactttcatcaggtatcacccccattgagaatgcttgctttctgttggttttgtttttattgtttttaaagacaaaatcatatagaagaaagagcttaacctctggagtcaaaccagtcggatgttggtttgaatcctgtttttttcacttagtaattattcaacccaagtgattaagtgattaacttaatctctctgagactcagttttctcatttaagagatagagattgtgattcctatgtgaagtatttgaagcttaatgtgattagtgggtatgaaaactccaagcacagtcctaaaagttgaataaatattagcttaaggaagtcactgcatgcaatcactattattttcctaagctggatttctgataatttcatcactccctctggccacaccaaagaataagaacagtcttttattcaggtaatatttacatgttttctctgtggcaagtactgtactgattttttttaatgtattatttcatattcttctcacaacaatcttataatgtagcatttttatcccattttcagctaagataactgtggttttgcaaaatttgtaacttgcctttcacagagctagtaggcaataaatagaggccgatgactagtttctctattaccaggtttttttttttttttttttttttttggatgggggacagggtctcactctgtcacccaggctggtgtgcagtggtgcaatctcggctcacggcaacctctgtttcccaggctcaagtgatcttcccaggtactttaaaagatagaaagatgctcatcctagtgacagaccaagagacaatacaacccaaattggacaattaaggtgccgtgattccctacaagtattgctttattcccctctgttgccaaagtcctatactgagacattcataagtccctcatggggactaatagatcaatttaaagaataataaataagaagtcaggaaatattcagtgaaatatagaaaatattttttctgtatcccctaacaattgtgtacttatttatcctttaaacttgaatatggcatatattacagactagcccaaatctaaatgtactttcaagagtcttgactcttaagtagctatttgaagttaataagatgtggttacaggggtctttatgtcttattacatgcccctatacatgacaaacttaagtcccattataaagtgacatcagttatctgcctgttattcaggtttaagtcagataatataatcatataatctttctgtgatacgtttagtctggaaaaggaagtatgtgaatttcccttattaaaaaaattgaagaaatacagaggtacagaaaatccaacgatgatggcaagacacttaaagggtcctgtggatgtctctctgaggaagcagagttgaatctgcatttacaaaatggaaaatttaagggttactcaagcatactgtttttcaaatcatctacgaaaatctcttcccagggtgccttcacttgtccacaggccctttattctgttacattaagtatgatataagcaagaacaaaacctttccataactttttgttttcatagcacatgcattgcatttccactttgttagctctgcaagttagaccttttgaagtgtctgggtcatcccacatttcttcaaaaaagatgatgtgcatcctctaggtcactccagttcttggaggtaggtagatagaattctaagttgggttctttggcagtgaagatgataccctatatattaatgtagtatctgtctaatgtaaattttgtttgatgaatatcaggtattttattgaaaatatttcaaacagttaaaattatggcctgaatctggggctagaagtgagtttttctatggcaataaactgacttaccctttcttggtctcagttttcttatctggaaacaagatattaagtgcaatttaataaatatttgttaaacactttctactgtttgccatgtactgtgttaataatgagaggtgatcaaatgagataataggtggcaaactgctttgcaatgttttcaacactgcaatacagttctacatgatggggaaccttactaaaatactccttttgtgggggagaaaacctttttctaacattatgttattttcccacctaagagctcttcagtttaatcttaggaacattggaatcataattattatttcattcattatttcatactttcatttttcccaagttgtataaatcttaatgttgattcacctttggttttctgtagataccaagtgaattttgagatcataaacagttgcctttgaacctgaaagttttgtttctaatttgggagataatatgctcttattaatttactgagaagatacgtagaattttgtttttcatatttctgtgttttgccttggttttctgttaaaccatcagcctctacactttcttctagaactatgtatatgtgttgagcattgttctgggaatagccttttacttctgtcatctggatgttctagatcactctgaattttctgtcttgatttagtattcaaataaaaaataagatattgaaagtggtggaattagtgggaactggtgacagaaagggggaaacccaaaattttttaggagctgtgatttatttcatggatagtctctctaagttaatgatacaattctaggggatcagttaaataaacttctaaagtaaaatactgtaaaaacttacctgtggtagaaatagctgttttttaaatcacaattttcacatggcagtgcaattgtacagtgtctctattttgctgatttggagccaaatacactcattagtcacgttagattcagttactattctagtgtcatctgtcatttcctttgtagtaaagaccaatagagttgagtccaaggacactgggcagggttggtgggggtggtggtgggaggggggctgttggtgaggaaagagagaatgaggatggtgagagaaaagggcaaatgggtgcatttgagaagaaagattgtgtaagctataaaaatgatttgatgttgatcaacttatttgaccaattatttgctgttgttcagctcaaaatagtgctttgaatcttaaaagtgaatataatttttgaaatgaaatttaatctaccatagactgaacactaaaaagcatattctgtaggcaaagtaaatatagtttgccctccaatctcagatgataatagtacaggcatatttcctgtgatggagaaatgtctacatatctgttatatctactgtaaactaggtaaatgtccttcccattaaccacatatgttaatgttcaacttccttctgagactcaatttactcatctaaaaaatgaaagtgaactctaagatgctttctagctctaaaataacataattctgtcaccatatttgaatgctcaacgatcaaaacatttaaaatcgagcatgattgggttgaaacacttaagaagcctctcaaacctgtcaaaaaattttatttgagcattgtgatattctaaatatatttcttcctttttctttcgaagaaaacaggacaaataaaacatgcatttgtcaaaaatttgtgacataaggaagccatatacaaaatgcaattaatatctcctatttgtaactcacttcataaccagtatgtatgtcattgtgaaactataatgtaattttaattgctcatgtttctattaactgtgttaccatatcttttccccttcaaggatttcttgctggtactctattaattggtaccctaattctagtcattggactatggaaaatcagagtgagcagaaattctgatgatttttaaaaatttattcctagtttatttccagtaaaatttggtactgtatcagtagatgactctcttagctttatttaaattttggcgtgtctctgtattcatttttgtctgtaattactatcctggattaacagacttcatgtctgttttttctcaatatattcaaaggcgcatttcaaagcaaagtgacttgaagtctcattttgtgatctattaatccactgatttttttccactcagtgtaatttatgatagtatctagtgttgcacagaagcaaagaaatctaggaaaaatcaacctctaacatactgtgaaattgcctgtgattagggctttttctcacttatattaatagatgccagtccagctcaaaacagcacagtggttaaggcagcagacaaatgggggaaatatagtacctacctcatatgattataatcatatatcaaatgagttgccacctgtcaagtgcttagaacattgcttggcacatagtaagcactcagatattaaaacaacaacagcacacacacacatcagtattatttaaaatatctaatctgcattgaatatacataatgttaagtataaatgtcacgattggctctgatgtgtcctgtagacagatgatgatttaaatcgaccctcttctgttttgtagttttaactgttcagaaaactagttgtggaatttatacaaacttgagttatttctaagctgccctaatgcctgtccgtttttcccattaataagaaaactattaatttaatgctgttattaaattgtctgttttaattctttagatgatgtgacctatctcctttttaccctctacaatttttctacttaaattaagaatattacttaagcctattataagttaaagcatgtaaatattctttaactcactaaatgagtcagtcttgtagaaaaatatttgaccattaggtccaggggagtgattaataatttttacaggcatttgtttaatatcaacaaaatattctagctgtcatgatagcaaatatagtaagacataactttttctccagatatatcagaaacgttttaggaatgtgatttagagcctagcaaaaactcacagttagtactaagtcatctaaagtgagttggtatggaagcatcagcaaagctactctgaaaaaaaataaaaccaccaatcttacgtactttcttgtacttgttccaactttccttttgaaatactgttatcagtttatcaagttataaagtatcaatgtatagagtattatcaatttaccaaagctactgctttgagactccctggatcggtgggaatggagactgggcgggggagggcggagggcgggcgggggcagggcagcaagatgtgataagtttaccaggtgctgtctcttggctttcatcagtttctttacatactttggtaaggtgattggctgtgatacttgtatgtcctattaaggacataaagtactggaacatcgaaggagggaatacagtaatttctgcttatcctcggttggggggcagggtgtttcaagaacccccagtgaatgcttgaaacaacagatagtgcctaaccctatatatgctgtgttttttcctgtatgtacatacctatgagataaagtttaatttataaatgaggcacagtaagagattaacaccaacgaataatcaattagaacaatttattgtagcaaaagttatgtgaatggggtctctctctctctcaaaatatcttattgtattgtactcacctattttcagattgcagttgactgtgggtaactgaaaccacagataagcagactaatgtatttgttttgaattgtattttggggttttgcagtgaacttaattgcttattttctgaattagagggaaagtcatgcaaactcctaagaaagaatttgtcttttttatgtgcacataaaaaacactccacttgctttattttggaaacataagctgttgagggtaagagctagctttatatatgtttggctagcctcctgatttcatactgatttaattaaatatttgatcttaattaagacaggatatagttaatgtgcaagtgataatgtggtttcatttaatgattcttcatgtttgcctatcagaggattgatttatttcttttagaagagttaggtctgtatgataaattttagtttagggatggaagtgtaagcagatgcctgacttcgttttttgattgaaatgacagttacataattcaattcaatagtttttttcttctctactattcagctcttataatgcacatgagagcaacaaagtactcaatgttgtgtttgaccatttaagtgtgactggtggtacctcagaaataagactttctggtaaattataaaaggtatatatggtttaataaaattacatttctgtatcttgcaaaatatccattaatacccttggctagggggttcttcatgacttttaaaggataatagaggcttaagtctctgtcactagagttgtttttttctttgttgaatgactaatacattgaatctctcattactatgacatatcgtcagttctggacttggtagcagtaatgcttatcatctcatcctacattttgaactcagtttattgtaacgattagatgctataatgccacaaatattcggggggaaagggatgatacattaggacttttaaagagaatgccttcattatgataatttgcatcatgagatggttgacctaccttgtatttctccttttgcttggtggcttttagagttttcaatgtttaagaaaaattataatatgtgctaagatatccttttataggtcatgtttatagatcttaaaagacatctcatatctttatacaaaattatcacacaaaaataacttggtgtaaatgtatctgtaaaactttctgagtgtcttcatctcttaatcttctcttccacatgtagtagtattcaggggtttttatttatttttatatttttttaacatctcccacacttaggaattcattgacttttaatctgaaggtaccttaattcattctagcttagccactgttcaactcgagaaactaaaaactccacgtcacattttagttgttgctgtagctgataaaccccacctgtagaatcttgtccatattctattactcattattttttttgttttgcaccccaaattaactgattctttttggtgatttatcacatagtaactaaaaatttatatttatcactagtaaataaaatcattttgattttaacttttttttttttttttttttaattttcagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctgttttgttgttgaagtactttaaatttcatacgttcatggcatttcactgtaaagactttaatgtgtatttcttaaaataaaactttttttcctccttaa

SEQ ID NO: 1603 - DNA, 39495 bp, Homo sapiens; identical to SEQ ID NO: 1602
  source 1..39495: mol_type = genomic DNA

SEQ ID NO: 1604 - DNA, 33470 bp, Homo sapiens
  source 1..33470: mol_type = genomic DNA
ttagaaggaaaagagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagtatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactatgtcacctacctctccactcaaatgccccattaagtaccatcctgttggagcttcctaacgcccctgctccctggtttcatttggaaccaactgagagacacaagtccctcttcgttgatcagggtcagttgaaagatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacactgaagaaatgtgacatgagggtggaggttcctgtccagcattcttcactctctatttaaccgaggctgactcattgcagttggcactaattttccattgccacagccctctccagccaggagggcctggagtacctgaggtgctgtttgccgggttcccttggtcctcagactgctcccttcagagaaagcacagaaagccttctctgtcccaaggagccccccttcccctcccccactccagctctgcatctggacacactgtcagccatcagatcctgaccaggtgctcagcctctttagggatatgtcacaatttgccgtgcccggtggctctgggcagcctttggacatgtagtggttgtgtcttggaatacaagagttgtgcctgaatctgggactctctgtgaccctgggaaaatcacatcagctctctgaaccccaattgtctctgatctataaaatgaagacagtatctacttcataggattgatttgatggacatatgtataagcagtgccagggacaactagtaggtggtcattggagtgtggctacagttattatacagttacacatggattccttgattccccattaagccctggtggatgaatgaggaaaatgcagcagggggtccatcctagaaaacccaacccactccagataatcgcgccagcctcacacctgagaagctgcttctacgacctgctgaggacataatgataaacacacacaagaggctactgtgtcccaggcacttgtcttaactcatttaacttttctaacaaccctaaacctagggttctcattttccagatgagaaaactgaggcatgtaaggttaagtaacttgcctgagggtcgccgattagcatcagagccggcatttcaaatagacaggccagctctagaggccagggtgtttggacagcctccaaattgtcaccctagccttcagggcaaggctgcacacacggcctctagtctcctacccctcttcctggcaggaggctggctctgacaggaggttgtttgtgccacaatttaaggaccaagctattctgggaagcccagaacagtctttcctttattattcatctcaattaaccattgtgttggtctggacttgggggtgcaggcattcccatctccctttcaaaaaagtttctaaaaaatgcagagcagcctttattcttgttttcccaggtaaatgtggtcctatgtacttgcagagtaagaatttaaaaaaataaacctgagaggtagtttagtggaatagggagtacagaggcctggaagatgagggagctgggtttaagccccatcaaccggcatcaactagccatgctaccttgggcaaaataaccgtagctaacacttagtgaccacttactgttgtgcgttctcatgttatcctgacagtaacacttatagggtaggtctgtcagaattttctgtccacaagcaacagaagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctaccttgtttgctgagtcttctggctttcttccactcttcctgctcttggacatcagactccaggttcttcagcctttggaatctaggacttgcaccagtgggttggttgccaggggctcttgggcctttggccacagactgaaggctggctgcactgtcagcttccccagttttgaggtttttgaactcaggctgagccactactggcttctctctaacccagcttgcagacggcctattgtgcgacttcgccttctaactgtgggagccagttctccctaataacctccctttcatatatacatatatcctactaattctgtccctctggagaaccctaatacatgaattataactctaagtttcagttctggccatagcattatgtcacaccaacaccagcatcaatattttaggttgcctaattaatgtatctgtaaacctatagccagcttgggtggggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcacccacctagaaattaaggtactgtggtcatttatcttatcccagaataacaggagtgtgtataaacaggaagctttagtttagataaataagattatccattacaaaaattttatattgaataacctgtaagtaatttgaaaaagagacttctggctagttttcacttatgtccaagtcagtgggggtaaatgcattgtgattcactgtaggttttagactcttacagccttaacaaccttgtaaatccataactagcatcttcctatctggcagaccctttacaaatgcattatctcaagcctcacaacaattctttgaggtagacatagaaagtgaaagttcagaaagggtttaaaaaaaaaaaaaaaaaaaaacttgtccagagacatagccaattagtggaagagggtttgaacccaggttcctaactacaaaatccacgggtttaactgctgctctcctgaaatgaaatatctacaagaagtagcaggcattgagaaacagatgggaagatagtgttttgatatgattttctgtttacaggaaggcctaactacgtcctgttcacctcatgctattgggtaactttccagtaaaaaacaattgcactttgttttcttttccaaaaagaggcagaaactgatttcttcaaagtaaaaaggcaccagggacccattctagactttccaaagctaggcacatattaaagagagtatacaaaataggcagagaagtagacttgctgacctgaggagctgagtgggaagcatggacttgccaacttacctaagtgaccttgagcgatccagctaactttgcatagtttcctcttgtgtaaagtgaggtgcaagtacagatgaaaatgtatataaaacatagagcttagaatcctgtaccagaaagctgccctcatcacaatgaatgtcagtcagtactagctccagccagctgctcagcccatcaagaatccctcagggggatctgttagcattagttcagatctgttggcagcaacagaaactaatgcgagctagtagactttgaacactgctaaagaacttaccaagagaactcagatgtataaaagtggttaattctgtcaagaggcccaaagtcttgggcaggctcttattttttcaggacacacataagacatgggggctaactgcaaggacacaagaaaaatatacccataccttgaagcccccagtacattcaagaccaagtttggcaaatagattagcatctttcaggaaataccatgagctccacttatctactcatcaggtgttccttgcacccctagctcatccccccaaggggacaatccaatgggcttatcaccacccaatactgaacactatgacagttcctgtaaatccagatgagtggagggcacagggtattggctctcgagcagagagccagtaggcatgactggtgttcgattcctaactcccctgctccctggtttcatttggaaccaactgagacagacacatgaatccctcttcgttgatcagggtcagttggaggatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacattgaagaaatgtgacatgagggtggaggttcctgtccagcactcttacactctctatttaacctaggctgactcactgcagttggcactaattttctattgccacagccctctccagccaggagggcctggagtacctggggtgctgtttgcctagtactataaatgtctttacattacagtattgcctttgggtccaggcactcaaccttgtctatggcatgagtcacagcaactttttgcagaaagcaaccccaaagtttaaggccatttatatgacccttgttgatttggacagcttaacagccccatctccccatttagtggcactcagattttgctttagaggactaccttcttcccagtgtagtctggccaaaaagtgggtacatgacacaagatagcagtaagccaatctcatcctagaatctcaatcctgagagaggcttccaaaactgtcgactcctggctttctggagtgtggctgaattccccacccccccgcccccaaaaaagttcccagaaattcattttctgcttaaattcatcaaaattgtttctcattccttagaactcacatgaaatgagcttctttgctcagccggtggctgtgggcatggtcagtacttcctcaggccaaaaaaaaaaaaaaaaacctattgatgtaaggaaagacactgagctaacagagaacacagagcaccaaggtaatgctaagttttgataagcaagtttctattttcctatgttcagggaacggcatcaacagaagaaagctggcactgctcaggatgtcttctttcagttgctaccattaagcatactgcatatccttttcggccataaccacattcacccacttgttatatttcattttcagaaaagcatcattcattgcactcggtttgtccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggtgtgtatcattttttagaagagcttctgaaagcctcaaacatctgtgagtgtgctaagagccgttacaaaggtattttatacaatctatgctgagtcagctaggagttagcaggaggctggatgcagatggtaaaacatacccctgcagatctgttgttattaaggatgacctttggaagtctcaaactgtaaccacaaagggtgtccccactgcattcatactatatacacacatacctgaactgcctttctaccagtaacatttaaaataagcacacttaatactgccagtcacatgtagtagagtgttcactctgtaactgtgtgtggcaaagccaagatatcctaccattccaataaaaaaaaggcaaggaaatagctttaacacaccattgatgtatgctattacacttttccagtggaagataacaaagcccatataaaatttaaagacagaggaaaaactcgattttcagccacttgtacctctctaagttttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttcccaacaggatccatttggaaaatatcaagcctttagaatgtggcagcaagagaaagcggactacgcaggaacggggagtttgggagaagctctcctggtgttgacttagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaaccctgtggggagacacacacaagggtaagaaagtaagtgggaagagttctgtatctgcttttgaatcctcaattctatttcgtatgtatcctgtgcaagtagagacttctaggcaagatgctcatcccaggtgggttgtaaaggagaacaattaagtaaataatgatacacctctaaatagagcttttacagaaaaccaaggtctcatcagagccagtatagttatgggggtgggacggaggaggaacaggcatttatactgttaagagggaaatttggtaatatctgccaagattttaaacacatgccccctttgatccagcaattccacttttagaatttacgctatgaagttacttggggattttttccttttcttttcttttttttttttagagagataaggtctcactttcttgcccggtcatctggtcttgaactcctgggctcaagtggtcctcctgcttcagcctcccaaagtgatagaattataggggtgagccaccatgcccagccaaagctatgtataagatatatgctcaagaatggtcagaaaaaaacctgaaaaacccagtccattaatttttaaaaagtgttaaagaaattacaatagaattccttacaatgcaagttccatgcagataagaaatgacgtgggccttcaagtgctaacatggaaggagcttgatttaaaaaaaaaaaaataaaggtggggggggggcagaaaaataggtaaactggactccatcaaaatttaaaacttttgtgcttcaaaggacattatcaaaaaataaaaagataactcacagaaagggagaaaatgtttgcaaatcacatgtaaaccaccaggtgcggtggctcacacctgtaatcccaacactttgggaggctgagatgggagaattgtttgaggcgggaagtttcagaccagcctggtcaacatggcaagaccccctctctatttcttttttaaagtcatatgtaagagcatagtatccaggatatagaaaacattcttaaactctacaataaaaagactaacccaattaaaatatggacaatgaggccagtgtgatggctcacacctgtaatcccagcactttaggaggctgaagtgagaggattgcctgcggccagcctgggcaacatagtgatatcccaactctacaaaaataaaaaataaaaaaattagccaggcagggtgttgcgcctttagtcttagctacttgggaggctgaggcaggaggatcacttggactcaggactttaaggctgcagtgagctatgattgtactgctgcattccagcctaggcaacaaagcaagaccttgcctctttaaaaaaaaatgggcaaaggatttgaataaacatttctccaaagaagattctcaaatggccaataagtacatgaaaagatgcttgatatcattagtcattaggaacatgcaaatgaaaatcacagtgagataccactttatactcactaggatggctaagatcaagaaaatggtaaatagcaaatgttgcaaggaagtggaaaaaattggaaccctcaaacattgctggtgggaatgtaaaatggtgtagatactctggacaaatttggcatttctgcaaaaagttaaagatagagttatccatttgactgagcaattccactcacaagtgtatatacttctgccattctctggaaggattcccaagtaatttaatactgttatcatcatggaagaatacacttcgtttatgtttctattgagtttttcaaatttgccacatggataatttttaaaatatttgaaacttcattttaaaaatcattagattattcagtaatacaggaaaagtttctataagaacatgctatcatggtctcatttttggaaaaatagccttgggcacacaggaaaataaaggccagatgtatacactccaagtatcttatcgtagtttgaattgaaaactacgttcacacacaagtttccacatgaatgttcatggcaccatgattcaaaattgctaaaaagtggaaacaacccatatgtccattactggtgaatggataaacaaaatgtgatatatccacacaatagaatactatgtggccacaacagaatgaagtactgatacatgccacagcatgagtgaaccttggaaacattatgtttagtgaaaaaaaagctagtcgcaaagtgccacaatactgtatgattccttgcatatgaagtgcccaggagagccaaatctatgaagacagaaagtacatcagtcactgctggggcatgcaggagggaggaatgaggactgactgctaacaggtttcttttcaaggtgacagaaagatcctggaattagacagttgcgataagtcatacaaccttgtaaatatactaagagccactgaattatacactttaaaatgtaaacgttctggtctgtgaattatatctcaataaaaaccctagatgcagaacagtgtatagaatgtgacccatttgtggaaataaagcacatatacattgaggtaagtgcatttatttttctctggaaggattcccaagtaatttaatagtgttatcatcatggaagaatacacttcgtttatgtttctattgagtttttttaatttgccacatggatgatttatttttaaaatatttgaaacttcattttaaaaatcattagattattcagtaatactggaaaagtttctacaaaaaacacgccatcatggtcccatttttggaaaaatagccttgggcacacaggaaaataaaggccagaagtatatactccaagtatcttatcacagtttttttaatattcagaaaaagcatgttaggtgaaaaatgtattagttgagagagtggtattatggtagattttcttctccaaaaataactgagtgcctgtgtgctagatactggggtataagaaggtatttgtccttgccctgaaagtggtttcttatcttctgtgctggaaagaaaaaaacgcagatgcatacttccttatttcaggcttgtagctaatttacccaattccatgcagagcttggaacacaacacttctcagtttataactgcaggcataactgtcctgtcctcctcctctgaggggatgggtatctggattggaatttaatgaagtttagtcaagtggcagagtccacatagagtattccagaaatggctctagttgctgaagtcttaactaaataactggaagcttctaatattgtactagaggctgctggtgattcagacaagttactgctttgtaacagtaattacgcattggaacttgaaaagctttaaagctatcagaattttaattagggaagcctagaagcttggggagaacagacagtaatttatgaataattgctaccaattaatcatttactatgtgtcgtgcagcgtaccaaagtgctttacttgaattatcatattcaaacaacagccttaacgatggtaataatctcaccaaagccagccttggaattatccacataaaagtggcttatatcagaatccctggagtgttacaggttttctcctcctcactctttttgaagacttcggctcaagtctatctaaagtcaacagtcttcagctgtcctaggcacccttaaatgtggcccttgttcagaacgtcattacagcagtgaccacttgacactgtcatcagaggctccttcaagactaagtacatttaaccttgcttacacttccatggtttatactgctaggatgccagtaaatattggttgaattagcagccaacctgtctctcttctagacttactttgtatagcaccatcatatctgtctctgtgcaaacgtcatagcgtgtagttacacaaacttacatggaatagcctagtacacactcaggctatgtggtatgtcctattgctcttaggctacaaacctgtacagcaagttactatactgaatactgtaggcaactgtaatgcagtggtaaatatttgtgtatctgaccatatctaaacatagaaaaatacagtaaaaatatgacacaaaagattttaaaaatggtacacctgtacagggcacttactgtgaatggagcttgtgagattggaagtcagtgaatgagtggtgggcgaatgtgaaggcctaggacattgctgtacactactgtagatgttttaaatattgtacatttagtccacactaagcttattttaaaaaatcaaccctagtttactgccactttactttagaaattttttaattgtaaatgtttttacctttgtaataaaacagggtaaaacacaaacatgttatacagtggcacaaaaatattttctttctattcttattttataagcttttttatttaaaaaaatttttaaaaacttttcttgtttttgttaaaaatgaagacacaagcacacacattagcctagtcctacatagggtctggatcatcagtatcactgttttccacctcttcatcttgtcccactggaaggtcttaggggtaagaatactcatggggctgtcctgtcctaggagagcaatgccttcttctggaatacctcctgaaggacctgcctgctgaggctgtttttttttttttttttcttttgtagagacagagtcttgttctgtcacccaggctagagtacaatggcacgaccttggctcactgcaacctctgcctcctgggttcaagcaattcttctgcctcagcctcccgagaggctgttttatagttaatttttttagtaagtagaaggactacatgctaacatgataaaaaatatagtaaatacacaaaccagtaacacatttattataaaatattatatactgtatataattatcaaaatatcaagtattatatattgtgttatattttagttttgtaataaactaccaaactgtcatccacagtagctatactggtttgcattcccactaggaatgaatcaaagttcccactgctgctgggcgtggtagctcacgcctgtaatcccagcactttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgagggttttaccttggacactaagaacattctgaaactgccattcctcgctggcatcatttgcacacatcgattctatccagaaccacaccccagcaagaacagagggcatgtctttgctggtttctttcctctgtctaccacttcctaaactctattttaacagggtgatggaggtgaatattctgtagtctaacaaatttggaaaatgcagactggacaggacttgtgcatgttagcattgcccatccccaaattcatgagcaccttgctctgaggctaccgagccctggcacctgctgttgcccctcccaggcacacccttcccttcttagccctcttacctcctacgtgtcctttgagctcagcttgagtctcctcaggactctgaatataccagataccccatggaatgagacagaggcatatataatgacatttaggacagccaaacaggcctttgtcataattttaattgtatgtgtcctttctttatctttgcatccctagctcctaaccctctgctgggcacacagtaggttctccaaggtctgggaggcagcacagggctgctgtaaaagagcacaagctttggaatcagatggacttccatgttcaattcctgagtcggttacttaaccataatttcttgcttaatctgaacctccatttccacatttatcaaatggaaataaaagatcacccttagaagtgcaaaacattaaatttaaaatgtatgaagaaagtgcttagcccaatacacacctgacgctaataaatggtagctattacttgatgcaagcctaatgaggattacagtggcacaatttttttcccaggcacttattaccccattacatttaggagacagacaggggaggctcttaccagctttggtaatgagacacgcatcaaaatcagatgaacaattgacggctgttttgcagtcagcagttgggttaggacagttgtagcactgcaggctatgacctagaatcaggaagaaagtcaggatctcttaaagcagcactgacttgtcccctggcagcccaccatctccattaatatgggcccaaagtcagcaacttgtggtatacttccactcccgcacaaatgtatagcagttatatctttccaaattcaaactacagttccagcaacattttttggaccctgatgcaagcacaaaggaaatatccacatttgaatatccatctaactgtgcaattgagaagcttcctcctaacctgcaactggaaggagattagtctgcaatgtaatgatgtgttaagaagaaattaccgagaaacaaacagaattctataagtgtcttccaagcaatgaatatgcccaattaaatcacatcctcgtgggttgatgatcaatgtctggcaatacctatctgcgtgaaaatacattttcaaaatgaaatatgtaaaatgtcatcacagattagtattaatagatgaacatctgcaattgatttgatgcgagggaacactaattttgaaccccaattaagcaaatggttatccccctaaaaagaattctattcccctcattagtagatgtgtattattatgctggactcaataattatgttatgaattttgtcaataaaaaaatctgtgaaaattttgtttcttattattgaggtaagtctcataatacccttgattttgcctcttggtctgcaaagcttaaaatatttactatctgggccaggcgcagtggctcacgcctgtaatcccagcacttagggaagccgaggagggtggatcacctgaggtcaggagtttgacaccagcctggccaacatagcgaaaccccatctctactaaaaataaaaaaattagccaggcatggtggtgcacacctataatcccagctacttgggaggctgaggcaggagaatcgcttgaacccaggaggcagaggttgcagtgagccacaattgcaccactgcactccagcttgggtgacagagcaaaactctgtttaaaaaaaaaaaaaaattgctatctggtcctgtacagaaaaagtttggtaacctctgggacagggtatcattactgaactactcccttctaagggactgaccgaatgccaggagtacacactgtcaaagacaagacaacagctgtgcactttaaacccatgggcataggacagctgggtaccagcagacacaacgtgagggtcatcttacatcagaagcaaattgcctccagttccctagtttgaaaaacaattattgctcccagtcaattcttaagactcatccttgctagctgtcagtttttgctgggttatttttccttctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagcttgcaccactgcactccagcctgggagacagagcgagaccatgtctaaaaaataaataaaataaaataaaataaaaaccaacctcctccccaacttttttgcagatgacaagacagatgtctggagaggtgatgtgactcacacaaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagcaacagggccaggtgcaatggctcacgcctgtaatcccaacactttggcaggctgaggtaggtggatcatttgaggtcaggaattccagaccagcctggccaacatggtgaaagcccgcctctactaaaaatacaaaaattaaaaagtaaataaaaaaaaatacaaaaattagccaggcatagtggcatgctcctgtaatcccagctactcagaagactgaggcaggagaatcgctggaacctgggacacggaggttgcagtgagccgagatcgcgccactgcgctccagcctgggcgacagagtgagactccatccccctgaaaaaaacaaacaaaaaaaaacaagcaataggtcagtggacaatggtttgatattttagccactaagccagggtagacgaggtttcccctgggccataagaggcagagctcagaggaaagttcccctgcagggtcctgagacccttttgggcagcagcaaagaaggcctctcatctgtgggcatgtgagcttcacatctcaattctctgagaaagggctgaagtgcaccccaagacttgtcacagagaagctgatggtcccaagcttgctccataaacaaatgcagactgctggaagtaggatgtcactgggctattaaaattctagaaaatattccaacttaagcagcagagacagaaaaaaagaaggaaccaagaaaaatgaataaataaaaaataattatagaaaaaatatagtgttttaacacaggtgaaccacattacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcactgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctccttggattcccattgtgattgtccacagaacctggaaggaagggacaggaaggaatgtcaggaacgaacaaatgactgctggttgtctcaaaaaccaagggctggaaggccaagaaggcttctgagaggaacatttacagggggagtcaaggcacactgaatccctgggccatgccccagctctgacccacagcaccatatacccttgagtaggctcagtccctataagccccagtgtgtactaccacactgtgggaataacactatcttccccatcagggtcagtgagtcaaatgacaatatgagcaaattgactcatatagccactgtggttcccactctactggccccaccccaagctgctggctgaaagagagggccacttctcggagccacagcactaagtgaatcagaccaaaggggtgactctggaaggcaccagcatgcattcagcagtggaacagggagcaatggcttagcatacctggaagctctggctcctcactgtaagaagtataatggggacacttgcttgctctctttggggacatgaagagaggtattgagcaactttgtaagtttccattacgtgaatgcctagatgtgtagtgatagcatcaggtgagaagaaggaaagcctgaaatgcctccaaccctactttacccagtaaagaagccaaagcttagggaggttttgaacttgcctaagtacaaagcatccatagcagaactaagaaatctcccaactccaatcctacatccctgaacccatcctgaaataaggaggtggcagtgcctgtaaaccagggtactccatattctattctccagagccccacaggcccggacagacagatgggttcttggaagggtgagtcatctaccctccctaagtcagaaatgcagagttccctggggaactgacaatcctgacaatcattcctgtcccttccttctcacacatcttgaaggtcatctgctacttaggaatttgctgacgcaggccagtggaggactgagaagttccaggaaaagggcagggtctgacattgtccaaaaaagaaaacaatcagtgagtcaagcctggagatgggggtggtggagatgagaaagaggtggttttatgatatgtgaggaaccaggaagaaagacaattgtcatctggcctttccttacaaattgagggctccccaccacccgctgggctctgaaacctacagcctgctacgggacaccatcccccatgtggaccttcccaggagacctgggctccagcacatgccagcggcttgcttggttccccattttcaggggtttctgagtaggaagggtgatttatagactcaggttagacagggctccagtatacaaggaactgctacaagtgagcagggagaggaaggtattggtctgaggtccccgaacagagagctccagacacttcctaaaagttaagcatagcatgatcggagcctgggtattatagtgagaccctgtctctacaaaaataaaaacattaaaaaaaaattagactggtgtggtggcacataactgtagtcccagctacttgggaggctgaggtgggaggatcgcttgagcccaggaggtaaaggctacagtgagctgtgactgtgccactgcactccagcctgggtgacacagcaaggtcctctctccaaacaaacaaacaaaaacccaatgtagctacaatgtcaggcatccccacggaaggaggaaggaaggaatctcctgactcgggttaggcactggaaaggtgtcaggctggcaggagctgccggttcaggacacttcccttggaatggtccttgacataaatcacactgccacaacacacagggcccctgatggggagctgttctttgaagtaccttagaaagaagtggcctgctaagaaagcaggaagaacacaatgaaagggttcagagcacaggcattccagtccaatctggaggcctctgaacaaggccagatagttctggctctgtcacctctttgctatgtgttaacctctgatcacgctttggctagtaagcatggagatagttacatgtactgcatagcacaatgcctggccaaagatggcactcaaaaagctgtggccactgttagtgctactcaggagtaatgaggttacttgaggaagaaattgtgtggggagggagtgttggggggtgaacggtgggaaggcagacagagggtgatgtgaggtgaggaagccagagaaacaccctgggttgaatgagcaggggagacctcaggcatcaaacctaaggaagccctcagttttctgggatggttggggagtgtcaagtcttagcctcagttccacatgactggctggttgttgctatagctgatcccatgacatgctgcaggggaagccaagacagcagagaaaggaagtagctatgtgtagatgccaaggtcgggctgttccatcaaaataagaccaggcctttatgaaccactgccaaaatatgaatttccaagagcaaaacgttcatatggagtatgtgtatgtgtatggggggcggaggagggcgggaggcagaaaaagaaacagctgattgttttaaagctattttataaatgccctacaatgtagatggtaactaacactaagcaagatcatttatggctttttatttttcttcctgatcctttactttttgccatcctttccccaaatattctataattaaccaagtattacttttacaatcagaaacatcaggaaaattcacacatgacaatgttccttttctagtagtcatagatcatctatcttttggtaaaactactccctagactaaaacaccctccattttaaggaaaaaaaaaaaaaaaaaagaagatgcccataagttaagtgtagataagatggtaaatgaaccaaaagtgttgccattccacccaaaccaagtacttaaatgcaagatacactcagaaagcatcaacactcaactcctttccaaacatttcaggattcattaataacggtgggtttgtccctaacgactgttctaataatactgctattgttctgaatgatttttaatcattctaaagaatgcacaactgaaaaatccctcaaagaagatatgtaggaacaagtcttcccccatgatgaaggaacggcaggctttcctgggtggtgcgtaagttgactctaaagtcatttccgtaatgggagctccaagtaggcctttcatcacaggaataagaaatagtcaagggcatacaaacattctttaaaatagcaaaaatttagtgatacacacatccaacaataaggaaatgagtatactatggtacacttccatggtggggaaccgcatagccaggaaaagtaatgggcgtggaaggctactcacaatgaattaagatctgccaagcaaatggaaagcaaaaaaagcaggggttgcaatcctagtctctgataaaagactttaaaccaacaaagatcaaaagagataaagaagggcattacataatggtaaggagatcaatgcaacaagaagagctaactatcctaaatatatatgcacccaacacaggagcacctagacgcataaagcaagttcttagagacctacaaagagacttagatttccacacaataatagtgggagactttaacaccccactgtcaatattagacagatcaaaagacaggaaattaacaaggatatccaggacttgaactcagctctggaccaagtggacctaacagacatctacagaactctccatcccaaatcaacagaatatacattcttcttagcaccgcatggtaattattctaaaattgaccacataattggaagtaaaacactcctcagcaaatgtaaaagaacagaaatcacaacaaactgtctctcagaacacagtgcaatcaaattagaactcaggattaagaaacccactcaaaaccgcacaactacatggaaactgaacaacctgctcctgaattactgggtaaataacgaaatgaaggcagacataaagatgttctttgaaaccaatgagaacaaagacacgacgtaccagaatctctgagacacatttaaagcagtgtgtagagggaaatttatagcactaaatgcccacaagagaaagcaggaaagatctaaaattgacaccctaacatcacaattaaaagaactagagaagcaagagcaaacaaattcaaaagctaacagacgacaagaaataactaagatcagagcagatgtgaaggagatagagatacaaaagacccttcaaaaaatcaatgaatccaggagctggttttttgaaaagatcaacagaatagactgttagccagactaataaagaaggaaagagagaagaatcaaatagacgcaataaaaaatgataaaggggatatcactaccaatcccacagaaatacaaactaccatcagagaatactgtaaacacttctacgcaaataaactagaaaatctagaagaaatggataaattcctgggcacatacaccctcccaagactaaaccaggaagaagtcgaatctctgaacagaccaataacaggttctgaaattaaggcaataattaatagcctaccaaccaaaaaaagtccaggaccagatggattaatagctgaattctaccagaggtacaaagaggagctggtaccattccttctgaaactattccaatcaatagaaaaagagggaatcctccctaactcattttatgaggccagcatcatcttgacaccgaaacctggcagagacacaacaacaacaaaattttaggccaatatccctgatgaacatctatgtgaaaatcctcaataaaatactggcaaactgaatccagcagcacatcaaaaagctcattcaccacaatcaagtcggcttcatccctgggatgcaaggctggttcaacatatgcaaatcaataaacataatccatcacataaacagaaccaacgacaaaaaccacatgattatctcaatagacacagaaaacgccttcaacaaaattcaacagcgcttcatgctaaaaactctcaataaactagatattgatggaatgtatctcaaaataataagagctatttatgacaaacccacagccaatatcatactgaatgggcaaaaactggaagcattccccttgaaaactggcacaagacaaggatgccctctctcaccattcctattcaacacagtattggaagttctggccagggcaattaggcaacagaaagaaataaagggtattcaattggaaaaaaggaagtcaaattgtctgtttgcagatgacatgactgtgtatttagaaaatcccatcgtctcagcacaaaatctccttcagctgataagcaacttcagcaaagtctcaggatacaaaatcaatgtgcaaaaatcacaagcattcctatacaccaataacagacaaacagagagccaaatcatgagtgaactcccattcacaattgctataaaaagaataaaatacctaggaatctaactcacaagggatgtgaaggacctcttcagggagaactacaaaccactgctcaaggaaataaaagaggacataaacaaatggaagaaaattccatgttcatggataggaagaatcaatatcatgaaaatggccacactgcccaaagtagtttatagattcaatgctattcccatcaagctaccactgactttcttcacagaattggaaaaaactactttaaatttcatatggaaccaaaaaagagcccacatagccaagacaatcctaagccaaaagaacaaagctggaggcatcacgctacctgacttcaaactatactacaaggctacagtaaccaaaacagcatggtactggtaccgaaacagatatatagaccaatggaacagaacaaaggcctcagaaataacaccacacatctacaaccatctgatctttgacaaacctgacaaaaacaagctacagggaaaggattccctatttaataaatggttctgagaaaactggctagccatatgtagaaagctgaaactggatcctttccttacaccttacacaaaagttaacttaagatggattaaagacttaaatgtaagacctaaaaccataaaaaccctagaagaaaacctaggcaataccattcaggacataggcatggacaaagacttcatgactaaaacaccaaaagcaatggcaacaaaagccaaaatagacaaatgggatctaattaaactaaagagcttctgcacagcaaaagaaactgtcagcagagtgaaaaggcaacctaaagaatgggagaaaatgtttgcaatctatccatctgacaaagggctaatatccagaatctacaaataaacaaatttacaagaaaaaacaaacaatttcatcaaaaagtgggtgaaggatataaacagacacttctcaaaagaagacatttatgcagccaacaaacttatgaaaaaatgctcaccatcactggtcattagagaaatgcaaatcaaaaccacaatgagataccatctcacaccagttagaatggcgatcattaaaaagtcaggaaacaacagatgctggagaggatgtggagaaacaggaatgcttttacactgttggtgggagtgtaaattagttcaaccattgtggaagacggtatggtgactcctcaaggatctagaacatctgacccagcaatcccattactgggtatatatccaaaggattataaatcattctactataaagacacatgcacacgtatgcttattgcagcactgttcacaatagcaaattcttggaaccaacccaaatacccatcaatgatagactggataaagaaaatgtggcacatatacaccatggaatactatgagttatagttctttgcaggaaaaaggatgagttcatgtcctttgcagggacatggatgaaactggaaaccatcattctcagcaaagtaacacaagaagagaaaaccaaacaccacatgttctcacttgtcagtgggagttaaacaatgagaacacatggacacagggaggggaacatcagacaccagggcctgtcgggagttggggggtgggggagggatagcattaggagaaatacctaatgtaaacgacaagttgatgggtgcagcacaccaacatagcacatgtatacctatgtaacaaacctgcacattgtgcacatgtaccccagaacgtaaagtataatttttaaaaaagaacttaaaccccgtatctccgagaaaaaaaaaaaatacaggcacttcttatcaagttcctgaaaatgttttagatagcaaatgttctgggtatttgggtagaaaatgtaatgagtctatttccactattttaagtaggaaaacgtgttactgttcatccaaaaccccaaccggccccccaaatatcaattaaatatatatatacacccacacacatttgacccttgaacaacacaggtttgaactgcaggggtccatttatatgcaattttttttctgaaaatatattggaaaatattttggagatttgcaattgaaaaaactgttagataaactgcatagcctagaaatattttttaaaattaagaaaaatttaggtatgtcatgaatgtataaaatgtatatagatactagtctattttatcactacccaaaaacatacacaaatctattataaagttaaaatgtgtcagccaggcatggtggatcttgcctgtaatttcagcactttgaggggccgaggtgggtggattgcttgagccaagagtttgagacgagactggcaaaaccccatctctacaaaaaaaaaaatagccaggtgtggtggcgtgtgcctgtagttccaactactcaggaggctgaggtggaaggattgcttgagcctgggaggttgaggctgcagtgggccaagacacaccactgcactcccacctgggcgacagagtaagaccctgtctcaaaaaaataaattattaaaacttacacacacaaacacagaccagacatggcaccaaagtaaagagaaatgtaaacaaatgtaaagatgcagtattaaatcatactgcataaaatcaactatagtatatactgttaataatgccatagccacctcctgttgctattgcagtgagctcaagtgttgcaaggatctacttatcagcagggatatgattagtatcatgtgatgctaattatctgtgagctgtttgcctctttaagaaattgcacatcacagtaaaaggtgatctcttgcagttcttgagtattttctttatcgtgttaagcgcaatagtgtaaaacttgaatgacacatgagacccttacagggtgccacaagtgatgctggccacgctcccaagaagcagaaaaaagtcatgatgttaccaaaaaacagttgaactacttgatatgtactacagattgaggtctgcagttgtggccgcctgccatttcagacaagtaattcatcttgtaaacagacgacataaactgatggtatcaataactatagtacagaactgtaatggattttctcttccttacgattttctaagtaacattttcttttctctagcttactttatcataagaatacagtaggcaatacatataacacaccaaatgtgtgttaatcaactgtttatgttatcggtaaagtttctggtcaacagtaggctattagtaattaagttttgggggagtcaaaagttaaacttgaatcttcaaccgtgtaggtggtcagtgtccctaaccctgcattgttttagggtcaactgtatataaacatatataatatatattacatatatacgtaaaaacacacatatacatacattatatatacacacacaaatacacatatatatgcacatatatatatgcaatccaaagaaattgaacataaaacatttaacacatcaaataattatttaataacatttaaggaattcactcatcagtatacttactactgtgaagtaggtctcaactcctacaccaactggtgctaaagactaggacgaaaataaaagagggtcataacagtggttctcaaactttagggagcatcagaatcacctggagggctcttaagtagatgattagactccagccctagaggttttaattcaggtgggctagtgtaaggctcaagaatgtgcattttgagccagcactcaggtgctgcgtttctgctggttcagggatcacactaagaaccactgggttagagggtgacctggcataagggccaggttactttagattgggttggaaatgtttcttccaacagggttataaaagaagctgttagttcttaaatatttaggagccgcttctacttttaagggcccatatgattatgacattgaatgcaagccattaggcaagaccttgtgatatggtttggttgtgttcccacccaaatctcattttgaattgtaactcccataattcccacgtgttgtgggagggacctggtgggagataattgaatcactggggacggtttcccccatactgttcttgtggtagtgaataagtcacacaagagctgatggttttataaggggtttcccctttcacttggctctcatatttctgtcttgtctgctgccagtaagacgtgcctttcaccctctgccatgattgtgaggcatccctagccacgtggaactgtgagtccattaaacctctatttctttacaaattacccagtcttcggtatgtctttatcagcagcatgaaaatggactaatacacctccaaaatctcatgttgaattttaatccccagtgtcggaggagggacctggtgggaggtgactggattatggggtggtttctaacagttcagcaccatccccctagtgctgtcttgtggcagagcttaggaaatctggttgtttgaaagtgtgtagcacttccccctttgctgtcttcctcctgctcccgccaagtaaggcattcttgcttccccttctccaccatgattctaagtttcctaaggccttcccagaagcagaagcctatacagcccaaagaactgcgagccaattaaacctcttttctttataaattacccagtctcaggtacttctttatagcagtgtgagaatggactaatacaccttgttcctgtgttaacttccatttggtgagcaaatatcaagggccagttgctaagatagatgctcttgacatagtaactggagttaatcctcacaataataccataaggtaaactgaacctttgcctccaattacagggggaggaaacaagattgaggaagagaactaatttatgcaactaacttatgtggtaggtagaataatgcctctcttccccaaaaatgtccgtatcctaactccaggaacctgtgaaaacaggagaccttgcatggcaagtgactttgtagatgagattaaggagattattttggattattcaatgggcccaatgtaatcccaggggtcattgaaagaggaagaaggtagcagagtctgtcaaagactcatgaccgacaacagaaaaagaggcaagaaatttgaagaatgagatgaagacacgaagggttccctaagccaaggcacacaggcggcctttagaagctaagaatggtcctcaactgacactcagcaaagaaacagaacctcagtcctccagtcacaaggactatattctaccaggaacctgaatgagcacagaaacagactctcccctagagcctccagagcagcacagagccctgccaccttgattacagccctgtgagacctgtgtcagacttctgatttacagaatggaaagattaataaacttgtggcatttgaaacagctaaatttgtggtggtttcagcagcagtagaaaattattataaggccgagtgtggtggctcatgcctataatcccagcactttgggaggctgaggcgggtggatcacttgaggccaggagttccagaccagcctggccaacatggtgaaaccctgtctctactaaaaaaaatacaaaaattagccagatgtggtggcactcacctgtaatcccagctacttgagaggctgagacacgagaatcgcttgcacccaggaggtggaggttgcagtgagccaagactgtgccactgcactccagcttgggcaacagagagagactgtctcaaaattaaaaaaaaaaattattaaaattattatagcaacctctgaactggaaactggtagaacagcatttaaacccaggtctaagctctgagtgaacgaaccatagttaaactctagtggggagacgggagacttcttataaattcagcttctgaaatacattagttaagctgaggtcattagagaagagagttgacatcagtggtgtttccacaagattcacagttgcccatgagtatggttactcctcctaggagcctgaggccttacagactgaagaattttaaggctagaagtgtcctcaaaataaaacccaatgtttttattttataggaaattagtggaggcccagtgggatgaaattacctgtcccaaggcaacatgttagtcgcaaaaccaccctggatggatcttgtttctattcgccaggggctggcaactcacaagatacctagtgtcagcaatgtcagagaactagagcttttgaaccccaggtctgcgtgtcaccttggagacatacacaatacctgctctagccatgcctgttgaagcgcccagacaaacatccatcactcagttcacggaacaaattacatcagcaggaagagacaaagagaaaacaaccatcataacggaaaaggctttccaatccagccaaggttctcatgccaggaataaccactccaaaactctttgtgtgatatacatataaattctagggtacatgtgcaggatgtgcagatttgtttcataggtaaacgtgtaccatggtggtttgctgcacctatcaacccatcacctaggtattaagcccagcatgcattagctgtttttcctaatgctctatccccacccaccccacctgccgacaggcgccagtgtgtgttgttcccctccctgtgtccaagtgttctcattggtcagctcccacttattaggccagaactctttggaccaaacaaatctgcagcttcccctacaagggcctttcctgcagtttgttccggaatgccaatccctaactctccaaagagtcctatctccgcactcacggcccctcccgtgttaagtacacatgcaaaaccaaggtttagtgaatatgtttcctaagatataggacataagtaaaaagaagtctttgcctttagaaagcctcaagcacttctgggcttggcaatgtctgtggcggtttggctgaggttcttaaagaggtggcccagaattttccatgctctacttttcaagagcttctaccagcagctgtcaaagatgaatgccattaggcaccccactctctcaccctaagatccattttatttaggcttttatctcctaagccactcagctaatgggatgtttttcttacagctaagttcagcaaacagtttctagtttccactgtgaaaatacagaggccacaagttttaggactgtttggcttgtaggggaggcagcctccctttctgcctctccttcataaactgccacgtaaatagccacattttggcaaacgttgccatctccctcaacattcggggctctgtgccttcttcagggaactgggagtaaaccgccaggagtggagaacttgaacaactgctcagggatcgcagggtacctgaaataattagcagccgccgcgtttgtgctgagcgctttccgtcaatcatctcaaccaccctgtgaagtgaagcctattgttttacccatcaagtgctgttaaatacttccagaaatgaccagtgaagagcctgggtatcactaaacggccataaaaggcacactgcttaatgttggttttttttgtttgttctttgtgggttttgttcgtttttgaggcggagtctcgctcttattgcccaggcagtagggcaatggcgcgatctcggctcaccgctacctcagcctcccgggttaatgttgttttttgaaaagtcagcagtcagactctaagaagggtgcggcccgagccgacccaagaaaacaaaacatcacgttgtacttaaaacgtccgtttcggccgggcgcggtggctcacacctgtaatcccaacactttgggaggcggaggcgggcggatcacgaggtcaggaattcaagatcagcctgaccaacatgggaaaaccccgtttctactaaaaatacaaaatttagccaggcatggtggcgcatgcctgtaatcccagctactcaggaggctgtggcaggagaatcgcttgaacccggtacacggaggttgcggtgaacccagatcgcgccactgcactccagcctgggcaacagcgaaactccatctcaaaaaaaaaaaaaagtccgtttcgcccgacacctgcttttcaaaattacacatttagaccgcgaggggagagaggaactgccgtgaccacggagggctggcctttcccccggcgcagtttctctggaccgctagagcttcccttgagacgaaagcgatggcaggggcccgggtgcgaggctgcccccgagggaatggggggcgcgacgggggtaacggggctgcttctgggagagggcgcgctccccgtttctccttcctcgtagataaaatgaagccagcgttcggctaggacaccgggccgcggtgacgggttggaagggccaggcctcgggaggctcgcccggcaggggtcgagtggaaagcgaggacgggggtagcccccacagaccctccgcccgggcccagactgccgccgccacctcggctcggctcacccaaaccccagcaggccttcgggccttcttacctggcggcgcccaagatcctcttccagcctcgagccgcttctgcgctcagcccccgcattctttcgctccagcccgcaaggctccgccccccggcccc

SEQ ID NO: 1605 - DNA, 19718 bp, Homo sapiens
  source 1..19718: mol_type = genomic DNA
ttagaaggaaaagagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagtatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactatgtcacctacctctccactcaaatgccccattaagtaccatcctgttggagcttcctaacgcccctgctccctggtttcatttggaaccaactgagagacacaagtccctcttcgttgatcagggtcagttgaaagatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacactgaagaaatgtgacatgagggtggaggttcctgtccagcattcttcactctctatttaaccgaggctgactcattgcagttggcactaattttccattgccacagccctctccagccaggagggcctggagtacctgaggtgctgtttgccgggttcccttggtcctcagactgctcccttcagagaaagcacagaaagccttctctgtcccaaggagccccccttcccctcccccactccagctctgcatctggacacactgtcagccatcagatcctgaccaggtgctcagcctctttagggatatgtcacaatttgccgtgcccggtggctctgggcagcctttggacatgtagtggttgtgtcttggaatacaagagttgtgcctgaatctgggactctctgtgaccctgggaaaatcacatcagctctctgaaccccaattgtctctgatctataaaatgaagacagtatctacttcataggattgatttgatggacatatgtataagcagtgccagggacaactagtaggtggtcattggagtgtggctacagttattatacagttacacatggattccttgattccccattaagccctggtggatgaatgaggaaaatgcagcagggggtccatcctagaaaacccaacccactccagataatcgcgccagcctcacacctgagaagctgcttctacgacctgctgaggacataatgataaacacacacaagaggctactgtgtcccaggcacttgtcttaactcatttaacttttctaacaaccctaaacctagggttctcattttccagatgagaaaactgaggcatgtaaggttaagtaacttgcctgagggtcgccgattagcatcagagccggcatttcaaatagacaggccagctctagaggccagggtgtttggacagcctccaaattgtcaccctagccttcagggcaaggctgcacacacggcctctagtctcctacccctcttcctggcaggaggctggctctgacaggaggttgtttgtgccacaatttaaggaccaagctattctgggaagcccagaacagtctttcctttattattcatctcaattaaccattgtgttggtctggacttgggggtgcaggcattcccatctccctttcaaaaaagtttctaaaaaatgcagagcagcctttattcttgttttcccaggtaaatgtggtcctatgtacttgcagagtaagaatttaaaaaaataaacctgagaggtagtttagtggaatagggagtacagaggcctggaagatgagggagctgggtttaagccccatcaaccggcatcaactagccatgctaccttgggcaaaataaccgtagctaacacttagtgaccacttactgttgtgcgttctcatgttatcctgacagtaacacttatagggtaggtctgtcagaattttctgtccacaagcaacagaagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctaccttgtttgctgagtcttctggctttcttccactcttcctgctcttggacatcagactccaggttcttcagcctttggaatctaggacttgcaccagtgggttggttgccaggggctcttgggcctttggccacagactgaaggctggctgcactgtcagcttccccagttttgaggtttttgaactcaggctgagccactactggcttctctctaacccagcttgcagacggcctattgtgcgacttcgccttctaactgtgggagccagttctccctaataacctccctttcatatatacatatatcctactaattctgtccctctggagaaccctaatacatgaattataactctaagtttcagttctggccatagcattatgtcacaccaacaccagcatcaatattttaggttgcctaattaatgtatctgtaaacctatagccagcttgggtggggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcacccacctagaaattaaggtactgtggtcatttatcttatcccagaataacaggagtgtgtataaacaggaagctttagtttagataaataagattatccattacaaaaattttatattgaataacctgtaagtaatttgaaaaagagacttctggctagttttcacttatgtccaagtcagtgggggtaaatgcattgtgattcactgtaggttttagactcttacagccttaacaaccttgtaaatccataactagcatcttcctatctggcagaccctttacaaatgcattatctcaagcctcacaacaattctttgaggtagacatagaaagtgaaagttcagaaagggtttaaaaaaaaaaaaaaaaaaaaacttgtccagagacatagccaattagtggaagagggtttgaacccaggttcctaactacaaaatccacgggtttaactgctgctctcctgaaatgaaatatctacaagaagtagcaggcattgagaaacagatgggaagatagtgttttgatatgattttctgtttacaggaaggcctaactacgtcctgttcacctcatgctattgggtaactttccagtaaaaaacaattgcactttgttttcttttccaaaaagaggcagaaactgatttcttcaaagtaaaaaggcaccagggacccattctagactttccaaagctaggcacatattaaagagagtatacaaaataggcagagaagtagacttgctgacctgaggagctgagtgggaagcatggacttgccaacttacctaagtgaccttgagcgatccagctaactttgcatagtttcctcttgtgtaaagtgaggtgcaagtacagatgaaaatgtatataaaacatagagcttagaatcctgtaccagaaagctgccctcatcacaatgaatgtcagtcagtactagctccagccagctgctcagcccatcaagaatccctcagggggatctgttagcattagttcagatctgttggcagcaacagaaactaatgcgagctagtagactttgaacactgctaaagaacttaccaagagaactcagatgtataaaagtggttaattctgtcaagaggcccaaagtcttgggcaggctcttattttttcaggacacacataagacatgggggctaactgcaaggacacaagaaaaatatacccataccttgaagcccccagtacattcaagaccaagtttggcaaatagattagcatctttcaggaaataccatgagctccacttatctactcatcaggtgttccttgcacccctagctcatccccccaaggggacaatccaatgggcttatcaccacccaatactgaacactatgacagttcctgtaaatccagatgagtggagggcacagggtattggctctcgagcagagagccagtaggcatgactggtgttcgattcctaactcccctgctccctggtttcatttggaaccaactgagacagacacatgaatccctcttcgttgatcagggtcagttggaggatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacattgaagaaatgtgacatgagggtggaggttcctgtccagcactcttacactctctatttaacctaggctgactcactgcagttggcactaattttctattgccacagccctctccagccaggagggcctggagtacctggggtgctgtttgcctagtactataaatgtctttacattacagtattgcctttgggtccaggcactcaaccttgtctatggcatgagtcacagcaactttttgcagaaagcaaccccaaagtttaaggccatttatatgacccttgttgatttggacagcttaacagccccatctccccatttagtggcactcagattttgctttagaggactaccttcttcccagtgtagtctggccaaaaagtgggtacatgacacaagatagcagtaagccaatctcatcctagaatctcaatcctgagagaggcttccaaaactgtcgactcctggctttctggagtgtggctgaattccccacccccccgcccccaaaaaagttcccagaaattcattttctgcttaaattcatcaaaattgtttctcattccttagaactcacatgaaatgagcttctttgctcagccggtggctgtgggcatggtcagtacttcctcaggccaaaaaaaaaaaaaaaaacctattgatgtaaggaaagacactgagctaacagagaacacagagcaccaaggtaatgctaagttttgataagcaagtttctattttcctatgttcagggaacggcatcaacagaagaaagctggcactgctcaggatgtcttctttcagttgctaccattaagcatactgcatatccttttcggccataaccacattcacccacttgttatatttcattttcagaaaagcatcattcattgcactcggtttgtccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggtgtgtatcattttttagaagagcttctgaaagcctcaaacatctgtgagtgtgctaagagccgttacaaaggtattttatacaatctatgctgagtcagctaggagttagcaggaggctggatgcagatggtaaaacatacccctgcagatctgttgttattaaggatgacctttggaagtctcaaactgtaaccacaaagggtgtccccactgcattcatactatatacacacatacctgaactgcctttctaccagtaacatttaaaataagcacacttaatactgccagtcacatgtagtagagtgttcactctgtaactgtgtgtggcaaagccaagatatcctaccattccaataaaaaaaaggcaaggaaatagctttaacacaccattgatgtatgctattacacttttccagtggaagataacaaagcccatataaaatttaaagacagaggaaaaactcgattttcagccacttgtacctctctaagttttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttcccaacaggatccatttggaaaatatcaagcctttagaatgtggcagcaagagaaagcggactacgcaggaacggggagtttgggagaagctctcctggtgttgacttagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaaccctgtggggagacacacacaagggtaagaaagtaagtgggaagagttctgtatctgcttttgaatcctcaattctatttcgtatgtatcctgtgcaagtagagacttctaggcaagatgctcatcccaggtgggttgtaaaggagaacaattaagtaaataatgatacacctctaaatagagcttttacagaaaaccaaggtctcatcagagccagtatagttatgggggtgggacggaggaggaacaggcatttatactgttaagagggaaatttggtaatatctgccaagattttaaacacatgccccctttgatccagcaattccacttttagaatttacgctatgaagttacttggggattttttccttttcttttcttttttttttttagagagataaggtctcactttcttgcccggtcatctggtcttgaactcctgggctcaagtggtcctcctgcttcagcctcccaaagtgatagaattataggggtgagccaccatgcccagccaaagctatgtataagatatatgctcaagaatggtcagaaaaaaacctgaaaaacccagtccattaatttttaaaaagtgttaaagaaattacaatagaattccttacaatgcaagttccatgcagataagaaatgacgtgggccttcaagtgctaacatggaaggagcttgatttaaaaaaaaaaaaataaaggtggggggggggcagaaaaataggtaaactggactccatcaaaatttaaaacttttgtgcttcaaaggacattatcaaaaaataaaaagataactcacagaaagggagaaaatgtttgcaaatcacatgtaaaccaccaggtgcggtggctcacacctgtaatcccaacactttgggaggctgagatgggagaattgtttgaggcgggaagtttcagaccagcctggtcaacatggcaagaccccctctctatttcttttttaaagtcatatgtaagagcatagtatccaggatatagaaaacattcttaaactctacaataaaaagactaacccaattaaaatatggacaatgaggccagtgtgatggctcacacctgtaatcccagcactttaggaggctgaagtgagaggattgcctgcggccagcctgggcaacatagtgatatcccaactctacaaaaataaaaaataaaaaaattagccaggcagggtgttgcgcctttagtcttagctacttgggaggctgaggcaggaggatcacttggactcaggactttaaggctgcagtgagctatgattgtactgctgcattccagcctaggcaacaaagcaagaccttgcctctttaaaaaaaaatgggcaaaggatttgaataaacatttctccaaagaagattctcaaatggccaataagtacatgaaaagatgcttgatatcattagtcattaggaacatgcaaatgaaaatcacagtgagataccactttatactcactaggatggctaagatcaagaaaatggtaaatagcaaatgttgcaaggaagtggaaaaaattggaaccctcaaacattgctggtgggaatgtaaaatggtgtagatactctggacaaatttggcatttctgcaaaaagttaaagatagagttatccatttgactgagcaattccactcacaagtgtatatacttctgccattctctggaaggattcccaagtaatttaatactgttatcatcatggaagaatacacttcgtttatgtttctattgagtttttcaaatttgccacatggataatttttaaaatatttgaaacttcattttaaaaatcattagattattcagtaatacaggaaaagtttctataagaacatgctatcatggtctcatttttggaaaaatagccttgggcacacaggaaaataaaggccagatgtatacactccaagtatcttatcgtagtttgaattgaaaactacgttcacacacaagtttccacatgaatgttcatggcaccatgattcaaaattgctaaaaagtggaaacaacccatatgtccattactggtgaatggataaacaaaatgtgatatatccacacaatagaatactatgtggccacaacagaatgaagtactgatacatgccacagcatgagtgaaccttggaaacattatgtttagtgaaaaaaaagctagtcgcaaagtgccacaatactgtatgattccttgcatatgaagtgcccaggagagccaaatctatgaagacagaaagtacatcagtcactgctggggcatgcaggagggaggaatgaggactgactgctaacaggtttcttttcaaggtgacagaaagatcctggaattagacagttgcgataagtcatacaaccttgtaaatatactaagagccactgaattatacactttaaaatgtaaacgttctggtctgtgaattatatctcaataaaaaccctagatgcagaacagtgtatagaatgtgacccatttgtggaaataaagcacatatacattgaggtaagtgcatttatttttctctggaaggattcccaagtaatttaatagtgttatcatcatggaagaatacacttcgtttatgtttctattgagtttttttaatttgccacatggatgatttatttttaaaatatttgaaacttcattttaaaaatcattagattattcagtaatactggaaaagtttctacaaaaaacacgccatcatggtcccatttttggaaaaatagccttgggcacacaggaaaataaaggccagaagtatatactccaagtatcttatcacagtttttttaatattcagaaaaagcatgttaggtgaaaaatgtattagttgagagagtggtattatggtagattttcttctccaaaaataactgagtgcctgtgtgctagatactggggtataagaaggtatttgtccttgccctgaaagtggtttcttatcttctgtgctggaaagaaaaaaacgcagatgcatacttccttatttcaggcttgtagctaatttacccaattccatgcagagcttggaacacaacacttctcagtttataactgcaggcataactgtcctgtcctcctcctctgaggggatgggtatctggattggaatttaatgaagtttagtcaagtggcagagtccacatagagtattccagaaatggctctagttgctgaagtcttaactaaataactggaagcttctaatattgtactagaggctgctggtgattcagacaagttactgctttgtaacagtaattacgcattggaacttgaaaagctttaaagctatcagaattttaattagggaagcctagaagcttggggagaacagacagtaatttatgaataattgctaccaattaatcatttactatgtgtcgtgcagcgtaccaaagtgctttacttgaattatcatattcaaacaacagccttaacgatggtaataatctcaccaaagccagccttggaattatccacataaaagtggcttatatcagaatccctggagtgttacaggttttctcctcctcactctttttgaagacttcggctcaagtctatctaaagtcaacagtcttcagctgtcctaggcacccttaaatgtggcccttgttcagaacgtcattacagcagtgaccacttgacactgtcatcagaggctccttcaagactaagtacatttaaccttgcttacacttccatggtttatactgctaggatgccagtaaatattggttgaattagcagccaacctgtctctcttctagacttactttgtatagcaccatcatatctgtctctgtgcaaacgtcatagcgtgtagttacacaaacttacatggaatagcctagtacacactcaggctatgtggtatgtcctattgctcttaggctacaaacctgtacagcaagttactatactgaatactgtaggcaactgtaatgcagtggtaaatatttgtgtatctgaccatatctaaacatagaaaaatacagtaaaaatatgacacaaaagattttaaaaatggtacacctgtacagggcacttactgtgaatggagcttgtgagattggaagtcagtgaatgagtggtgggcgaatgtgaaggcctaggacattgctgtacactactgtagatgttttaaatattgtacatttagtccacactaagcttattttaaaaaatcaaccctagtttactgccactttactttagaaattttttaattgtaaatgtttttacctttgtaataaaacagggtaaaacacaaacatgttatacagtggcacaaaaatattttctttctattcttattttataagcttttttatttaaaaaaatttttaaaaacttttcttgtttttgttaaaaatgaagacacaagcacacacattagcctagtcctacatagggtctggatcatcagtatcactgttttccacctcttcatcttgtcccactggaaggtcttaggggtaagaatactcatggggctgtcctgtcctaggagagcaatgccttcttctggaatacctcctgaaggacctgcctgctgaggctgtttttttttttttttttcttttgtagagacagagtcttgttctgtcacccaggctagagtacaatggcacgaccttggctcactgcaacctctgcctcctgggttcaagcaattcttctgcctcagcctcccgagaggctgttttatagttaatttttttagtaagtagaaggactacatgctaacatgataaaaaatatagtaaatacacaaaccagtaacacatttattataaaatattatatactgtatataattatcaaaatatcaagtattatatattgtgttatattttagttttgtaataaactaccaaactgtcatccacagtagctatactggtttgcattcccactaggaatgaatcaaagttcccactgctgctgggcgtggtagctcacgcctgtaatcccagcactttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgagggttttaccttggacactaagaacattctgaaactgccattcctcgctggcatcatttgcacacatcgattctatccagaaccacaccccagcaagaacagagggcatgtctttgctggtttctttcctctgtctaccacttcctaaactctattttaacagggtgatggaggtgaatattctgtagtctaacaaatttggaaaatgcagactggacaggacttgtgcatgttagcattgcccatccccaaattcatgagcaccttgctctgaggctaccgagccctggcacctgctgttgcccctcccaggcacacccttcccttcttagccctcttacctcctacgtgtcctttgagctcagcttgagtctcctcaggactctgaatataccagataccccatggaatgagacagaggcatatataatgacatttaggacagccaaacaggcctttgtcataattttaattgtatgtgtcctttctttatctttgcatccctagctcctaaccctctgctgggcacacagtaggttctccaaggtctgggaggcagcacagggctgctgtaaaagagcacaagctttggaatcagatggacttccatgttcaattcctgagtcggttacttaaccataatttcttgcttaatctgaacctccatttccacatttatcaaatggaaataaaagatcacccttagaagtgcaaaacattaaatttaaaatgtatgaagaaagtgcttagcccaatacacacctgacgctaataaatggtagctattacttgatgcaagcctaatgaggattacagtggcacaatttttttcccaggcacttattaccccattacatttaggagacagacaggggaggctcttaccagctttggtaatgagacacgcatcaaaatcagatgaacaattgacggctgttttgcagtcagcagttgggttaggacagttgtagcactgcaggctatgacctagaatcaggaagaaagtcaggatctcttaaagcagcactgacttgtcccctggcagcccaccatctccattaatatgggcccaaagtcagcaacttgtggtatacttccactcccgcacaaatgtatagcagttatatctttccaaattcaaactacagttccagcaacattttttggaccctgatgcaagcacaaaggaaatatccacatttgaatatccatctaactgtgcaattgagaagcttcctcctaacctgcaactggaaggagattagtctgcaatgtaatgatgtgttaagaagaaattaccgagaaacaaacagaattctataagtgtcttccaagcaatgaatatgcccaattaaatcacatcctcgtgggttgatgatcaatgtctggcaatacctatctgcgtgaaaatacattttcaaaatgaaatatgtaaaatgtcatcacagattagtattaatagatgaacatctgcaattgatttgatgcgagggaacactaattttgaaccccaattaagcaaatggttatccccctaaaaagaattctattcccctcattagtagatgtgtattattatgctggactcaataattatgttatgaattttgtcaataaaaaaatctgtgaaaattttgtttcttattattgaggtaagtctcataatacccttgattttgcctcttggtctgcaaagcttaaaatatttactatctgggccaggcgcagtggctcacgcctgtaatcccagcacttagggaagccgaggagggtggatcacctgaggtcaggagtttgacaccagcctggccaacatagcgaaaccccatctctactaaaaataaaaaaattagccaggcatggtggtgcacacctataatcccagctacttgggaggctgaggcaggagaatcgcttgaacccaggaggcagaggttgcagtgagccacaattgcaccactgcactccagcttgggtgacagagcaaaactctgtttaaaaaaaaaaaaaaattgctatctggtcctgtacagaaaaagtttggtaacctctgggacagggtatcattactgaactactcccttctaagggactgaccgaatgccaggagtacacactgtcaaagacaagacaacagctgtgcactttaaacccatgggcataggacagctgggtaccagcagacacaacgtgagggtcatcttacatcagaagcaaattgcctccagttccctagtttgaaaaacaattattgctcccagtcaattcttaagactcatccttgctagctgtcagtttttgctgggttatttttccttctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagcttgcaccactgcactccagcctgggagacagagcgagaccatgtctaaaaaataaataaaataaaataaaataaaaaccaacctcctccccaacttttttgcagatgacaagacagatgtctggagaggtgatgtgactcacacaaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagcaacagggccaggtgcaatggctcacgcctgtaatcccaacactttggcaggctgaggtaggtggatcatttgaggtcaggaattccagaccagcctggccaacatggtgaaagcccgcctctactaaaaatacaaaaattaaaaagtaaataaaaaaaaatacaaaaattagccaggcatagtggcatgctcctgtaatcccagctactcagaagactgaggcaggagaatcgctggaacctgggacacggaggttgcagtgagccgagatcgcgccactgcgctccagcctgggcgacagagtgagactccatccccctgaaaaaaacaaacaaaaaaaaacaagcaataggtcagtggacaatggtttgatattttagccactaagccagggtagacgaggtttcccctgggccataagaggcagagctcagaggaaagttcccctgcagggtcctgagacccttttgggcagcagcaaagaaggcctctcatctgtgggcatgtgagcttcacatctcaattctctgagaaagggctgaagtgcaccccaagacttgtcacagagaagctgatggtcccaagcttgctccataaacaaatgcagactgctggaagtaggatgtcactgggctattaaaattctagaaaatattccaacttaagcagcagagacagaaaaaaagaaggaaccaagaaaaatgaataaataaaaaataattatagaaaaaatatagtgttttaacacaggtgaaccacattacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcactgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctccttggattcccattgtgattgtccacagaacctggaaggaagggacaggaaggaatgtcaggaacgaacaaatgactgctggttgtctcaaaaaccaagggctggaaggccaagaaggcttctgagaggaacatttacagggggagtcaaggcacactgaatccctgggccatgccccagctctgacccacagcaccatatacccttgagtaggctcagtccctataagccccagtgtgtactaccacactgtgggaataacactatcttccccatcagggtcagtgagtcaaat

SEQ ID NO: 1606 - DNA, 19718 bp, Homo sapiens; identical to SEQ ID NO: 1605
  source 1..19718: mol_type = genomic DNA

SEQ ID NO: 1607 - DNA, 19718 bp, Homo sapiens; identical to SEQ ID NO: 1605
  source 1..19718: mol_type = genomic DNA

SEQ ID NO: 1608 - DNA, 19943 bp, Homo sapiens
  source 1..19943: mol_type = genomic DNA
ttagaaggaaaagagattttgcgttatattttttaaatgaagcaatacaatcattttttatgtatatatctagttgaggagaaaaaattacagattttttcccccttactccaagataatctaaacagattttactctggatggcttaattataacataatccatgaagttatagccagggggttaaataagaagttgatgacaaacttggtttctctaacaagtatgcaagaaaactcaagtgccacaatgaacacccataaactgctgtcaggaggcaaagtccctatgaggtaataataaacccacgaggttaaggcaaaaccctacggttgtttctgcaaacaaatgtccaggaaactcaagtttgtgatgaaagaacagtcttgaattcaacttcagcagaacctttccctccctgggctccaaagcactatgtcacctacctctccactcaaatgccccattaagtaccatcctgttggagcttcctaacgcccctgctccctggtttcatttggaaccaactgagagacacaagtccctcttcgttgatcagggtcagttgaaagatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacactgaagaaatgtgacatgagggtggaggttcctgtccagcattcttcactctctatttaaccgaggctgactcattgcagttggcactaattttccattgccacagccctctccagccaggagggcctggagtacctgaggtgctgtttgccgggttcccttggtcctcagactgctcccttcagagaaagcacagaaagccttctctgtcccaaggagccccccttcccctcccccactccagctctgcatctggacacactgtcagccatcagatcctgaccaggtgctcagcctctttagggatatgtcacaatttgccgtgcccggtggctctgggcagcctttggacatgtagtggttgtgtcttggaatacaagagttgtgcctgaatctgggactctctgtgaccctgggaaaatcacatcagctctctgaaccccaattgtctctgatctataaaatgaagacagtatctacttcataggattgatttgatggacatatgtataagcagtgccagggacaactagtaggtggtcattggagtgtggctacagttattatacagttacacatggattccttgattccccattaagccctggtggatgaatgaggaaaatgcagcagggggtccatcctagaaaacccaacccactccagataatcgcgccagcctcacacctgagaagctgcttctacgacctgctgaggacataatgataaacacacacaagaggctactgtgtcccaggcacttgtcttaactcatttaacttttctaacaaccctaaacctagggttctcattttccagatgagaaaactgaggcatgtaaggttaagtaacttgcctgagggtcgccgattagcatcagagccggcatttcaaatagacaggccagctctagaggccagggtgtttggacagcctccaaattgtcaccctagccttcagggcaaggctgcacacacggcctctagtctcctacccctcttcctggcaggaggctggctctgacaggaggttgtttgtgccacaatttaaggaccaagctattctgggaagcccagaacagtctttcctttattattcatctcaattaaccattgtgttggtctggacttgggggtgcaggcattcccatctccctttcaaaaaagtttctaaaaaatgcagagcagcctttattcttgttttcccaggtaaatgtggtcctatgtacttgcagagtaagaatttaaaaaaataaacctgagaggtagtttagtggaatagggagtacagaggcctggaagatgagggagctgggtttaagccccatcaaccggcatcaactagccatgctaccttgggcaaaataaccgtagctaacacttagtgaccacttactgttgtgcgttctcatgttatcctgacagtaacacttatagggtaggtctgtcagaattttctgtccacaagcaacagaagcttacactgagaatttattggagggctttgagacagctcatgtaatggaaagctcttaagaactaggtttagaaggtgcagagaccagggcaacttcagggatccaggtagcaggaaggaatcggtagcctctttggtatggccactatggtggtagacactgtctaccttgtttgctgagtcttctggctttcttccactcttcctgctcttggacatcagactccaggttcttcagcctttggaatctaggacttgcaccagtgggttggttgccaggggctcttgggcctttggccacagactgaaggctggctgcactgtcagcttccccagttttgaggtttttgaactcaggctgagccactactggcttctctctaacccagcttgcagacggcctattgtgcgacttcgccttctaactgtgggagccagttctccctaataacctccctttcatatatacatatatcctactaattctgtccctctggagaaccctaatacatgaattataactctaagtttcagttctggccatagcattatgtcacaccaacaccagcatcaatattttaggttgcctaattaatgtatctgtaaacctatagccagcttgggtggggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcacccacctagaaattaaggtactgtggtcatttatcttatcccagaataacaggagtgtgtataaacaggaagctttagtttagataaataagattatccattacaaaaattttatattgaataacctgtaagtaatttgaaaaagagacttctggctagttttcacttatgtccaagtcagtgggggtaaatgcattgtgattcactgtaggttttagactcttacagccttaacaaccttgtaaatccataactagcatcttcctatctggcagaccctttacaaatgcattatctcaagcctcacaacaattctttgaggtagacatagaaagtgaaagttcagaaagggtttaaaaaaaaaaaaaaaaaaaaacttgtccagagacatagccaattagtggaagagggtttgaacccaggttcctaactacaaaatccacgggtttaactgctgctctcctgaaatgaaatatctacaagaagtagcaggcattgagaaacagatgggaagatagtgttttgatatgattttctgtttacaggaaggcctaactacgtcctgttcacctcatgctattgggtaactttccagtaaaaaacaattgcactttgttttcttttccaaaaagaggcagaaactgatttcttcaaagtaaaaaggcaccagggacccattctagactttccaaagctaggcacatattaaagagagtatacaaaataggcagagaagtagacttgctgacctgaggagctgagtgggaagcatggacttgccaacttacctaagtgaccttgagcgatccagctaactttgcatagtttcctcttgtgtaaagtgaggtgcaagtacagatgaaaatgtatataaaacatagagcttagaatcctgtaccagaaagctgccctcatcacaatgaatgtcagtcagtactagctccagccagctgctcagcccatcaagaatccctcagggggatctgttagcattagttcagatctgttggcagcaacagaaactaatgcgagctagtagactttgaacactgctaaagaacttaccaagagaactcagatgtataaaagtggttaattctgtcaagaggcccaaagtcttgggcaggctcttattttttcaggacacacataagacatgggggctaactgcaaggacacaagaaaaatatacccataccttgaagcccccagtacattcaagaccaagtttggcaaatagattagcatctttcaggaaataccatgagctccacttatctactcatcaggtgttccttgcacccctagctcatccccccaaggggacaatccaatgggcttatcaccacccaatactgaacactatgacagttcctgtaaatccagatgagtggagggcacagggtattggctctcgagcagagagccagtaggcatgactggtgttcgattcctaactcccctgctccctggtttcatttggaaccaactgagacagacacatgaatccctcttcgttgatcagggtcagttggaggatgtagctgtcggcctggtagccaggtgggcttgctaatcctgcacctctaccttaagcttacccagcgtgaggccaggttagaaagtcacaggccttggcagcaggcagagagcctttactgtcatagtgaagagcttgccaaggacaggactgattcttcctccagcctcacctatcggggcagtcattgttccgctgtcaggaggagaggggccagaagggtcacattgaagaaatgtgacatgagggtggaggttcctgtccagcactcttacactctctatttaacctaggctgactcactgcagttggcactaattttctattgccacagccctctccagccaggagggcctggagtacctggggtgctgtttgcctagtactataaatgtctttacattacagtattgcctttgggtccaggcactcaaccttgtctatggcatgagtcacagcaactttttgcagaaagcaaccccaaagtttaaggccatttatatgacccttgttgatttggacagcttaacagccccatctccccatttagtggcactcagattttgctttagaggactaccttcttcccagtgtagtctggccaaaaagtgggtacatgacacaagatagcagtaagccaatctcatcctagaatctcaatcctgagagaggcttccaaaactgtcgactcctggctttctggagtgtggctgaattccccacccccccgcccccaaaaaagttcccagaaattcattttctgcttaaattcatcaaaattgtttctcattccttagaactcacatgaaatgagcttctttgctcagccggtggctgtgggcatggtcagtacttcctcaggccaaaaaaaaaaaaaaaaacctattgatgtaaggaaagacactgagctaacagagaacacagagcaccaaggtaatgctaagttttgataagcaagtttctattttcctatgttcagggaacggcatcaacagaagaaagctggcactgctcaggatgtcttctttcagttgctaccattaagcatactgcatatccttttcggccataaccacattcacccacttgttatatttcattttcagaaaagcatcattcattgcactcggtttgtccaacagagtataatcaagggttttttttcaacattaatcaagaaattcctccatctgcaaaagtcagcctatgccattaaatacagccaagatcataaaatacaaatgtcattaggtctactgaatcttgagattcattcactagaatacacagggaaaaggaaaaagtttgcccttgtgaaaggtgtgtatcattttttagaagagcttctgaaagcctcaaacatctgtgagtgtgctaagagccgttacaaaggtattttatacaatctatgctgagtcagctaggagttagcaggaggctggatgcagatggtaaaacatacccctgcagatctgttgttattaaggatgacctttggaagtctcaaactgtaaccacaaagggtgtccccactgcattcatactatatacacacatacctgaactgcctttctaccagtaacatttaaaataagcacacttaatactgccagtcacatgtagtagagtgttcactctgtaactgtgtgtggcaaagccaagatatcctaccattccaataaaaaaaaggcaaggaaatagctttaacacaccattgatgtatgctattacacttttccagtggaagataacaaagcccatataaaatttaaagacagaggaaaaactcgattttcagccacttgtacctctctaagttttcatgccctgctatctggaacacttccccacttccctgccagaagtcctctagctctgcattaaggatcttgttgtccctgactgacacccacatatggaacatttggcatgcctccatggcaacacgggatccctgaagtttatgaaagcgttccatgtgagagaggatgctcatatactcctgccccaccctccaaagatgtactaatgatgctaactgactacatccaaggagccagaggaaaaataatctgagggctgcagagaacccactcaagctgtcactgcaaagctggtcttcccaagagcaaaggaggaagcatgcaatctagttcaagtcacacctacttcactcttagacttcttccttcaagtggggcttccctgcaaacaggactggtcttcaaagtctcccagagcccctctatcttagccaggttgctcaagctaattttattctttcccaacaggatccatttggaaaatatcaagcctttagaatgtggcagcaagagaaagcggactacgcaggaacggggagtttgggagaagctctcctggtgttgacttagggatgaaggctccaggctgctgccagaaatggagtcaccagcagaagaactgttttctctgataaggatgtcccaccattttcaagctgttcgttaaagttacacaggtccttcttgcagcagtagtacgttagctcattttccctcaagcgggttgtgacgtcgttgaaattgcaatgctcaaacttccaacacttgttatacacttgtaaccctgtggggagacacacacaagggtaagaaagtaagtgggaagagttctgtatctgcttttgaatcctcaattctatttcgtatgtatcctgtgcaagtagagacttctaggcaagatgctcatcccaggtgggttgtaaaggagaacaattaagtaaataatgatacacctctaaatagagcttttacagaaaaccaaggtctcatcagagccagtatagttatgggggtgggacggaggaggaacaggcatttatactgttaagagggaaatttggtaatatctgccaagattttaaacacatgccccctttgatccagcaattccacttttagaatttacgctatgaagttacttggggattttttccttttcttttcttttttttttttagagagataaggtctcactttcttgcccggtcatctggtcttgaactcctgggctcaagtggtcctcctgcttcagcctcccaaagtgatagaattataggggtgagccaccatgcccagccaaagctatgtataagatatatgctcaagaatggtcagaaaaaaacctgaaaaacccagtccattaatttttaaaaagtgttaaagaaattacaatagaattccttacaatgcaagttccatgcagataagaaatgacgtgggccttcaagtgctaacatggaaggagcttgatttaaaaaaaaaaaaataaaggtggggggggggcagaaaaataggtaaactggactccatcaaaatttaaaacttttgtgcttcaaaggacattatcaaaaaataaaaagataactcacagaaagggagaaaatgtttgcaaatcacatgtaaaccaccaggtgcggtggctcacacctgtaatcccaacactttgggaggctgagatgggagaattgtttgaggcgggaagtttcagaccagcctggtcaacatggcaagaccccctctctatttcttttttaaagtcatatgtaagagcatagtatccaggatatagaaaacattcttaaactctacaataaaaagactaacccaattaaaatatggacaatgaggccagtgtgatggctcacacctgtaatcccagcactttaggaggctgaagtgagaggattgcctgcggccagcctgggcaacatagtgatatcccaactctacaaaaataaaaaataaaaaaattagccaggcagggtgttgcgcctttagtcttagctacttgggaggctgaggcaggaggatcacttggactcaggactttaaggctgcagtgagctatgattgtactgctgcattccagcctaggcaacaaagcaagaccttgcctctttaaaaaaaaatgggcaaaggatttgaataaacatttctccaaagaagattctcaaatggccaataagtacatgaaaagatgcttgatatcattagtcattaggaacatgcaaatgaaaatcacagtgagataccactttatactcactaggatggctaagatcaagaaaatggtaaatagcaaatgttgcaaggaagtggaaaaaattggaaccctcaaacattgctggtgggaatgtaaaatggtgtagatactctggacaaatttggcatttctgcaaaaagttaaagatagagttatccatttgactgagcaattccactcacaagtgtatatacttctgccattctctggaaggattcccaagtaatttaatactgttatcatcatggaagaatacacttcgtttatgtttctattgagtttttcaaatttgccacatggataatttttaaaatatttgaaacttcattttaaaaatcattagattattcagtaatacaggaaaagtttctataagaacatgctatcatggtctcatttttggaaaaatagccttgggcacacaggaaaataaaggccagatgtatacactccaagtatcttatcgtagtttgaattgaaaactacgttcacacacaagtttccacatgaatgttcatggcaccatgattcaaaattgctaaaaagtggaaacaacccatatgtccattactggtgaatggataaacaaaatgtgatatatccacacaatagaatactatgtggccacaacagaatgaagtactgatacatgccacagcatgagtgaaccttggaaacattatgtttagtgaaaaaaaagctagtcgcaaagtgccacaatactgtatgattccttgcatatgaagtgcccaggagagccaaatctatgaagacagaaagtacatcagtcactgctggggcatgcaggagggaggaatgaggactgactgctaacaggtttcttttcaaggtgacagaaagatcctggaattagacagttgcgataagtcatacaaccttgtaaatatactaagagccactgaattatacactttaaaatgtaaacgttctggtctgtgaattatatctcaataaaaaccctagatgcagaacagtgtatagaatgtgacccatttgtggaaataaagcacatatacattgaggtaagtgcatttatttttctctggaaggattcccaagtaatttaatagtgttatcatcatggaagaatacacttcgtttatgtttctattgagtttttttaatttgccacatggatgatttatttttaaaatatttgaaacttcattttaaaaatcattagattattcagtaatactggaaaagtttctacaaaaaacacgccatcatggtcccatttttggaaaaatagccttgggcacacaggaaaataaaggccagaagtatatactccaagtatcttatcacagtttttttaatattcagaaaaagcatgttaggtgaaaaatgtattagttgagagagtggtattatggtagattttcttctccaaaaataactgagtgcctgtgtgctagatactggggtataagaaggtatttgtccttgccctgaaagtggtttcttatcttctgtgctggaaagaaaaaaacgcagatgcatacttccttatttcaggcttgtagctaatttacccaattccatgcagagcttggaacacaacacttctcagtttataactgcaggcataactgtcctgtcctcctcctctgaggggatgggtatctggattggaatttaatgaagtttagtcaagtggcagagtccacatagagtattccagaaatggctctagttgctgaagtcttaactaaataactggaagcttctaatattgtactagaggctgctggtgattcagacaagttactgctttgtaacagtaattacgcattggaacttgaaaagctttaaagctatcagaattttaattagggaagcctagaagcttggggagaacagacagtaatttatgaataattgctaccaattaatcatttactatgtgtcgtgcagcgtaccaaagtgctttacttgaattatcatattcaaacaacagccttaacgatggtaataatctcaccaaagccagccttggaattatccacataaaagtggcttatatcagaatccctggagtgttacaggttttctcctcctcactctttttgaagacttcggctcaagtctatctaaagtcaacagtcttcagctgtcctaggcacccttaaatgtggcccttgttcagaacgtcattacagcagtgaccacttgacactgtcatcagaggctccttcaagactaagtacatttaaccttgcttacacttccatggtttatactgctaggatgccagtaaatattggttgaattagcagccaacctgtctctcttctagacttactttgtatagcaccatcatatctgtctctgtgcaaacgtcatagcgtgtagttacacaaacttacatggaatagcctagtacacactcaggctatgtggtatgtcctattgctcttaggctacaaacctgtacagcaagttactatactgaatactgtaggcaactgtaatgcagtggtaaatatttgtgtatctgaccatatctaaacatagaaaaatacagtaaaaatatgacacaaaagattttaaaaatggtacacctgtacagggcacttactgtgaatggagcttgtgagattggaagtcagtgaatgagtggtgggcgaatgtgaaggcctaggacattgctgtacactactgtagatgttttaaatattgtacatttagtccacactaagcttattttaaaaaatcaaccctagtttactgccactttactttagaaattttttaattgtaaatgtttttacctttgtaataaaacagggtaaaacacaaacatgttatacagtggcacaaaaatattttctttctattcttattttataagcttttttatttaaaaaaatttttaaaaacttttcttgtttttgttaaaaatgaagacacaagcacacacattagcctagtcctacatagggtctggatcatcagtatcactgttttccacctcttcatcttgtcccactggaaggtcttaggggtaagaatactcatggggctgtcctgtcctaggagagcaatgccttcttctggaatacctcctgaaggacctgcctgctgaggctgtttttttttttttttttcttttgtagagacagagtcttgttctgtcacccaggctagagtacaatggcacgaccttggctcactgcaacctctgcctcctgggttcaagcaattcttctgcctcagcctcccgagaggctgttttatagttaatttttttagtaagtagaaggactacatgctaacatgataaaaaatatagtaaatacacaaaccagtaacacatttattataaaatattatatactgtatataattatcaaaatatcaagtattatatattgtgttatattttagttttgtaataaactaccaaactgtcatccacagtagctatactggtttgcattcccactaggaatgaatcaaagttcccactgctgctgggcgtggtagctcacgcctgtaatcccagcactttgggaggccgaggcaggcagatcacttgaggccaggagtttgagatgagcctgggcaaaatagtgaaaccccgtctctactaaaaatacaaaaattagctgggcatggtggcttatgcctgtaatcccaattactcaggaggctgaggcatgagaatcacttgaaccctggaggcagaggttgcagtgagccaagattgcaccactgccctctagcctaggtgacagagcaagaccttgtctcaaaaaagaaaaaaaaaaccagaaaaacaaagttcccattgttccacatcctcaccagcatctggagttgtcagagttttggagtttggccattttaataggtgtgtctcatttttgtttacattaaccatttataagaaattttgggatttaagagctggaaaaagatcttggctttgacctcctttcctctcctccctacctctgctgtccaacacatacatttcataaatgaaaaacagaggtggagagagctagctggtggcaggacagaagtcagagctctaattgctgctgtaatattcattcaacacatagtaattgcccttatcgtctcatttggaaactatacttagtttaattatacttagtagtgaggagtccaagagacacagttgatcaagctaaagagccaagtcttctgtgctcgtacataatgaccatgttctcgctaggggccttactacgcttcctacattaacagtgaatgaatatggtcttccagtgggggcagagggactggtgccctacagaatcaagagctctgaatggaaggtttggagttttagctgcaatccagctaaactatatcaaatttatcaaatccagctaaatatatcaaaattatcagatgcccctgtttttttagacagggtaactataatttgtctttagttattgagggatttctcctttctggggaagttaatcatctttatctcaggtttttctgaacatgtgggtgtcccaaggcttttctgagtttacctgacatgttcaccatttcttgatgttgacactggggggagctggtgtagaaggtctaagagtacaaataaccttgtggagtgtttttattattaatctcttagaaatctaagcctgagggttttaccttggacactaagaacattctgaaactgccattcctcgctggcatcatttgcacacatcgattctatccagaaccacaccccagcaagaacagagggcatgtctttgctggtttctttcctctgtctaccacttcctaaactctattttaacagggtgatggaggtgaatattctgtagtctaacaaatttggaaaatgcagactggacaggacttgtgcatgttagcattgcccatccccaaattcatgagcaccttgctctgaggctaccgagccctggcacctgctgttgcccctcccaggcacacccttcccttcttagccctcttacctcctacgtgtcctttgagctcagcttgagtctcctcaggactctgaatataccagataccccatggaatgagacagaggcatatataatgacatttaggacagccaaacaggcctttgtcataattttaattgtatgtgtcctttctttatctttgcatccctagctcctaaccctctgctgggcacacagtaggttctccaaggtctgggaggcagcacagggctgctgtaaaagagcacaagctttggaatcagatggacttccatgttcaattcctgagtcggttacttaaccataatttcttgcttaatctgaacctccatttccacatttatcaaatggaaataaaagatcacccttagaagtgcaaaacattaaatttaaaatgtatgaagaaagtgcttagcccaatacacacctgacgctaataaatggtagctattacttgatgcaagcctaatgaggattacagtggcacaatttttttcccaggcacttattaccccattacatttaggagacagacaggggaggctcttaccagctttggtaatgagacacgcatcaaaatcagatgaacaattgacggctgttttgcagtcagcagttgggttaggacagttgtagcactgcaggctatgacctagaatcaggaagaaagtcaggatctcttaaagcagcactgacttgtcccctggcagcccaccatctccattaatatgggcccaaagtcagcaacttgtggtatacttccactcccgcacaaatgtatagcagttatatctttccaaattcaaactacagttccagcaacattttttggaccctgatgcaagcacaaaggaaatatccacatttgaatatccatctaactgtgcaattgagaagcttcctcctaacctgcaactggaaggagattagtctgcaatgtaatgatgtgttaagaagaaattaccgagaaacaaacagaattctataagtgtcttccaagcaatgaatatgcccaattaaatcacatcctcgtgggttgatgatcaatgtctggcaatacctatctgcgtgaaaatacattttcaaaatgaaatatgtaaaatgtcatcacagattagtattaatagatgaacatctgcaattgatttgatgcgagggaacactaattttgaaccccaattaagcaaatggttatccccctaaaaagaattctattcccctcattagtagatgtgtattattatgctggactcaataattatgttatgaattttgtcaataaaaaaatctgtgaaaattttgtttcttattattgaggtaagtctcataatacccttgattttgcctcttggtctgcaaagcttaaaatatttactatctgggccaggcgcagtggctcacgcctgtaatcccagcacttagggaagccgaggagggtggatcacctgaggtcaggagtttgacaccagcctggccaacatagcgaaaccccatctctactaaaaataaaaaaattagccaggcatggtggtgcacacctataatcccagctacttgggaggctgaggcaggagaatcgcttgaacccaggaggcagaggttgcagtgagccacaattgcaccactgcactccagcttgggtgacagagcaaaactctgtttaaaaaaaaaaaaaaattgctatctggtcctgtacagaaaaagtttggtaacctctgggacagggtatcattactgaactactcccttctaagggactgaccgaatgccaggagtacacactgtcaaagacaagacaacagctgtgcactttaaacccatgggcataggacagctgggtaccagcagacacaacgtgagggtcatcttacatcagaagcaaattgcctccagttccctagtttgaaaaacaattattgctcccagtcaattcttaagactcatccttgctagctgtcagtttttgctgggttatttttccttctccatttttgtaacaacagtgacaacaaaaagatgagttacagtccacacgtgtgatggggagagactgaggaagcaagagttggaaggaaatcttcctggtttgtatggatacccccttttccatcatcagagataaactatcttcatgccatatgacttctaccatgtaatcagtatttggaagtacctacctctgtgaaaagacattttcaaagatgaaacacgtaaaatctcacaaaagaatgtcatggttaaaccaagtgtgggttttagagcccaacagctgacttctagttctaaggctgaaggctaggtttatcaccatggaaatagatttttcagtggaaagtccagtggaagcaaggtgggtcctcactttctgagcacacacaggaacccagttctctagagcatctgaaatggccatgtctgccctcacaggtgtgaaatcctacccaatagaggatcctctgacttgtgaaggttacagattaatgccttgaaatattagttttaaaaaacaacaacaaactaggccaggtgtggcggctcacacctacaatcccagcactttgggaggccgaggtgggtggatcacttgtagccaggagtttgagaccaccctggccaacatggtgaaacctcgcctctacaaaatatacaaagattagccgggcatggtggtacatgcctgtaatcccagctattcaggaggctaaggcatgagaatcatttgagcttgggaggtggagggtgcagtgagccaagcttgcaccactgcactccagcctgggagacagagcgagaccatgtctaaaaaataaataaaataaaataaaataaaaaccaacctcctccccaacttttttgcagatgacaagacagatgtctggagaggtgatgtgactcacacaaggacacctggctacaaagcagcagagctggcggcagccctggggcctgtgggcagggccccatccaccaggctttgtttgttctcccccactgtcagcctgtggctgtcatgcccgtgtgagagggaagccacaaggagaaggcgcaaagatgcaatttttctttggtcccttccttgtgccagacatgtattcacacgcatgaaatgaaaagagtctaagatgaagggtgttgttcttgagactggccatgtttgagggccattttaaaaggttacctgtagacatggatttttgtggtggctagatcccgggctcatttggcctcttaagaaagctttagaaggaaaggctaaaacccatggttggaacgtctgtgggcaaaaatattcatggcaaacatgttcattcagtgttcaaatatatgtgcatctatgtgctaagctcttcataggattgttaagagaactaggctcaattatcttcatccccaccttgcaagagaaaactaagactaagatgttaactaaattgttcaaagccacacagctactaagtgaccgagctgagctcaaactcaggctgtcagttctaaaatccaagcttggttaaccatgatgttcttctaattgacctgagtgggaagagaaggaaactctagattatggtggaaactgaggtcaaaaacaagcaacagggccaggtgcaatggctcacgcctgtaatcccaacactttggcaggctgaggtaggtggatcatttgaggtcaggaattccagaccagcctggccaacatggtgaaagcccgcctctactaaaaatacaaaaattaaaaagtaaataaaaaaaaatacaaaaattagccaggcatagtggcatgctcctgtaatcccagctactcagaagactgaggcaggagaatcgctggaacctgggacacggaggttgcagtgagccgagatcgcgccactgcgctccagcctgggcgacagagtgagactccatccccctgaaaaaaacaaacaaaaaaaaacaagcaataggtcagtggacaatggtttgatattttagccactaagccagggtagacgaggtttcccctgggccataagaggcagagctcagaggaaagttcccctgcagggtcctgagacccttttgggcagcagcaaagaaggcctctcatctgtgggcatgtgagcttcacatctcaattctctgagaaagggctgaagtgcaccccaagacttgtcacagagaagctgatggtcccaagcttgctccataaacaaatgcagactgctggaagtaggatgtcactgggctattaaaattctagaaaatattccaacttaagcagcagagacagaaaaaaagaaggaaccaagaaaaatgaataaataaaaaataattatagaaaaaatatagtgttttaacacaggtgaaccacattacagtgcaccctggctagaatcacggaaggtggggaagaaggggtgccatgacttctctttctgctcagaaagggagaacatattaaagtgtgtcctggcgccaagttactactttgccttcatttcctcagctgtaatatgggaggtaacagtaccgacctcccggaatggctggacggatttaaatgagacaggctctggcacagtccccagtaaacaataaacagtgaatatatggttgctgttaatattctaagacatgctacagtggtgtggaaatctttttttaaattgctcactgtattgccactttcttttctgctccccccaccaaccatatttataaaaaacaaaaaaccagcagtggccaagatattataccaacatgacacaggcagacaaccacacttgatctttacaatgaagcatgtgtgtttccactgttatagaagttgactcagaagcacacaatttcctccagcaaccaggggaggggtggctgaggagagggggtggcccagtgacagatggcctggagcaggagggaagagcagggactctgttgccagactgtgtgttcacattcccgtgtaccacttctgtgtgttatttgacaagttattaattttggggaggcctcaatcttgttgcttgtaaaacaaggataaaaataccaccaactccatcaggttggcatgaggattaaataagcaaatacacgtaaaatgcttagagtagtgactggcacataaatgcttcagggttagttagctgctgctgctgtcactatgaccatcatcatcattaaaacacaggaggagcctcagagcagaaggactgagctcagatggctctaagcagagtggaccccaaagggacttgcacagcactctaagaatggtatccattggtgtccccaagcagcttatggtgacaggagtgaaacttcagccgccgattgttgacccacccctgccaaaagccacgctgtaactcaggacgggctgtaactcaggacgatgccccactgaggacaaggtcataacataggaaggagctgtcatacaaccccagacctgtaacactggaaggcaaaagaaccaaagccaggcctggaggagcagctggggctgaaactgaggcttaagaagggagttcatggccaaggcagcctagatccatgtcctgagactggagcactcacctgaatggcagaagacagccaggacgagcagcagcccgaacaggacagaccctccttggattcccattgtgattgtccacagaacctggaaggaagggacaggaaggaatgtcaggaacgaacaaatgactgctggttgtctcaaaaaccaagggctggaaggccaagaaggcttctgagaggaacatttacagggggagtcaaggcacactgaatccctgggccatgccccagctctgacccacagcaccatatacccttgagtaggctcagtccctataagccccagtgtgtactaccacactgtgggaataacactatcttccccatcagggtcagtgagtcaaatgacaatatgagcaaattgactcatatagccactgtggttcccactctactggccccaccccaagctgctggctgaaagagagggccacttctcggagccacagcactaagtgaatcagaccaaaggggtgactctggaaggcaccagcatgcattcagcagtggaacagggagcaatggcttagcatacctggaagctctggctcctcactgtaagaagtataat

SEQ ID NO: 1609 - DNA, 33470 bp, Homo sapiens; identical to SEQ ID NO: 1604
  source 1..33470: mol_type = genomic DNA

SEQ ID NO: 1610 - DNA, 33470 bp, Homo sapiens; identical to SEQ ID NO: 1604
  source 1..33470: mol_type = genomic DNA

SEQ ID NO: 1611 - DNA, 33470 bp, Homo sapiens; identical to SEQ ID NO: 1604
  source 1..33470: mol_type = genomic DNA

SEQ ID NO: 1612 - DNA, 4250 bp, Homo sapiens
  source 1..4250: mol_type = genomic DNA
tccactcacagcctgaagcatacccggcaggggctgtccccaggcccaacaagcaaagggcccagtagcgagggccactggagcccatctccggggggctgggcaggaagtagggtggggtttggggtagggatctggtaccctgggactgctgcaactcaaactaaccaacccactgggagaagatgcctgggggtccaggagtcctccaagctctgcctgccaccatcttcctcctcttcctgctgtctgctgtctacctgggtatgtggccaaagggcaggaactggcgggaggtgggggaagctgtggaggctgcagagagggcacaggcagagggaagggggctcagggaaaggggaagaggaggcagaggataggggacccagggaagatgcctatagaaatcgtatctgtgccaagatgggccaaggtggggctggagggagcccagcgaaggagaaggggcgtccacagtctcacacagggaggcaggagcaagagtcacctcccccacctcctgttccccacaggccaaaataaggaactaaagttgctcttgactgagcaccagggctgggggcaggaaggggacttaggggtagcagcattcagcgtctgtcaaggggagaaaaagctttctctgccttaaacctcaggtgcctctctctgttgggagtcccttctcagcactgggggaatgggtgtctcatggactccccctcacctgctcaaggacagctggcaggggctgtggccacgctaacccaggagttcagagaaaaaggttccccacccaaggggacactgggagcaaggattggagttcacgtctgagtcttaagcccgtgacgatgagggtgctcggcccctctccccatctcttcctccttctctcttcctcacctccctcctccacctacctccagaagaggggactggccatgtgggaggcctggctgagagctggggcttcccagaggagcccggattggacactgcagccagcctgagccgcctcgtctcactcagagacacccccagtctccaccccgctctgagccccttcaatcaccagcagcccagcccaaggactgaactcacccctgacccctaggttgacacatacaacttacagagaatgagggccaggcacagggtcacaggccagggcaggccacagactggctcctcagcccaggcagggagaggccagggagccaagagtttgaacccagtgccactcctgactgcctggtgatgctggcaacccgcctgccctcccagagcctcagccatccctcctgtaaaatggggctaaggagagaacctacttctagggttctgtgaatgattacacaagaaaaagcgccaggtgctgggcctggctgaggctggggtgcaaaaatggaccgggaaggctgcgggaggaggggacgcctgcactgcttctggaaggagctgtctggacagcggtcctccagtgcctggaacaaacatccaaaatccagagagttcacagggccagagtacaaagtgcgtatgcgggagggggacaagagatggcgctgcagaggtgagaagggcctcccaggggtcttaccatcccagggagtctcattctcctctcccaggatatcctcacccaccccaaccaggtatgtcctctctccttcccaggggcttcttcactttcccgcatcccccctctccccaggatgtatcagcccctgtcaggggctctctctctccctccccacccaggagagtcctcaccctcttcccaggagtgctggaactgcaggggccagggctggggaaatgtgtcaccatccccagtccctgacccacccaccctgtctctccacaggccctgggtgccaggccctgtggatgcacaaggtcccagcatcattgatggtgagcctgggggaagacgcccacttccaatgcccgcacaatagcagcaacaacgccaacgtcacctggtggcgcgtcctccatggcaactacacgtggccccctgagttcttgggcccgggcgaggaccccaatggtacgctgatcatccagaatgtgaacaagagccatgggggcatatacgtgtgccgggtccaggagggcaacgagtcataccagcagtcctgcggcacctacctccgcgtgcgccgtgagtggcccagccctggcccctactcccactgtcccgctggggacactcggtttatctttgaagtggggatagagccagtaccttcaatgtgggtttcaaaccggcttggacagagggacggacattctcctctgcagagtggggtctctggggggtctggggccttgcaggaggtgggcggggccaggaggctagggagggcaagaggggccagggctctgagccatactacctccttgcagagccgccccccaggcccttcctggacatgggggagggcaccaagaaccgaatcatcacagccgaggggatcatcctcctgttctgcgcggtggtgcctgggacgctgctgctgttcagggtgagccccctcggacctctgagtcagccgggcgagggcctgggccgagggacccccaatacccaggtagccctctagagcctgaggttccccatccaaaacttgggagaatgaaagcacccaccatataggggctgtgggagttaaatgaatgaatataaagaagggacttgaactggcgctgagcccagggggtgtcttcaatttagtttccccttctgggctgtcctcacgtccacctccccccaagaagagtctcattcttctccctaagagtgtcctcactcccctcctgccctcacccaggagtgtggttaccctccaggtgtagccaagaccagggaaggtggggcctggtcctcccagaatctctgatctgtaccagcctctccttaggcactacagaaagtgtgactgttattgttattattcatggagaatagtaagggagtggagactcaagaagacgctagcttgggaggccgaggcaagaggatcacttgaggccacaagtttgagaccagcctgggcaacacagcaagaccctatctctacacacacaaagtcttaaaaaaaaattagccaggcatggtggcacacacctatagtcccagctactcaggaggctgaggtgggaggattgcttgagcccaggagttcaaggctgcagtgaaatatgatgttgccacagcacttcagcctgggcaactgagggagaagaaagagagagagagagaaagagagagagagagagagagagagagagagggcgagagggagggagggaaggaagggaagggaagggaaggaaggaaggaaggaaggaaggaaggaaggaaggaaggaaggagaacactggttgtagactcagagagaactgttacataaccagtatgtggccttggggacatctcttaccctttctggaaaagtacttcctggcatccaggagggtctgaaagatattcacctccccctgctcactgaggcacccaccccacccacccctacagaaacgatggcagaacgagaagctcgggttggatgccggggatgaatatgaagatgaaaacctttatgaagtgagtgaagggtggggatggggtaggggcagttgtgttaggggtgggggtgttccctctgggggtggctgggggcagggaccccaggtgtcagggtgctgatgttcgctgcctcatttccatcccagggcctgaacctggacgactgctccatgtatgaggacatctcccggggcctccagggcacctaccaggatgtgggcagcctcaacataggagatgtccagctggagaagccgtgacacccctactcctgccaggctgcccccgcctgctgtgcacccagctccagtgtctcagctcacttccctgggacattctcctttcagcccttctgggggcttccttagtcatattcccccagtggggggtgggagggtaacctcactcttctccaggccaggcctccttggactcccctgggggtgtcccactcttcttccctctaaactgccccacctcctaacctaatccccccgccccgctgcctttcccaggctcccctcaccccagcgggtaatgagcccttaatcgctgcctctaggggagctgattgtagcagcctcgttagtgtcaccccctcctccctgatctgtcagggccacttagtgataataaattcttcccaactgca

SEQ ID NO: 1613 - DNA, 4250 bp, Homo sapiens; identical to SEQ ID NO: 1612
  source 1..4250: mol_type = genomic DNA

SEQ ID NO: 1614 - DNA, 3607 bp, Homo sapiens
  source 1..3607: mol_type = genomic DNA
tgtggtttctcaggacacaccgtttattccacgggggaaggcactggaggccagggcctccctggggtgggagtggttgcgggagaggaatgatgttcctgtggctcttctggggcccagttgggtccatggcccttcccaagctctgctgggaggccctcggctccgagtccatttgcgggctctggaccagtctctgcctcccccatcccatgtgtggggacggatcacctcatagcacccccagaaggctgggtcccgtccatccccagagaactccctccaagttgctgccctgttgtccttctactccaggccctttggcaagagctggggaccaggggctggagacaaatggcagctctggtgggccagcttcagaggccagctggggggtccaggaaaggggttgggccatgagccaggcagctccgaagcagtcactgaggccagggagcctgcacccaggtcatggggcgacctggctctcactcctggcctgggtgctcacctacagaccacttcacttcccctgtccgcagcgtcactatgtcctcataggtggctgtctggtcaatgtccaggccctggagacattaagtggaactcaggccgggaccacaccccaaccacaccagcagatagtggccactgaccccgaggactcagagctgctgggcctgcccctctccttacctcgtaggtgtgatcttcctccatgccagccttgctgtcatcctgggggcggagagggatggagatcagagtgttagtgtcccccagccccatcccctgctgggccaggctggggagggccagggagaggggtgaggggtcaggagtgaggtgcattctgcaagaacagctgaatgaaggaaggaaggaaggaatgattgaattggtgagccagtggggacaggctggaccaagaaggccacaacgagagctggggagatggagaccctgcatatgcctggcctatgcggtggcctcctctgcggtcccccaaggcttcccccgtcccctgatcaccttgtccagcagcaggaagataggcacgatgatgaagaggatgatcagcagcgtctggatcatgatgataccatccttcagcgtgttcctctgcttcagctgtgccaaggtgctgaatcctgcggggacaggggtggggttgtgagcctgggccacagtccaccttttaggcctacaagggcagctccctcaggtcccagtggctctcctgagtgctctagggccatgaccatcaccacaagaggcaggccgggctagggtggggcggacagctacaggagcgtcccagccacctggcacacacccatgactcgcagctctgtgccgcagccctggtagacctccgaggtgttgttgcacttctgctgacagaagtagatgccattgtcctcaaaccggatgccttggatggtgagggtggcgagagattcgttctgggactcttccatgcggcccttttccagcttcagctgctggggattctcgtccatctcctgcttccagagccagctcacattgccggaggcgctgttcatgtagcagtgcattttcaccgtgaagccccgtttcctggctatgaaacgtgggctctgccagatccgcgaacaagcactacctgtgggtgccaaggccaggctcagcattccgcttggcatcttcctgagtgccagccccagcagcaggcccctgccctggctggcacagactccctgggcttagtccttgcttctcagggtgtgggacaggcaggaggctgaggttggagttgggaagcagagccacgtgagaggctgagccacatgagaagccacggccaagctctcagactccacctcttcccgactgccccacctccccttcgattttcctttggaagagccctgggaccttgccattccttcctatgcccattacaacagcctgacccaggccacacccccaggacctggaggcccacaggcctggcccctcctttcactgggctgccctgcacaggcttgaaatcctcagtctcccccgttcctccagggataaaggccaaattcctagtctgtcaactgagaccttcctcagtcgaccccctccctgcatgacttccctctatcatccccctcttccctcctgcagggactgggtccacttcttgttccagaaccctctttccagcttcgactgccttgttcttagtgagcactgcccgggaatccctgagcccctcacatagtgaccctgcactggagggctcacccgagactcagccagattcccagctagacaggcccgggcctgagtcctagaggaacccccaggctcccttgctatgacccagagtttagcccagcccttcagtggccaaggctggagggcatgtgtctgatgaggatgacagtgggctgggggtggggctcagaggagatcctaaggaggcctggggatgggaatcctggatggggagatcaggcaagggtgggaaggcggaccgcccccaggacagggaccatagtcggacacaggacatagtcgcacacaacttgccctcagaagcggcaggcgaggctactgacctttgggattccggtaccggtcctccgatctggctgctggtactggctcagctgctgggtgggaggaagtgggcggggccagtcagggcctcctctggcctgggctgccccacccctgcatgccctctatgttcccggagctacttcctccttccatgacagcagcttcaagacccctcggtcctccctgcccccagtacttgggagacagatatggggtgggggtaccggaagccctgcccccagccccctttctgcctttgaccctcatggtggctttgagcaggcatctgaatgagacaggagggacagggaaatctcagtattttgagaggccaagacaggaggatcgcttgggtccaggagtttgagaccagcctgggcaacatagggacaccctgtctctctttttttttttttttttaaagagagacaggaagaaagtcacagcccggaggatctttcacctcccagaggaggggaccacatttggatcttgcatcttccagggtccggttgggacagcctctcccctcccgacccccaggcaccgccctcagcctctcttcctcctgagcctagttcttccacggtcctggttgctaactctggtttgctcctcatgcccagctcagcctgatgctctccaggcaggagaggaactggggccacaggctcctgagcccatcaccacgtgcagctgacacccacagacccaggccccagggccatgagagggagacaggcggtaaagagtgagagacagaggaggagggtggagcaagcaggaggcagagccgcagggcccagacagctggagatgagagcaaaccccacaggcctcgtcgtgggttctgtacctgagagcagcagcagcaacgccaccatccagtggctgggcacaggagacaacgccagcctggccatggtcaccgctctgtccccgaccccaaacccgtgacaacgtccgaggctccttggaggaaaacgtgtaactgcaccggctgcag

SEQ ID NO: 1615 - DNA, 3607 bp, Homo sapiens; identical to SEQ ID NO: 1614
  source 1..3607: mol_type = genomic DNA

SEQ ID NO: 1616 - DNA, 3607 bp, Homo sapiens; identical to SEQ ID NO: 1614
  source 1..3607: mol_type = genomic DNA

SEQ ID NO: 1617 - DNA, 20103 bp, Homo sapiens
  source 1..20103: mol_type = genomic DNA
gagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccggaggttgggggcgatccgcctcactctttccccagcccagctcactctccaatctgcggtcaccacccgagaccttcctgggggtcgcgcctaaaaggagcgcagactcccgccgggatggcccagaagctggggtgcgcgcaccctggccgtccctgcctgggagccgatctccctctcctcacccagacacgttccagcggaggcctcctcccagaagggctctggaggcctcgcaggagtggggatcccgcggttctgagttggcacaaggaagagagtggcaccaggggcctggagtggatggcagggtccgggagtggggccgctgctttgcaagaggggcccccacgctgggcatctttgggtgccagcgtgggtggaggagggtcttttgctgagaatggctttctcctgaccgcagtctttgctgctgggaagtgactgatgggctttcgccttttgtttccatttcctgtcggtgttagaattggggagggggtggaaatcccttcttggcctggaaggactggagtgggtgtccatggccgcggcctccccgtggccacgcccctgggcatagactgcaagcccctccccgtgccccccaggctgtcacccccttctcgtggaagactcggctgatgtcccagtggaccgagtgtttctcaagttgaggcagggagggcaaactttttaaatggcccctggagccagtgtgtgggaccagagacatctgtttcccatctggacggctgaggatcccagtgcggatgattatttggagggggaaggacggaggctgaactgaactctcagctgggagatgagtggggcagtcacatcccaccttccccaagccgggctgttctgcacagcctgcttgggacgctggtgggagtcactgtggccttcggcactgccctggcagtgggggcagctaggccatttgggaggggctcgccttccccaggcccggccctgggacctcagccgttgcttagtggtggcctgcttcagcccaggcatgtgggagaggcaccagacacaggatgtccctctgccagcccctgaagccccgtcccctgacgaggcgagtgtggacctgggggtgggggctgagggagactgtggacctgggggtgggggctgagggagggtgtggacctgggggcaggggccgagggagggtgtaggcctgggggtagtaggggctgagggagagtgtggacctgggagtaggggctgagggagggtgtaggcctgggggtgggggctgagggagagtgtggacctgggggtaggggctgagggagagtgtggacctgggggtgggggttgagggagggtgtggacctgggggcaggggctgagggagagtgtggacctaggggcagaggctgaaggggagtcacgggaggggacttctccggaggtggatttttgctctctggacggtgtgtcagcactgggtgagcccctcctgcctgcccaggctgagaggtctccctggcagccccctgggagtgtcgccagggcgggcctggaagtttcccaggcagctggggtggagacctgacacatcccaagggtgcttgttattaaggctcaaggaaatgtctctgaggcctcaccgctcctctccccagggcctgctccctgcaaagcattgagaactgagtccgtccacagtcactgtggacccacccatccactggggctcagtggtagccagcaatgccaggctgggtgaggtggggttggtgggcaccaccctggtggacccccctccaccctggtgtcgcagggtgtgtggctgagagcacagtgccatgggcttgggcctccttggtggagtccccaacacactgctctggtcctgggcctcggccttccccgtctgcagtgggggcccacagtgagcctacctcctggtggtgttggtggatttgctgacatgcctgagtgttgacagggggcttggtgcaggaagggctcagggcgtgggtgttggccaggggtccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaaggagcccacacacacacgcacaggcactcacacacacgaatgtgcacacacacacactcccaccttcacacacactcacactcttgctgtctcccttcccaagccaaggtgcgagggggaaggtctgggcagcatgcacctgcgccctgaccgctttgggggccagtgagaactgggctccctgggtgcgcggcgggcccaagcagggaggacattgcagatgccctggccaagcagcgtggaaatcctgtcccttgggtgggtctcggagcctccatcagaggcggctggcacctgagacccacctgctgccaggagcagggcaggagagtttgtgtcccgggacagggaactggcctgtgggagccttgccttcctcatctgtgtaatggatataagagtcttctcctcgggggctggccagggagtccagaagaggtgtcaccagtccccgcagggagaagagcggtgtcccccgcctgggactggctgctcccccaagctaatgcagctggtagccacctcccagtggcagggcagccaaacccggccgggaaagagactgattagaagcctcgctcacgggtatttctcgcttccagacagcacatgactgtcatttggcacgtctttcgccgtccttccgggagaggggctgcaaccctggcaggcgctgtgggggagggggctaggacatcctgtgcctggtttcaccaagtgggtgtgtggactttccctggctcccccaggctgtctggctgcacagctttggggaaacggccactgggtcaagcgggccgagaagaggaagtctgtggtttgtctctgctacagactggccccagtgaggctgtccagcagtgcagggcacagagcaaaagcagggaggtatgggcctacttccccggtcgcccctgtggctggctgtggctctgccgggtgctgacaagtcactcgccctccctgcggtcaccagggtgcatgcccgaaagccctccattctttcctgggtttgagggtccttctcctgcacccaccccagcgcccagttcagctcaactttcagaaatctggttcacccccaatccctttctcataactgcttccaagcccagacaaggagacagaccccaaaagatccctacccctatttccgcacctgaaatcgcaccacgggaagagctttgctcatagagtcaataaggcttagagtccaggcgcctgtgcgagggagcaggtcatcacccttgtacccaccgtggttttagacaggaccctgaggttggggtggggctggggctggagaggagccaggtgccctgccccttgcttgggccccgtgtccctgtgatccaggctgggcgtgctatgggtgctgggtgatattccagccctgcaggtgtccgccttgttcccagcacccctctgggcaagaagaaccaggctctcccagaaatgggcttcagtgatctccacttccaagtcgtccccacctgccttgtaggacacagtggtacctggtatgctgggcagccttccaggaacctctggacttactcagtgtcccccagccctacacaccattctttgtgtttctgggcccaaactaagccccccaacctgggctgcagagcaagtgctgaatcatgagagacccttgagggtcctccaggtaggcccccagtgctggaggagtcccctcaggcagggggccacgcccaagggtgtggaaggtcagctggcagccggatctcacttttggggctgtaggcttcctgcactggccgccaatgccatggccgtgggatggccaggataaggcatctgccccccacccccaccccccgcacaaggtctttgagggctgcgggctcaaggagttggcggtagggctgggggaccaggggcacagagcttgtaagcgcctctctccaggatgtgggtggcccagcaggggagctttgagagtccaggtgtgagattccaaatgctaggggcctgagaggagggagccaccagcttggccagagcctggtggatcacgcccccaccacgccttgcccttctctctggtcatgtgctctcccaccacgtttggaaagttactgcttccctcttcctcagcccctcgggctcccagttatggaagtggcgtgattcagagaaggtaaaggatgggagggagagggctgggtgatgggggaccccgcagggcgccctgtgctgttacatggagctccaggatcagggcaggtgggcagcctggggtcctcacttctctccccagccaggccaggtccctcacagccctgccaggagcatgatatccgctgcggtgcagaactaatctcaaagctcaaacccaggtaacagtgtaggtaaaacagatgacagggcatgagactcaccccaggacaggcgaaggacccaggccgatgggggcccagaacagtcctgatcctggagctccttcccgagtgggaccccaggggtttccgaggggcttagagtagggcttagaggcttagagtagggctagggacttcctggcttccctgcctcgggaacagctggtcctggaaggggcttggtcctcggggcactggtgcccaccacccctgatgcctgggagacaccagcatcctctgagcatgtgtgcgtcctcctggtcccgagggaagtgactcctcacatcccccagctggcggggccagagggccagcatcctcgcctgacacctatttttagatgctgagacaggcggcttcctcggggccaggggccctgtgagtggagcttccgcttcctggcctaggagagaattcctgctcctcttccctccatgctgccttttcgcccctggaggccacaacggggtcagaggggcagctgctcaccacctaggagggcctgagagggccctacgtcacccagggaggagtctggccccgtccccaacctccacacccaggcctggcactgccccttcttggtgggcagagagtgaggggttggcctgcagggacccaggctggaggggccgttcacctccggcccccagcgtcccttcctggaagcaccttggtgagcccctcccctccttcacccagtatctccaggggtacttcctcctttccttcctgcctcagggcctcactgtcctcctggggagggtgtctcaggccccagcacctcccagtggctgagccgaatgggcacttcccggtgtgtttcccatatgtgcagtccctaggtgtcggtgagcaggcacagagcccgcagcgtggccctgcctggtggaccccctccccaagagcatcaagggagggcctggactagagacacacagatgcccagcctgtacgtaaaggcgggtgagctgatgtaccatcgtcctcgtcccccactggggtgcctgggcaggacttggggtgaccacttggcccgtctgggtgggggtaaggtatgggtggggcgaccagatccctgccctttcctgcagctgtgggggtgtgtgtgctggcctggagagctcccacccgaagttctggctcctggctgtccggggcctgcgggggcagcgagcagctggcatgggtaggggagctgacctaggcctgcccgggcagcgcctgctgccttttgctccctttcagctgcttcttggaaacagcggacaggctgggcaggaacccagtgtgcttggcagccccccttttaaagtcgattctgttatttattaattcccaggaaggagaaagaaagaaacaatccttcatagagtacaaacactgcttttagtagccttgcaaggagccctccaggaaccccacaggttacctgggctccatcctgagagccaccctccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgggaggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttccttgtttgtagacaaggcagagagaagctgagatgggcctgaggtcgccttggtgaaaggcactcagcagccagggccttgggctgccctccctcatcaccgtgaaagcgggactctcttttaactgacatcgggctccatagttactccagtcctaactttgatggatcctaaaagtgcacttctaaggacgcggcttcggtgtttcccatgccgctgcttgcccctgggaagcgttggctctgcctcggaagaagttagcgccaagatggcagcctggggtctttggggcccagaagaaacactggccccggggagttcagtcatcagggacttaggatgtgggggcttttcaaacagctttatttagacgtgattgacacacagtaaatacagatgtttaagggtacaacttggtaagttttgacaaatttatacccccgtgaaaccatcaccaactccccaggtgcccctggggcccttgggatctctgcttcctgcccctcctccccgtcccagggcaaccacgggccgtcgctgtgggtgcacacagcatgcatttcttcaacaagcggactcagaaggcacttgcacatcgttgctgttctgcctctttgcttcagcatgattacccagaggcgcacccgtgccgtggcctgcccgtcgtctatgcacccgtgctgtggcgtgcccgtcgtctgtgtggcatgcctgtctgtgcacccgtgctgtggcgtgcccgtcgtctgtgtggcatgcctgtctgtgcacccgtgctgtggcgtgcccgtcgtctgtgcacccgtgctgtggtgtgcccgtcgtctgtgcacccgtgccgtggcgtgcccgtcgtctgtgcacccgtgctgtggtgtgcccttcgtctgttccttttattgccgggcagggttgcacccacatgtgcaagccagcgacggaccccaggttcacccgttcaccggtcagtgggcatatgggttgtttcagtttggggcatttacaagaaacgtgctagaacatttgtgtacaagtcttgtgtgaacctaagttcatttctcttgggtaaatacctgtgcgtggagcagctgggtcatgtggtgaatgtgggtttcactgcttaagcagcagttttacataactgccaaactgttattcaaggtggctggaccgttttacagcccccgttgtatgcgtcccagttgcctcccccagcagcatgtggtgtggttggtctttttcgtggcagccagtccactgggtgcgctcggcatgtggctgcagcttgacctgggtttcctggtccctggcaaggtggagcatctcttcatgtgcttttttgctgtgtgtggatcttgcggggaagggtctgttcctgttttttgcccatctttcaaagattgggttgccagttttcttgctgttgagtttggaaagctctgcatacgttcagggcacaggtcctttaccaggctctgccccaggtctttcggagagcaggtgtctttcgcattcctgactctggggaacctctagccctgccacatggggtttgttatggggcaggggcacctgtgcctttcccaccacggggcttggggatttggtgctgccattgccctccctcgtaggtggccctaggggggtccctccgcctccgtttcctcatccagaaaccggcagtgaccatcaccaccattgttgtcacctagctccagctcaaggtccctgctgaaggtcggagagcttggcatggccccgtttgtccatgctagggctgggaagaccaaggctcaggtgaggcctctgcccagtgcctggcactccttcttgccccatttttccacccagggtggctcccgactacttctggtagcctcggggacagttgaggtggacaggctggcgtcacccccatttccggctgtccctcccaccccctcctggcccagctgttctgccctattaaaagtcacatgggccctcgggtccttcctggtgttggcccaggctctttcaggccctgcaggccaggaccagccttccctgcaaccctcggcagaggcctggggccggggcttgtctaggggcagcctccccatacggccctggagtctgaacagaagccccttcccagagcacagcaagaagctgcaacgtggcctgaagtcccaccattagcaggtttggggtttaggctgagctttgccatcactacctttctgttaggacggtatgcccattagatgggatcatcccctcagcgcccaggctagaggaggggtggtccctgcccagccagggagggctgggggtggatgggcctctacagagcagcttccgagccaggcacggttccatgatcagctctgttttatagagggggacactgaggaaccgggagcctggggaccttccagtggccccacagctcctgtggctgagtcagggtttgtcaccaggcctctgtggggatgaggctcccccatccacctgccccactctgtcctggaacagctctcaaaacggtctctggaccacagtttcaaaagaaaataagcaatgttttcaaaggccctggaggaagccagagttaccacggcaactctcggcctcgccacctcctcccgccaggctgcatctggagccagctcaggagggcagcagggtgaggacagccaggctctctggggccaccccccagcccccacccttcctgcctctcctgcactgtccacggccctccctgtgctcccacgggtataatgggcacagaagaaccaggagctgtctgcccctgcaggattctggaagccaggggcccctggcctccctggggccttgtcatgtgaggggcacacgtggggtcccagctgccacatggcttccagcgctgcccgcaggtgtatgttgggcccttggtgactctaatgcaccttccactcggcacagaagagcttcagtctggggcctgggcgggggaagtaggctgccatcctcgctaaaccaaagtgtgaaaattgagttgaaactcccataggagggcaggaggcacagctcctcagaagaaggtctgagaaaccacagcccaggttgttgtttcgggtgtgtggagaaggtgctctggcagtcctgctacagggggaccatcaacagcccctttggggtgagagccccgtggctgctggcaccagcagcccctatgaggcttattttatttttgagacagggtcttgctctgtcaccgaggctggagtgcagtggcacaatcataactcactgtagcctcaacctcctgagctcaagcgatcctcctgcctcagcctccaaaggtgctgggattacaggcgcttgctaccacgcccagccccctctggccttattgtttgccaggcccagctcaggtcccggaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggcctgaagctcacgctctgctgagcacagccccctgcccaaccccaccctggggccctgcttccctggccagggccattggaacaggagtggggctgtccaggtggtgttcttgggtccagccctcagtttctcttctgcagttgaccggcagccctgcatctgtggtggggtcggcgcctggtgctggtgaggcaaggcctcagctgctgggacaggacctgcctggcacccagctggtggcagagccaagcattccgactcagctctgggagcagctgccttctgggctggcattctccgccaggggggttgtgccctcgtggccccccccgggtgcctcctcacctggctgatttcatctcctgtccccctgcctcctcctccaggaagcccccagggcctggccctccttgagagtggcatggaggaggaagaagactcgcccaggcccatgggagtcggatggtggccgcacttgtggggccctgaccccataggcttcttcagcacgccctggcctgggtgatccctgcctgagggctgtgcacggctcatctgccagaccagattttaggggattcttgtactgtcctcctggagcagcagggggtaaagcctgacccacccagactgtccagcaacaagggcctcctgctgtgggccagggaccctggaactgaccaattgtgtcctagggacgcagagtccccaggctgctagagggctgtggggccctgtttcatgcctgaagcaggaagaaaccccaggagaggtctgaaggggacccagcccccaccctgtctagcagggaggagcctctgcaagaggccgaggggtgctgaagtggaggaggatagaggcagcaggactcagggtcactggtcatttatggggatcacacggctgcagtgtgccctgcatggtgctaggcaccagggacagcagaggacaagcctgtgtcctctcccaccaccagagggctgggcactgcccctagggagagagggggccttggtgtgtgcagaggggggcctggggcacgtgcctggcctggtcagatgatcagagtgggctgggctgggcctggtctggggcccagtctcaagggcagaccccacctggctagagttgattgtgtgcacaccggatgacccggcgttgaaggcctctcctctctgtgagcctcatccccacctgccagactcccagcacagcctgcttcctgccccagctgctgagcgacagcgctgggccggcttctgcgcgccccttcccccagcccatcttggaaaccacagcagcgtccttcctcccaagtcccttcccagggctgacatcccacagcagggatgtatcccacaaaccccgcaggccctggtgcctacagcttggcctggtaacatcaaatcctaccctctcctcctggcagcaaagatggggtgcccccaccccagagttctcagcacccccagacagaagcagtcccccagcgacctcagaactcttggggcgctgccacacccttgcaggagggggcagtgttcctgggatgctcaggtcctggtatcacctctggccagatacggaaggtgaaactacagggcatccaattcaccttgaacttcagataaacaccagattatttttttgtatgtcccgtgcaatatttgggacacacttaccctaaagaagtattctgttttcatctgagaggcagatttaaccggcgtcccgtgtcttcctggcagtcctgccctggagtcacactccacaggtgcagggcagggccaggctccaagtagatggcggccaaagcacccgccccatgctcctgactcccggggctcttcagggcattgcgaaaaccagcagcagagctgacacctggtccctgctcgggagccagcaaggcaggaggctgcttaggccttgcgtgtggggtgggcgcactccctgctgcagtgctcttcgtacatgtgacactgttcccgctctttcccagctggctggaggcgtgatcctgggtgtggccctgtggctccgccatgacccgcagaccaccaacctcctgtatctggagctgggagacaagcccgcgcccaacaccttctatgtaggtgagtgcacatgtggccgcagacgcattcagggagggcttctaggaggaggcaggtcctagccttttggatggggacatggagggtgaaagacagtcgggcatggcgtgtccgggcagggaggcggccctggaaagggctctgggcacaagggttgagatggaggtgggcctgtggcctgctggcccttctggtctgagccagggcagggggtggcagctaggcctgggcagggactgtgtggagaccttgcttattttaagtgtggggttatttcgggggaggctccctgagaagggtggggctggatgcctgggccacacagagcagccgaggcagctggcgctgtggagcccgggagggagggagggatggagctcaagggatggaacccagtgaggggtggagacggggcaggggaggggtggagaggggtggagacgccccagaggcggtgtgactcagctgcccctgcaggcagctgcaccttgctgccttattaggctgcgtgtgggggactgggctgccctccctgcccccaggagcaggagcaggagtgatggaggaggaggaggggaggggcaaggccaggaggaggaggagggccatctcactgtgcagagagcagcacccttcctcctggtgcccctggcagggctggtgctggtggggctctgggagcatttgttgagatgcttctggccttgaaaggaggcccctgggatggctctgttgccctcacaggctgaggggtgggtgaggtgggcagcctgtgtgtccccagtcctcagggcttccctcagccggcaggtgcccccaggcctggagctgcagggccaggccccctgccagttacggaggctgcttggcttggttgctgaaccagggccccaggaggccgaaatagccccacacctgcgccgtcccacctctttgtccagtcaccccagggccaggtgagggccctggccacacagcgtgcccgttccttcttccccatgccccgctcatgggtcagagggccggtgctggggtccagatggtgtcaacagggatggtccctgtcctccccagagacagaagcctgtggcccacggagggtttctgggcccagccgatcctagggagggtcccatggccctgcccataggttcctggcctctctcggggccgtggtgccctcacaggtggtgtcaggaaggacgggaaaggctgcttgtcccaggggctcatgtggagaccaccccctgcacgcagctggggcgctcctgcctgtgtcctcagaagcactcggcttagctttgcccatgtgcctgggctgtgggtggcagagcccggccagcatcctccgatctccaagggtgcatctctactggaggcccctcctgggcctcttgctccccgcttcccagatcattaggatatttggggtccagaagggcctcccagccatcctgggccttgtcctccggggccaccagtccagccagtgacaaccacagcatccccggcctggaacgaggctgcccccagcacgttcctcgtactcctgtccagggacaggaggggctgcccctgccaccgagtccccttctccaggacctggggcctgtgggtgtgaggcaggtgttcttggaaggggtcactctccaggcacccggcggccaaggcttgtggctggagcagctcccgctgtggggtcggcgtcgggccccgtgtggccggagaggagctgaagggtcacttagcttcgggctggggcgaggacaggggacaccccagagaggtatgccaggcctccttcctgcgccccactctcggcagaagcagaggtcacaggctgtgctgaggccccatggtgctgcccccatgatgccagggtgaggctggcgttggaagcaggtgtctgacctgcatggtgtcaccgtggccacatcagagctccagccccagagccgcccaccctcggtccttggctgtggtttccctgggctggaggagcctgccgttgtgttggccacacgaccacaggacctgccacccccgacgtgggctctgcctgggcccccactggacagggaccccttggagctcctctggccaccaagtcctcgcccattccagaatcggccttctggagcctcttgctgtccctgatgcgggctgggccttgccaagggctttttttcctgcgccgggaacagggtggatttgctgggctcactcccctcagagacgctgcgggtgcggtgggttaggcccaagggcgttaagagaggaggctggggtggggctggggcctggcagggggtctggcagccctgggcctcccacctcctgtcaggaccaaaaaaggcaacgcgcctctcctgacctgtaccccggagtgaacccaaccttgcaacccaggagtgtcagggcctgaggggagggagacctggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaatccaacttgatcctccccacacagcagccaggttcaaatgcaggtcccgtaacggaagtgctgctgtgcagcccagattggggggcaggagccagcagggcccccccaccctcttctcgcaccacactggggaggcagcattggttccagttccggttcctgggctgccctctcaaccccggcctacagtggggcccaccctgtgccttctgatgccactcccaccccacgccaagtcccagaggctttgggagcgggtgaaggcggtgggtggcgggtggcaggtgcaggcggtgggtggtgggtgtggcaggtggcgggccccaccgcaggtgtcatccctgcgaagcacctgtcgccagcactcagagcgctcatgaggtgcccagtccccatgtggcctccttagtctccgtcctgtgtcatggaagaggtaactgaggcacagaaaactcaccaggccaggctgggatgtgaggtcccttgctgctcatccctggcagtcagcaaccctacatcttcccagctgggcggcccgtggtgggttcggcacccaggaccctccggggtcttgggctgtggcgagtgtgtaggcacccacctggtgtctctctccccgcaaggcatctacatcctcatcgctgtgggcgctgtcatgatgttcgttggcttcctgggctgctacggggccatccaggaatcccagtgcctgctggggacggtaaggcagggaggcgggcctgtgcctgggccggggaggggctgggggctgcgtctggccctgaggagggggcagagctggtgctcagggcggagcctagaattctgggggaggtggctcctgtgccctgcttttcccgtttggtttttaaattaaatcccaccgtgcttggtctccatcgtggccagttcctacgtgaccgcttttctttgtcaaaaaatagccacaaatataacagggagcaagcctcagctctgaggccagcctcggcgtcccgggcacaccgccccctgtgggaagcccaggcctggctgtgccatccagggcctggccagtccaggaagagggagcctatgcccgtgtctccagtgggggaaactgaggcagatcccatggctcccccttccgtggggagcaggaacaagggggtggggaagatcagtcaggggtcatgctgctgcacacgcctccctgggggctgcagacatcctggactcaccagcctgtgaccccaaaccacacgccccgccccatccaccccgtcctgtggagcctggtgccgcgtggggacatcctgggctttgacggctcctccctgcgctgagttttagcctctgtgccccagggctccacacaagccgctcactcctggtcaggtcgtgggctggtggctcccactagcccctcacagacacgcctgctgggcacctgggtgtgtgtccttgggccccgcctacagcctgccctctttcctccctctggccactgcccggctccagttcttcacctgcctggtcatcctgtttgcctgtgaggtggccgccggcatctggggctttgtcaacaaggaccaggtgagcctgggtgtgcagggacagggtggggtgggtgacgggggcaccctcctctcctgtcgcgggtgggggttgggctgactcatggcttgtgggagctctttgggctcttcctgggtcccacttgccaggaggatctccaggggctttatggaggaggcagcattggggctgagcaccaggccagcctcccgtgtcccagcactcccggggcagctgagagtgcagagtccttgtcctctggggtctagcctcgaagccaccctgcccagggagagcctgggaaaagtgcgtccgcctggggcggggcggggtgggggcaaggagggggaggttccccctgtgcatgtgaccgcacccctcccccagatcgccaaggatgtgaagcagttctatgaccaggccctacagcaggccgtggtggatgatgacgccaacaacgccaaggctgtggtgaagaccttccacgagacggtgcggccccggggggcgagggcggggagcagggccccgggaacccggcggggtgtgtctcgtcctggatgaatcctgcctacgcccagacctcaggagcaggaggtgcccttgggacctccaggacccctggtctcaactggtcctcgggtgggaacctagtgggccagggtggcccagggtgcggaaagctctgagcagcgcagctgaggaggaagaaggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcag

SEQ ID NO: 1618 - DNA, 23792 bp, Homo sapiens
  source 1..23792: mol_type = genomic DNA
tcggatgctgtttacccattaaagaggatgctacaaatgtttattcattaaagccactcataacagcatagtacaaccctatttaaaaaagaaagacatattttacatgtatgtgtagaaaataatcaggaagaatgtacaccatattaacaggagattattcctaaggtgaagaattatgagtggttcttatttccttatctacttaagttttttctctccaatgggcaggcattgcttgtaccataccttaagcaaggaagtgcatgtttgggacagcagtttgggctctcagcctccttaagagagtcaggtctgcctcatccctgtatctgctagttgagcagaggccagggctgtgtgaggggctctccaacaattgtctttacaaagtataaaaagtcatcagtgatcccaggaacatgtttgtatctcaaattcagagattcaagagggccttagtttaacctcactgatgctcaaattctatttgtaaaggggtagcctgtcctctttcatgggcccctctgcaatgcaagggctgggagagcaattccgcctccacataggggtttcacagagattttctttagagatagagggattcattttccagggttaagctcaccacttcattttattttaggtctatacaattttaggcttgattataaaaaaaaaaagtctgatattgtttacattatagaactctgccaaaggcagttctcttctttaattcattacctcctcgaggctctgggcacagtatcccaggtatcaagaagtacttgttcccttgccgttggagactcaagcacctcaccctgagacaggggcctcggaaagaaagacctgaatggtgtggaggaaagagccctgagctgggagacaaggtccctccagctactgctccaaccctgacttgctgtgtgcctttgatcaagctgtctctgggctttagcctccccctttgtaaaacgggcggggaagaggttgagatggcatgggtgcctccagctctctcagcatgattctgagaactctgcgggtagctctggcctgcccctttccacgccctaccgcgatgtgcgcacaacagtattgtgacccttgtggtgtactgtagattttacctagttttgtttcccgtcaaacacataaagaaaaagtaatctttcccaccccgcccccactaaaataataatcatgagaatgaatacacagggaggaagactggaaaaaatgaaagggaaggacttgctccctcaaaaggaaggatctcagtttgaagtaatgtagtggctgttgcacagggttagacgtatctcgccgaaaggctgggcttgtctcccgatttgaccacaggcctgaaagagaggaaagcgaccatcattgtagccagaaccccgccagtgcagcatccatccagccacgtccagcctcccaatcccccagcctttgaaaggtctgagaacctgttcctggggcaccagcatgggactgggtgaatgacgtcagcacagcacccgtgctaaatgccttacttgcaccatctcatgtaatcctcacagcagccttaagggtgggcactgagattgagaagttaaacttgcccaaggtcacacatctaggaggtggctgagccaggatctaaaccgagttagtctagcttcctggagcccctgtcaaggtctccacagaggtgtgagagtgagactgataaccaaagtcattagctgacctgattctcagccccggaggatgacagggagagaggaggatgtgagcaaatcaccaccatcagccaaatgatgttacgctaaaaacgtgttaattcagcaccaggctagcaccttgtaaacatgctaattcatcatgagcgtcatgtctgcactctcagccctctaaaacctctctgttgaagctgagcggcccaccatcatcactgagtatattaactcgggtgttggaatttcccaggtgtgtttaatctgtatagctttgtattttaaggcagaactttattctcagttattcatctcaaaatgagagttttcagaaaagatcgagaaaagggatggtccttctgcaaaagttccaaagtgcaccctgaataataaaaatgctaaaaactggccgggtgcggtagctcacgcctataatcccagcactttgggaggccaaggcgggcggatcacgaggtcaggagatcgagaccatcctggctaacacggtgaaaccccgtctctactaaaaatacaaaaaattagccgggtgttgtggcgggtgcctgtagtcccagctacttgggaggttgaggcaggagaatggcgtgaacccgggaggcggagcttgcagtgagccgagatcgcaccactgcactcaagcctgggcgacatagcgagactccgtctcaaaaaaaaaaaaaaaaaaaaagaaaagaaaagaaaagaaaagctaaaaacttccccccccactttttttttttttttttgtgagatggaatcttgctctgttacccaggctggagtgcagtggtacgatctcagctcactgcaacctccgcctcccacgttcaagcgattctcctgcctcagcctcctgagtagcccggattataggcatgcaccacaatacccggctcattttcaaagtctttatccccttggtatatcacctgtaacatatgcattggaaatccattgcatttccattgctaaaaacaacaatgtgtaaagtcctgaacttggattccctcagaaaaatgtaaaggagtataaaatgcaaactccaggtataaaatgtaaaatatttcatctactgaaaagaactggtgtacacagtcggttatccttaacacttcagcctgcagccatggggaaggtgtctgagctttggatggaagttgcagctcccgggcagtatgaccttggacaaatcactaaatgttctaagcctcagtttccttatctgtaaaatgcaggtaatcatgactactttaaaagttgtcataaaacttaaaattaaaaaaaatctataaagcaagtaacgtgcgttgtaggctttcatcaaatggttattactattgataatctgagtttaatgtgcctttgccactttactaatccctgagccatgagatggcacaaagttgctgtgaggattaagagagatggggagtattacccctatcacagtgcctgactagagcaggcacttgttagatgctaccacagggatgcctcagccaacgggtggagagaggtttttaacagagagggagagagagagagagtgtgtgtgtgtgtgtgtgtgtgtgtgtgatcatgggctgaaactggatgaggcagtcacttgagctgccagatagccaattgtccctgcatctcgttccccttttttctactccagtccttggcagcaaaccaaggtcctacatgacacagagaagttagcaaccaaagccattattattttggttcagctgataaaagattggctctccctcaaaaaactagaccagccaagtaggaaaaaaaattgttttcttaagaaaacaacaaaacccagatggaataatcagaataaagaggaggtcaggtcctacgaggagctaggataaattgggggaatccctcaggttttttttttttttttttggaagtgccaggtcaaataagatggagatttactggagtcacactgctgttggcacccgcctaacccgggcctcctttttctcaaagacacaggccagatgccagccttggcctctctttgctcaggaactggctgactccctgccccaggatttcacggccatgacctctctctgggaaaagttcccactatttgctgctggggaaaccaggaccccaccccagggctggccaaggtgagcaggctgagttcaaaagagactcaccggggacatttgcaaacacgtcttcggttccctggataaggaaaaagaagggaaaaagtgagtgcccctatccatcaatagtccccaaagacagtgtattttttgttgttgctgttgttgttgctgctgttttttggttttacaaaaaatcatttcagaacgatcatgggctgaaattggatgaggcaaatagggaattgcctctacgaattctccttcctttcccctatttctttgaggattataactcttgagagccgggtaagggcttcttatccatccttcgtctcaagcatcaattaaaaaaaattgcaactacagacgcgggcgaaagcggggagcctgcagacctgatccggcacctctcttgcatgggacccaaagcagggtgggcggttcgccgaagagggccaaggacgaacctcaaactgatggtggttttgactaaccctcctgggcacttgactcggccacagcggccccctcccggcgggcgtttgtcatgtgtccagacatgtgcgcgcgcgctgcgggcttcgtcgacggaacacacccgctgcagcggctctgggaacgcggctttgtctcccaaaacctctccgagagcgcaaggagcgggaagggctttctcgcattctatctcccagaaagaagtgcctgtacctgcggggcagctcgggagtcccagaaaactcaaccccaagctcccccctcgcaaggtccgcctggagctagcagagccaagggcaggagcggggccgactccttcccgccgcgattcctcgggacttactgtggttgcagtaaagggtgataaccagtgacaggagaaggaccccacaagtcccggccaagggcgcccagatgtagatatcacaggcgaagtccagccccctcgtgtgcactgacgacaccaaagacgccgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggcctcgcgcacctttccccacggggacgcctccccccggttttcctgggagaagggatagcagaggagacaggatggggaccccgggatgcgcgcggacccctgtgctcgggcctcggctcagcccagcgcacccggcgcccagagccggagcgcaggagccagctcccctgcacctggcctctctcccgggctgaaccagcaaccctggagcgcgggttgattgctgtccgcattttacccacgagcaaacggaggcgcagataatttaagtcatttgcccagaatcacacaagaatccgaactcgagtccagatcggccggacgtaaaaagccatccccagtccctactcagcctcgcgttagcctcagtttgctgtgtctgtgaaatgggaacagtatctaagtcgcttccaggtgcgctaagaggcttgaaagcagggcccaggtgtggaaaacaggttgaggtgaaccccaagccccacgcggagaggtgccgcaacccggcgcgcggacctggcaggaagaccggcacgaagtggctgaagtacatgatggagttgctcagggccgagcagaaatagtagccctcgttctctcggcggaagtcgctcagggtgaggacgaaggtgtcccccaacctcttgcccgagaaccgctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatgaggaaaagggcttggaaatagtccttggaaatggttgtcttgtgagagtgacagagtgggtgaagggagaccaaagatttcaagaagtgagggcgagagtaggcagcaaaggaggggagtgtcccttcctttgccttcactaaaggcgtctcttgtactgtcaccttgggactttttattggcaaaatgggcactgagggctgaaaaggaagaggaactagcgacctgcccgcttctgaggaactcgctagagcagccccagttttcaccgaggaaggaccctctcccttcccccaggagatttccatgagagcggcagcagccgaagctttgggtgtcggtgtcagtgcgctgctgacctcattcttccggcctttcatccagcggctaaactcaccacacagcctcatctcttcttggagccattgcaacagccttcaattcacaccagtctctctcctgatcagtcctccagccacgttgttataaaaattattattctcacaaaggggatctgacagcgtcactgctgcagcctcccatggcctgcattgctggatggaaattcaacccccagcttggttgaccagcccttgggtgctggctcctcccagcctccgcacagccccctgccctgcctttcccatacacctgcagctgcagcttcacaggcttgaagtcattcaacccctgcgctctgtgctttcacgcccttgcacttgcggtccctcggcctggaatgctggtctgtttaagccctggaggcagctcctgtgctgtctcatttggacctcatttctttcacccccagctctgggtgctctgcagggaggtgtgggtgatgtgggtgaatgcttgggtagaggcggttttctcttttctgtccctaacacatgtgtgtccccttcctttttgtttctttaaaaaataaaataaaataaaaaagactggagtctcgctgttttgctcaggctggccttgggactcctgagctccagtgatcctcccaccccagccccctgagtagctgggactacaggctcatctttcctttttgactgttgctgtcctgaaaccttccagctccagtggcatgccctcttcccatttcttcagggtttctgagtctttccactttgaatcccatagtggctgcacctcacattgctactgcttgatcctagagacaagacacctggcattctgtgttccatgtgtctgccccacccattagttctgctgggcgaggaccatgccgagacttcatgatgtgtcctccatccccagaaacacagcatgggctgagctgtgcttgttgaactgcattctccttgtccttgtgaagtacaaacttaagtgttggatgggttctttgtcgttgttgctatttttttttttgagatggggtctggctgtgttgcccaggctggagtgcagtgtggcaccacctcggctcactgcagcctctacctcccaggctcaagtgatccttccacctcagcctcccaagtagctgggaccacaggagcacaccaccatgcccagctaattttttgtatttttggtagagatggggtttcaccatgttgcccaggctggtctccaatgcccgaggtcaggcgctttgccccgccttggcctccaaagtgttgagattacaggtgtgagccaccatatcagggcctggatgggcttttttttttttttttaattattttgatttcagtacctccttccagctccctcaaagcatccaagatgcttattctagcatggaacatgtaacattttatattcagaaatttttaaaaatgtcttttaagtgacaacagtgcaatatattcttgtacgaaaacaaacacaaagttccctgtctcaactctcctcactgtcacctgctccccacagaaaaccactgttacagttgaatgtgtcccttagatattatctgtacataaacagatgtttatacatcatcttagacacatgggattgtatgagataaatatttttttgcaacctatcttgtttcacagtagaaggagagcgttcagcagatgaagatccaccccattcttataaatgggtgcattatatatgggtgttccataatttaattctgctgttagtggacatttaggcgatttctcattattgcaacactagcaaggctgtggtagatataatgtatctgtatcactgagggcttgcaccagtacctgcagctttttcaaatgggagatgagggagttggggaagaaaacacctttacaatgatggttataactggcctatcgatgtatgcatgtgtgtgtgtgtgtgcatggtatgagggtccctcgctgtgtagacacagtgctgtccctcaactcacatgaatgagggagacaaggaagcaatcaagtccagacaggccaccaacacatcaattcttgctgtagatggtagtttgccattttgctcagcaccaccagcactgtatcaggagtgtcaaatggccctgctggccaaaggctacaatcaacagggtggtaaggaagatggctagacacgaaactgcacttgcccagtggtggaagcactgagggggccagagtcaacctccacctatttggatcttgagaatcaggcccctgagtgtgatgatggccagatttgggggtgtactgctttaaaatagactagttccatcttagtctcacggaaatcagcttgggggccttctagccctgcagctcagaaaagtgtcagccagtggggtggcagcccctttgtacagagcaccatgggggttggggtggggaggataaggcaacatgtcaaacccatcaaggaggctttgtgaccccagtgatattttttgcagaacgtggtggattttcgatgtgaccacaatgacatccgccttgcagtggcagaacagatgcaattgcacaagttctggagaaactttctgtagaccaggtgtgcagagggctgggttgggcctgtccatcactgccaggtaagttcccaaaccccacactgtagcactgacttgggatggcatgaagaaatgtgaatgactgcactcctttaagcaagccccttatttaaaaaaatatccagaagtagatagagtaagatagtaaccagtttctatgctgatttaaactggtccatggaaatggaaaactttaatgtagattaaagacatattcaaaatgcaaaaccgggcagagcagtggtaggaaatccatcagggttctgtgccactgctcctaagacatgaactgcagggacaacttggaatcatggctgggaaattgcctgctgtgtccccatcgccaattcaggtctatggagatgttactgttcttggaaggagttagcttgtccagggctagaaactctagagttatcagggcttgttttatcttaattggaaataccaatcaatttggcctcacttctgtcacctttcttttcctccaccccgagttccccaagttcatctagctgctgtccttctttcctggacttttgcaatggcctcttaactggccaaccccatttctgctctggtcccttctagagaaaatctcatcatgccaaccccctgcttcaacctgaaaggacttcctggtgtccctagtagaatgtcggggatccctaatgttgcctgtgaggccctgcacacttggtttcatagtctctgtcctcttgtctgtcaccttcttcactcctcctaggttccgcatctctcatttctcaagcggaccctagtcctttccacttcagagccattaaacatgctattccctcagccaagaatgttctcacctctgctctctgcttaccaaactcctctcccttaagacccagctcaagcatctccttcctgtggggtttagctccttccccctcccactcccagacagtacagaccacatccttctcttctctgtgtcacccggaccttgggtatctgcagactggagcacaatggtttgtttgcctgtccagcttgacaaccaaacccttggtcccttgaggaaggagccttgtccctctcatgtttacaccagggtgccaaacagagggcttggcacacacttgagtggcacacactcaagaaattcttgctcagtaaaagctaaaggaaggtagaagtagggtacagcagaccagaggaggcttagatagttcattccaagtaagagtggtcaggaaaggcttcacatatagttgggtttgaagataaaggaagaattaggagagaggttgtttagaatgaggcatttgatatgtctgatcaagatcagctgataccatgctttaacatatagcaatggtatagttaaaaacaaaagaagaggaggaaggggagaaggcagatgtactcaaaagcaagataaacgtcttcaaggatgtagttgcaggacaatggctggaatcaggggctggcttgctgggatctgttcttagcaaaccattcttgggcctgggtcttgagggtctgttcttagtgtagaggcaccaagagtttgactccttcagctaacagagtttcacagtgctttgcctatagaggaaggctggagccaggctctctgcttgaaacagggatttggatctgattttctcttgattgaaagagagcccacagccacccatgtaaggcctagttctgactgtgggccctggaaagtcagaggctactttaaaaaactcaggaaaagagagagtaaagagaggaagagattttcaaaaatttctattcaagataaccctgcacacacactcgaaattcaaagtatacataaaaaagactcaacaagtggaatgtgaattcacttccaaaaagaggcaaattattgaacaatttgaaaaatgtttaaaacaaagagaacaacaaatgtagaaaatgcagaaattaaagaagaacagttgaagatgataaatactgagcatactggaaatgaacactctacatattaaacaaggatatactctaggttggacatagttgaagggataattaatgaattggaagctagcattgagaaattcatagagaatgcaacacagggagatgaagacagaagcagtttgaaaaagctgttgagatgtatattagcatggtgaagtgtttaataggatttcagaaaggggagaacaaagggaatgtggagaagaaatatgggaagaaagcatggctgaaaatttttcacaattaaagacaaacattctcagatcaaaaatactcttagtgccaagtataaaaacatatacatctttgcacatatcaaggtgaattataaacatcaagagtaaagagaagagggcatcccaggaagctaggatgtttgaaatataattgggagaatccttgttgcagtttggattgggcagagagggtaagaagctgaactgtaatggggaaaaatatacacattttggttacaccttgcattgactctctgtcatcccctcccttggtgctgacacatgcttactgtaaaactgatccaatgatcccatagagttgatgtttgtggtttctttgaataaacatataaattgatccttgccttcttaaaacctgagaaagttacatttgtcttatctgagttcctttctagggaaaccaactatcaggcctcccagatggtagcaatgagctgaaactcaccagatcacttattatgaacaataagacgtcagactcttcacctggtatgatggcctaactaacctcctgtttcctgttgtccaactccttttccttactcctcccaacttcctgttttcccacacatgattacatgtcttccctgctatataaaccccttaattttagtcaggtcagagggatggatttgagactgatctcctatctccttggctgcagcacctgactaaattcttcttccttggcaatacttgttgtctcagtgattggctttctgtgaggtgagcagaaggacctagatggatcccccggtgtttcggtaacaaaattgttttggatctttaatctcagtaacactgaaacagaagcgttctgaatgcaactggagagccaggatttgagttcagaagaggggtcagggctggggatgtagccttgggaaggaggtgataagttgtgagagtgggtgtcattgcaaagggaggtggtgtggaaagaacatacagaagagtatatggaaccttcagggaaggctcgtattgaagagcaggaaataaaacattggcaaggaatccaggtagtgcaggaaattcagaatggggcttgagaaggtggaagaacttcacaggggaggtttgggctataagagaagcacagagaggacatcaaagcctgtggcaggtagagattgtaagctcatgtctgcccctgacccacatgaggatgtcccacatgtttgccattggtggatgataagatgaggaggactcacaggagaaaggccaacaagggagggtaggggcagcatggggacttgtggagggcaatgtcagatgaagtgatgttgacttctgaacttcattcattattcactcatttaaatatttctgctattcacttttttaaaaaaaagttttgaaaacattttaacatagaacaatatgtcaaataatataaaatgcccactctttataagtgttagcattttgtcgcatttccttcacatgaacattacagataaaactgtaccctcccaagtaccaccccacccgccttctcatgaaaagctaaatttggagttttgttcattaattatgacagaaagatggtaagttttttaatttttaatctgttaacctttcctatggagctgagagagaaggatgccgaatgtccaatgagtgtggatttgtctatttctccttttaattcagttcatattttgtctcctatattttgaagctttgttattaggtgcatacacatttagaattgtgccttctggatgaattcactcttttatcattatgaaatgttcgtctttacctctgcctctggtaatactttgttgtgaagtctaccttttattcataaggaacagagctttctttcttttttttttttttgagatggagtttccctcttgttgctcaggttggagtgcaatggcacgatgttggctcaccgcaacctccacctcccaggttcaagctattctcctgcctcagcctcccgagtagctgggattacaggcatgcaccaccacgtccggctaattttgtatttttagtagagacagggtttctccatgttggtcaggctggtctcgaactcccaacctcaggtgatccacctgcctcagcctcccaaagtgctgggattacaggcatgagccactgtgcccggccagaaacacaactttcttatgcttcccgtttgcataatgtatcttttcctttttcttttttttttttgaggcagagtctagctctgttgcccaggctgcagtgcagtggtgcgatctcatctcactgcaacctttgcctccagggttcaagcaattctcctgtctcagcctcctgagtagctaggactacaggtgcacggcaccatgcccagctaatttttatatttttagtagagatggggtttcactatgttggccaggctggttttgaactcctgacctcaggcaatctgcccacctggccttccaaagtgctgggattacaggcatgaaccactgtgcccagcctgcataatgtatctttttctatccatttactttcaacttccccttctctgttttgaaatgtttactagatatgtatacatgtatatgtgtatatatatctataaatgctatataattttattttctgagagtttcaaaatacagaaatgtcatcatattgtgtgtctttgagctatgttgatacatatagatttattttaaatgctgtgtggtgtattatcctgtgaatgtgccacagtttcatgttcagtggttcttgaaccagagtgttcatctctctggaagtatatggaggctgtccttggggatacacataattttaaggaaattgttttccagattctcaactcccattggttctcttctcataaaatggacctgcccaagaacaagtccctgtgtttaggctttgtgctcgttctcctttctggcctattctttcatgattattttatttcccactttaaaactgaaaggcaaacttcccgccctcctgttccttactatgctccagaggtgggcacgtaatcctctgggccaccaataaaaagacaaatccaaacatttttcatgtaatttccatccgttagaaattgccaaagaatgcatttctcctgagcagagtccccagtatccaggtagagtcatctgggggccgggcacggtggctcacgcttgtaatcccagcactttggaaggccgaggtgggcggatcacgaagtcaggagatcgagaccatcctggctaacacggtgaaaccccatctctaccaaaaatacaaaaaattagccgggcacggtggcgggcgcctgtagtcccagcgactcgggaggctgcggcaggagaatggcttgaacccgggaagtggagcttccagtgagccaagatcacaccactgcactccagcctgggcgacagagcgagactctgtctcaaaaaaaaaagaaagaaaagagtcatctgggagggatgcaggaggcagagtgcctcacagcaggctttggggcctcatccctctactcagctctctatcatcgagctagaattcagaggtgagacagtcattatgaggatgcatattaacgtgttcattatgattacaaaaggaatcagaattcttttttttttttttaacagaaattaagtctgagttgttaattggtttgacattgaagaccagctttgccaatgaggttaatggcagtattttaactttccttgaatctagtgagctaaatctttagctccaaggttttgatgagaatcaagtttagcgctaaagaaacagcttagaaaaagaaagaaaagaaaacacttttaacaagtttaaaatctatgataagataaaagcattttggccaggtgcggtggctcatgcctgtaatcccagcactctgggaggccgcagtgggtggatcacaaggtcaggagtttgagactagcctggccaacatggtgaaaccccgtctctactaaaaatacaaagaaaatttagtcgggcatggtggcaagcgcctgtaatcccagctactcaggaggctgaggcaggagaattgcttgaacccaggaggtggaggtagcagtgagccgagatcacaccactgcactccagcctgggcgacagaaaaaaaaaaaaagaaagaaaaaaaaagataaaaacattatatcacaatattgtttgtattggaatttgtcttgaaattaaattaaaaatatttctaataccccaacactttccaagttaatcaatttcagcaatcgtttttaagtgaaagaagaatgatgtcattgatggctacttggtaggcttcggtaaaacctagtttagggcttccaaaacccaagaaagtgaataaatctaaaaatggtaacaaacccatgtgcaggtcagtggttcccaagtgtttgctttcaacaaaattggaagaaggccttctagatttggcaactatcacaggttgaattgtgtccccccaagtatatttgttgaagtcttatactctagcatctcagaatgtgaccttatttggagacaaggtccttacagaggtaatcaagttcaaatgaggccaataggatgggtcctaatccaatataactggtgtccttgtggaaaggggcaatcaggacacacacacagagaacatcatctgaaaacaaggcagagatggggtgatgtttctacaagtcaaggaatgccaaagattgccagcaactgactagaagctaggtgagaagcatggaacaaattccttctgtagccctcagaaggaacacacccagctgacaccttgatcctgaacttctagcttctagaactgtgaggcaataaatttcttttgttgaagccacctagtttgtggtactttgttaaaacagccctggcaaactaatacagcaactaatagatcattaaaattaatttttgatgatagataacattgtctccctccctccctgcctccctcccttccttccttccttccctccttcccgctctctttctctctctctttttccctttctccctttctctctctctctctctttctcccttggagaaagggtcttgcactttcgcccaggctggagtgcagtggagtcactgcagcctcaacctcctgggctcaaacagtcctcccacctcagcctcccaagtagctgggactatgggtgcacaccatcatacctggctaaatttttgtagagatgggggttcaccatgttgcccaggctggtcttgaactcctggactcaaggaatccatccatccaccttggcctccaaaatgctgggattacagacgtgagccactgcacctggttcatgcttttgtctttttgaaaaaaaaaggaaaaagttaaaagatttagtgattctgctgtaacaaagccaactatttatttatggagacaaaatttctcagtacttacattgtatgacaaacaaaagcaaaacaaaattaatactgaactctgtctcattctagcaatcaataaataaaataaatcctgttattttatgggttcattaattaattggaccacaaaattcatttgtggggggtccatttcattaagagctgaattttcccccaaaattatgttttaaaaagctttttttgagataattgtagattgacatgcacatacaagaaagggtacagagaattccatacccttcacccagtttcccctaacaaaggttacttttatatttatttatttatttttagagacagagcattcttctgttgcccaggctggagtgcagtggtgtgatctgggcccactgcaacctccgcctcctggattcaagtgagtctcttgcttcagcctccctagtagctgggattacaggcacccgccatcatgtctggctaatttttgtatttttagtagagacaggatttcaccatgttagccaggctggtctcaaactcctgaactctagtaatctgcctgcctcggcctcccaaagtgctgggattacaggtgtgagccaccatgcctggccaaaggttacttttaatgttcattaattttgaagacttgcagtttatttatgctataaaggacaattgtgcactattaatagtcgcaatgatgacataatctaagacttttaatatttagaaacttatggttgcaggaaattaaaaattcatctcatgtgcttttttggcagagaagtatgaaatattgatcaatataaggtccttaagcatatgcacctattaaacttttatggaggaagtagaatagaattcataagtccatttgtttttactctttatttttttgagacagagtctcactctgccgcccaggctggaccgcagtggcacaatctccactcactgcaacctctgcctccttggttcaagtgattctcgtgtctcagccacctgagtagctgggattgctactcaggtgtgcaccaccacacccgactaatttttgtatttttagtagagatgggatttcacccctttggccaggttggtcttgaactcttggcctcaagtgatctgcctgccttggcttcccaaaatgctgggattacaggtgtgaaccatcgcgcctggcctagaattcataagtttaaggagaaaaaggagtgatgaaaaatttccaaaagttaagaactttttcttgtattttaaaaatgagtgacggttgaaacaaaattgatatattatttatgtgctattagaaataattaaaaagaataaggttttcttttttaaaaatcaacatttactttggaaattatgtcctttatagtgatgaaaaatgtttgatgtcaagttaaaagtgagtaaagaagtacattcattttataacagcatttttcacagtagctaaaatgtggtagcaacccaagtgtttattactggatgaatagataaacaaaatgtggactcaggcatctctcttctgggctcatacccaaaggaaatgaaatcaccacctcaccaaggtatctgtactcctgtgtttattgtagcattattcataataaccaagatatggagacaacctagacaaccatcaatggacgaatggtttaagaaattgtggtacggatatatacaagggaattcagccttaaaaaaggaggagatagcatttgccataacctagacgggcctggaggacattatgctaaatgaaagaagccagacacagaaaaaaaatattgcacgatcttacctgtatgtggaatcttttatttatttattttcttagacggagtctcactctgttgcccacgctggagtgcagtggcgcaattttggctcaccgcaacctctgcctcctgggttcaagtaattctcctgcctcagcctcctgagtagctgggactacaggcacctgccaccacacctggctaattgtatttttagtagatatggggttttgccatgttggccaggctggtctcaaactcctgacctcagatgatccacctgccttggcctcccaaagtgctgggattacaggtgtgagctaccatgcctggcctgtggaatcttttaaaaaggtcaaatatatagagaataaaacagtggttatcaagattggagtaggagagaggaaatgggcagatgtaggcctaaggatacgaagtagcaaacatataggatgaacaagtcaaataaagtacaatatgaagactacaattaataatagcatattattccaggatttttgctagatgagcatagttgcttttgctacaggaggaaataaatgggtaactaagtgagatgatgcataagtcaatttgtttcactatagtatccattctactaaatatgtgtgtcttataccatgatgttgtatataccttatatatacacaataaaatttatttaaacaaacaaaatgtggtatatacatagagtggaatattattcagccttaaaaaggaagttctgacacatgccacaatatggatgaatcttgaggatattatgctaagtgaattaagccagtcacaaaaaaccaaatactgtatgattctatgtatttgaggtatttaaagtagtcaaaataatagagacagaaagtagaatggtggttgggacaggctggggagagggaggagtgggagttatgtttaacggttatagagttttagtttttctagatgaaaagagttagagagaaggatggtggtgaaggttgcacaacaatgtgcatgaacttaataccactgaactgtacacttaaatgttaaaatggtaagattgttatgtgtattttgccacaataaattagtattattattttttttagagacagagtctagctctgtcaaccaggttgagtgcattggtgtgataacagctcactgcagcctccaactcttgagcccccaactcctggcctcaagcagtcctcctgcctcagcctcccaaagtgctgagattacaggggtgagccattcactgttccttgctaaatcttttttttttttttttttttttttttgagacagagtctcgctctgtcacccaggctggagtgcagtggtgcgatctcagctcgctgcaagctccacctcctgggcttaaatgattttcctacttcagcttcctgagtagctgggattacaggcacacgccaccatgcctggctaatttttgtatttgtagtagagacagagttttgccatgttggccagactggtctcgaactcctgacctcaagtgatccacctgcctaagccttcctaagtgttgggattacaggcatgagccaccacacctggcctaaatttttttttttaatgagtgaaggagtccatagtctttcatactttggggtgatacaagaaaaggaaaaaggtttaatgacaactgccactttcatttattcattcctttgttgatgtacttttgggctgggttttgctgttataagctaaactacaatggacatccttgtacacattccctagagtccaagtacaagattttctctagggtgttttcctggaaaaggaatgacttgaggagtatggcaaccttgtgagaaatgactgattcgaaagatgtgtcccatagcttttgatacatttttctccgaagtcatggttccagtccacactcacaccagctgtggaggagttttcatttacccacgagctttgttatttctggttttgtcagtcttttcaattctgccaatctcatagggtgtgatggtatctcgttgtttaaacctgacttctcttgttaaggttgagaccgagcatctggccccatgtttgctggctattcagctttcctcttctgcagactgcccgtttgtccactgctctgtttcagtaacttccatataccaagaactctctgccttccataactcacatcacttaaaatacgaatttttttgatgcttagagaacctgatttccttccaaccaattgtgctctcctaattccaacaaccaaatgaagcttcaactcttctttttgttcagagccctcctgagtcctgtcctactcacagtaaaggctgtggcaaaataaataaataagtaaataaaggggaaaaatacactgcatccaaaaaaggctcgtttctttttctttctttctctctctctctttctttttctttttctcttgttgtgacaattgtcacaacaaaatgtgtatgtgacaatttgttatcttaaaacagtttacccaaaatagaaaccttacaaagccagtggaaacttttctttttgcataagttggttaattcttttgagtgctggcctgggatccatgaaataacctcaactcgaccataaaacttttcactcccacgttatgcaaacggtgatgaccttgttggtggcaagccccccgtgtgactttccgaggggatctgagtggtgcaaggtggaggacgcagtgatggaaacattgcgagagggaaggcgtctgtttccacccacttaccctcagagcatgagggctgggcgaaggctctgactcctgtagggggtgacccatttctaggactatagaaggagaggtgtggacctggaaaaaggaaggaaagaccacggcaaggaaagtcaagaagtgggagaagtcaagggctctctcctcccttcctccttgtccttggcctgcagcaactcctctttctctttttgtggggacagactgaagaggatttcttagtatggtttgtaccttcccagtagagcaggaaaaagaggaacgagctgctccctccacacctcagacgctgaggtcaactgccctttgggcggggcacgttggctcacgcatctaatcccagcactttgggaggccgtgaggggagcatcacttgagcccaggagttggagaccggcctgggccacatagtgaggccccatcctccggcttgcaccactcaaattccctcgtaaagtcacacggggagcttgcccccagcaaggtcgtcagtttgcaaaacatgggagtgaaaagctttatggtggagtgtaggttatttcatggatcccaggccagcacccaaaagaattaaccatcttgtgcaaaaagaaaattttccactacttttttaaagtttctattttgggtaaatcgtttcaagataacaaattggagagagacctagagagaaatgagcctttttaagatgcagtttattttgccccatgatgtttttgtttttgtttttgccagagcctttactgtgagtaggacaggactcaggaggcctctgaacaaaaagaagcgttgaagcttcatttggttgttggaattgggagagcacaattggttggaaggaaatcaggttctctcaaaaaataaaataaaataaaataaaaaaaaaagccagcgtgctggcgcgggtccatggtccaagctacttgggaggctgaggtggggggatcgcttgagcccggaagtcgaggctgtagtgagccgtgattgcaccactgcactccagcctgggcgatagaacaagaccctgtctcttaaaacaaacaagaaacaaaacaaaacaaacaacaaaaaaattcatttgggaatgtttctgcgcgtgcccataagcagagccatgctataggatctcccctgtgccccaacaatcagcttcttacttggagggtagagaacggtgcttccccacgctgctgtgcaatggataggagctatgtgaagctggcgtatgggtggggtttgcaggcttcgtccggcttcatcgccggctgctgacccggcaccaattcctgttctgcaggtctcaccgcagaggggcacgccagccatgaggacagatgagggaacacgtgatgccacgatgggggtgccaggatgaggtgggtgcggtcgcggacaggcgcacgaggagcccagcggagcgccacccggagcaggcgcggaggagggctggggagggccaccaaggcgacgagagccggtgtgcctgaatcagcctaaaggagacggaggaggagtgtggtgggcgcaggggcagggagctgggggaagggcggggggctagcccaggctgaaggcaggcaggagcagggccgcgatgtcagacaagaaacggcagcagtgtgtttgggaacctagcaccaaccgcaccggtggagacagggtctgctgtagaggaggtggggccgggtcccagctaagtaaggcggtggatcttgcagcccttccatcctcagccgctcattctgcgcaaatctcggggccagccttggtggagccgtaaagcgtccaccagaacctggatccctccgccacctttcccatgaattcacctttctgtacacagcaagcgcctgagcggagacggccgacacgtttcccactgttaccccaggaaaccgcggctcctgagggggtcagggcctgggcagggggcagagctcagcgcgccgtactgaggcagaaacggggtccagagagggtggggtgggggtacagggaagggtcgcccgaaggtccctggcgcagggaggacagaggagggatctagaattcgtaggggagaagagaactcagaaaagatccggcccagcgcatttattttacagag

SEQ ID NO: 1619 - DNA, 7110 bp, Homo sapiens
  source 1..7110: mol_type = genomic DNA
tcggatgctgtttacccattaaagaggatgctacaaatgtttattcattaaagccactcataacagcatagtacaaccctatttaaaaaagaaagacatattttacatgtatgtgtagaaaataatcaggaagaatgtacaccatattaacaggagattattcctaaggtgaagaattatgagtggttcttatttccttatctacttaagttttttctctccaatgggcaggcattgcttgtaccataccttaagcaaggaagtgcatgtttgggacagcagtttgggctctcagcctccttaagagagtcaggtctgcctcatccctgtatctgctagttgagcagaggccagggctgtgtgaggggctctccaacaattgtctttacaaagtataaaaagtcatcagtgatcccaggaacatgtttgtatctcaaattcagagattcaagagggccttagtttaacctcactgatgctcaaattctatttgtaaaggggtagcctgtcctctttcatgggcccctctgcaatgcaagggctgggagagcaattccgcctccacataggggtttcacagagattttctttagagatagagggattcattttccagggttaagctcaccacttcattttattttaggtctatacaattttaggcttgattataaaaaaaaaaagtctgatattgtttacattatagaactctgccaaaggcagttctcttctttaattcattacctcctcgaggctctgggcacagtatcccaggtatcaagaagtacttgttcccttgccgttggagactcaagcacctcaccctgagacaggggcctcggaaagaaagacctgaatggtgtggaggaaagagccctgagctgggagacaaggtccctccagctactgctccaaccctgacttgctgtgtgcctttgatcaagctgtctctgggctttagcctccccctttgtaaaacgggcggggaagaggttgagatggcatgggtgcctccagctctctcagcatgattctgagaactctgcgggtagctctggcctgcccctttccacgccctaccgcgatgtgcgcacaacagtattgtgacccttgtggtgtactgtagattttacctagttttgtttcccgtcaaacacataaagaaaaagtaatctttcccaccccgcccccactaaaataataatcatgagaatgaatacacagggaggaagactggaaaaaatgaaagggaaggacttgctccctcaaaaggaaggatctcagtttgaagtaatgtagtggctgttgcacagggttagacgtatctcgccgaaaggctgggcttgtctcccgatttgaccacaggcctgaaagagaggaaagcgaccatcattgtagccagaaccccgccagtgcagcatccatccagccacgtccagcctcccaatcccccagcctttgaaaggtctgagaacctgttcctggggcaccagcatgggactgggtgaatgacgtcagcacagcacccgtgctaaatgccttacttgcaccatctcatgtaatcctcacagcagccttaagggtgggcactgagattgagaagttaaacttgcccaaggtcacacatctaggaggtggctgagccaggatctaaaccgagttagtctagcttcctggagcccctgtcaaggtctccacagaggtgtgagagtgagactgataaccaaagtcattagctgacctgattctcagccccggaggatgacagggagagaggaggatgtgagcaaatcaccaccatcagccaaatgatgttacgctaaaaacgtgttaattcagcaccaggctagcaccttgtaaacatgctaattcatcatgagcgtcatgtctgcactctcagccctctaaaacctctctgttgaagctgagcggcccaccatcatcactgagtatattaactcgggtgttggaatttcccaggtgtgtttaatctgtatagctttgtattttaaggcagaactttattctcagttattcatctcaaaatgagagttttcagaaaagatcgagaaaagggatggtccttctgcaaaagttccaaagtgcaccctgaataataaaaatgctaaaaactggccgggtgcggtagctcacgcctataatcccagcactttgggaggccaaggcgggcggatcacgaggtcaggagatcgagaccatcctggctaacacggtgaaaccccgtctctactaaaaatacaaaaaattagccgggtgttgtggcgggtgcctgtagtcccagctacttgggaggttgaggcaggagaatggcgtgaacccgggaggcggagcttgcagtgagccgagatcgcaccactgcactcaagcctgggcgacatagcgagactccgtctcaaaaaaaaaaaaaaaaaaaaagaaaagaaaagaaaagaaaagctaaaaacttccccccccactttttttttttttttttgtgagatggaatcttgctctgttacccaggctggagtgcagtggtacgatctcagctcactgcaacctccgcctcccacgttcaagcgattctcctgcctcagcctcctgagtagcccggattataggcatgcaccacaatacccggctcattttcaaagtctttatccccttggtatatcacctgtaacatatgcattggaaatccattgcatttccattgctaaaaacaacaatgtgtaaagtcctgaacttggattccctcagaaaaatgtaaaggagtataaaatgcaaactccaggtataaaatgtaaaatatttcatctactgaaaagaactggtgtacacagtcggttatccttaacacttcagcctgcagccatggggaaggtgtctgagctttggatggaagttgcagctcccgggcagtatgaccttggacaaatcactaaatgttctaagcctcagtttccttatctgtaaaatgcaggtaatcatgactactttaaaagttgtcataaaacttaaaattaaaaaaaatctataaagcaagtaacgtgcgttgtaggctttcatcaaatggttattactattgataatctgagtttaatgtgcctttgccactttactaatccctgagccatgagatggcacaaagttgctgtgaggattaagagagatggggagtattacccctatcacagtgcctgactagagcaggcacttgttagatgctaccacagggatgcctcagccaacgggtggagagaggtttttaacagagagggagagagagagagagtgtgtgtgtgtgtgtgtgtgtgtgtgtgatcatgggctgaaactggatgaggcagtcacttgagctgccagatagccaattgtccctgcatctcgttccccttttttctactccagtccttggcagcaaaccaaggtcctacatgacacagagaagttagcaaccaaagccattattattttggttcagctgataaaagattggctctccctcaaaaaactagaccagccaagtaggaaaaaaaattgttttcttaagaaaacaacaaaacccagatggaataatcagaataaagaggaggtcaggtcctacgaggagctaggataaattgggggaatccctcaggttttttttttttttttttggaagtgccaggtcaaataagatggagatttactggagtcacactgctgttggcacccgcctaacccgggcctcctttttctcaaagacacaggccagatgccagccttggcctctctttgctcaggaactggctgactccctgccccaggatttcacggccatgacctctctctgggaaaagttcccactatttgctgctggggaaaccaggaccccaccccagggctggccaaggtgagcaggctgagttcaaaagagactcaccggggacatttgcaaacacgtcttcggttccctggataaggaaaaagaagggaaaaagtgagtgcccctatccatcaatagtccccaaagacagtgtattttttgttgttgctgttgttgttgctgctgttttttggttttacaaaaaatcatttcagaacgatcatgggctgaaattggatgaggcaaatagggaattgcctctacgaattctccttcctttcccctatttctttgaggattataactcttgagagccgggtaagggcttcttatccatccttcgtctcaagcatcaattaaaaaaaattgcaactacagacgcgggcgaaagcggggagcctgcagacctgatccggcacctctcttgcatgggacccaaagcagggtgggcggttcgccgaagagggccaaggacgaacctcaaactgatggtggttttgactaaccctcctgggcacttgactcggccacagcggccccctcccggcgggcgtttgtcatgtgtccagacatgtgcgcgcgcgctgcgggcttcgtcgacggaacacacccgctgcagcggctctgggaacgcggctttgtctcccaaaacctctccgagagcgcaaggagcgggaagggctttctcgcattctatctcccagaaagaagtgcctgtacctgcggggcagctcgggagtcccagaaaactcaaccccaagctcccccctcgcaaggtccgcctggagctagcagagccaagggcaggagcggggccgactccttcccgccgcgattcctcgggacttactgtggttgcagtaaagggtgataaccagtgacaggagaaggaccccacaagtcccggccaagggcgcccagatgtagatatcacaggcgaagtccagccccctcgtgtgcactgacgacaccaaagacgccgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggcctcgcgcacctttccccacggggacgcctccccccggttttcctgggagaagggatagcagaggagacaggatggggaccccgggatgcgcgcggacccctgtgctcgggcctcggctcagcccagcgcacccggcgcccagagccggagcgcaggagccagctcccctgcacctggcctctctcccgggctgaaccagcaaccctggagcgcgggttgattgctgtccgcattttacccacgagcaaacggaggcgcagataatttaagtcatttgcccagaatcacacaagaatccgaactcgagtccagatcggccggacgtaaaaagccatccccagtccctactcagcctcgcgttagcctcagtttgctgtgtctgtgaaatgggaacagtatctaagtcgcttccaggtgcgctaagaggcttgaaagcagggcccaggtgtggaaaacaggttgaggtgaaccccaagccccacgcggagaggtgccgcaacccggcgcgcggacctggcaggaagaccggcacgaagtggctgaagtacatgatggagttgctcagggccgagcagaaatagtagccctcgttctctcggcggaagtcgctcagggtgaggacgaaggtgtcccccaacctcttgcccgagaaccgctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatgaggaaaagggcttggaaatagtccttggaaatggttgtcttgtgagagtgacagagtgggtgaagggagaccaaagatttcaagaagtgagggcgagagtaggcagcaaaggaggggagtgtcccttcctttgccttcactaaaggcgtctcttgtactgtcaccttgggactttttattggcaaaatgggcactgagggctgaaaaggaagaggaactagcgacctgcccgcttctgaggaactcgctagagcagccccagttttcaccgaggaaggaccctctcccttcccccaggagatttccatgagagcggcagcagccgaagctttgggtgtcggtgtcagtgcgctgctgacctcattcttccggcctttcatccagcggctaaactcaccacacagcctcatctcttcttggagccattgcaacagccttcaattcacaccagtctctctcctgatcagtcctccagccacgttgttataaaaattattattctcacaaaggggatctgacagcgtcactgctgcagcctcccatggcctgcattgctggatggaaattcaacccccagcttggttgaccagcccttgggtgct

SEQ ID NO: 1620 - DNA, 7110 bp, Homo sapiens; identical to SEQ ID NO: 1619
  source 1..7110: mol_type = genomic DNA

SEQ ID NO: 1621 - DNA, 7110 bp, Homo sapiens; identical to SEQ ID NO: 1619
  source 1..7110: mol_type = genomic DNA

SEQ ID NO: 1622 - DNA, 14158 bp, Homo sapiens
  source 1..14158: mol_type = genomic DNA
cctccgggcccgggtcggcgcgcccagcctgccagccgcgctgctgctgctcctcctgctgtgggaccgctgaccgcgcggctgctccgctctccccgctccaagcgccgatctgggcacccgccaccagcatggacgctcgccgcgtgccggtgagggctgggcgggcgaacccgaggggcgggcgcggtgggtgctggacgcaggcgggcgcgggccgaccctctccaactccgcagcctagcgctgccttaactggtggcctgcctaggcgttgcccgcttgggcaagcccctgattttgtgcacctgggataactgagggccatggggacgttcctgcgtggcgtgcgcacccgaagtgcgggcggcgtggagacttgagtcgtttgcaggatggctagcagcgctggaaagccctaggcacgtgcgtccgccaaaggccggacagcggccgggagcgctggccggtcccgattttgcctgccaggcagagccagcctgcctgccccctgggaggttgtcccgcagcggcccagccctttcccgcacacaactcggagccagtgcgtggctcgccgcgtctatacccgcgctcagtgggtggcccttgggcgcgcaccccgcccggcaagagacgcgtccgcttctaaccgctgagggccagcgcgtctgaggtttaaggtcttgcgaaccggtctcctagaacttgggctgcgcacgcagtgtgaagcgaccgtagtcccgggcggtggttaagtgcatttaaagggcttggtgggtcaaagcgttcgccgaccatttgctcgtttcctacttcctccaccccaacccccaaccccccaccccccaccccccagccttactcttagctgcaggacgttgctctgagtggaacgttactttttgctctaacggaagccagaacgtagggtcgggctcctggagagggtagaagagtgggggttgggtgaaacggaagacaatgacatgtttaaaataaatatcaggggttagggaccctcgcgggggtgggtgcgatggggcgtggtttcagagctgagtcgccgccccggtggagctgggcattggctttccggatgaagaaaaccatgtgtagctggtcttggaacctgacatgcctgagttcaaatctgagccaccatgggacttgagtaatccatttcgctttcctgagcctcagtttcctcattggctaagtgagaataacgatagcacctttgttgcaaagaattaaacctgacgtgaaagtgtacttaacatagtgcctggcacgaaaaacgcctactataaatggtattagttattacttacctgccaaagaagttcatctccgtcttgactatttgccttgctgcttttttgtggcttttcctccaaagatacgtttgcctggtaaataactcttggcttgtgctgacttgttaaagctcagcctgtatttctcggacagcttccaatagaatgccgcctttgaggctgtctggggcctctgactgcttgcaggtagattgatgagtaaagggtggtaattcctgcagtaatgcgatgaacactgctgcttaagaagatggcagacttgagttctccttcctgcccctgtgatcttgcagtctattacaccttcctggggccttgaatatcctcatctggaaaatgggatctgagatccttttcagctcccaacattcattgtgtcccaggctggagtgcagtggcacagtcacggctcactgcagcctaccgggctcaagcagtcttcccacctcagcctcccaagtaactgggattacatgtacgcaccgccacatccggctgatttttgtgtttttagtagagacggggtttcaccatattccccacgctggtctcgaactcgtgggctcaagtgatcctcccaccttggcttcccaaagcgctgagattacaggtgtgagccacccccctacacatacacctaacctttatatttagtagctctaccttttacacgttgtcctgccttgttaagagggcaaaagacaaaaacttcctaagatgattgaacggagtttacttaggggtatagggatgttgggagtgccatcatcatgaaaataactttatctgcaagagactgaaatgcgtaatgttaggccaagaaggagggcaagaatgttctggtcacctgacatcttacatcttagcatattttgtagaatctataccagagcttgccctttcaaagttttcagtgtaaggaatcacttctgctattccatggccccatttaaggaataaaaacacaggacctaatgcaacacttaggaaatctcgttaaatattaagaaatgacaaaccactatcctttttttatacaagatagatgccaattacattttctgagagcagtgccaggctgttcagtatttatgaatgaatgaagcatttctatgtaagtaatttgcactttataaaaggacttttaaaaacttaagtcttgtatagcaaagggacagcaacaagaactgaatgacagcctcaagtaatagagtgctaaaatggaatccggtatcccacctgcatttggagtgctatttgatctttaacttggctccttgtaccatttgttgaagcgtttgatgtatttgctttgtaaggacttctgtggaaatcacgatagccctcttgattggaaaggggcctgcttggaagcctgccatcttgaagtagaggtcctgcccagtttttgtagtttgtgaaattagcatcacagtacatagcccaaagcttacataaaaatacctcattagcttgattttggctgagggagaaaaatctttctccccttttgtacttttgaaatttccttttagaagtacagtttaatttttttaaaaaaacaggttggattttaggagtttagcattaaaatctcctgtggggctcagtataatgctaagagctaaagattaggggctcataaaggtgggttgagaggtagctctacagatgtttgaataaattgataaatgtctttacaattttcctgcaaagggatcccttcttagaatttgacctggttttggccgggcgcggtggctcacgcctgtaatcccagcactttgggaggccgaggcaggcagatcacgaggtcaggagattgagaccattctggctaacacggtgaaaccccgtctctactaaaaatacaaaaaattaaccgggcgtggtggcgggcgcctgtaatcccagctactctggaggctgaggcaggagaatggcgtgaatccatgaggcggagcttgcagtgagccgagatcgcgccactgcactccagcctgggcgacacagcgagactccgtctcaaaaaaaaaaaaaaaaagaatttgacctggttttaaagatttttgggtccagatacagtagctaatgcctgtaatccaagccctttgggaggctccggtgggaggatcacttgagcccaggagtttgagaccaacctgggcaacatagcaagaccccatctctaaaaagaaataaaataagttagctgggcatggtggcacatgcatgtagtcctgtctactcaggaggctgaggcaggaggcttgcttgagctcaggagttccaggttgtagtaagctatgatctcagcactgcactttagcctggaagacagagcgagatcctgcttcttacaaaaaaaagaaagaaaaaattttttgtagcagttaacaaacttccttttctatgtagggtatgataaatggacatatctactctgtgctgtttgaacctactaaactaaaaaaaaatgatgtctttagttaaataaagtaagcatcacgcttaataggattgctatttccatttgcagcagaaagatctcagagtaaagaagaacttaaagaaattcagatatgtgaagttgatttccatggaaacctcgtcatcctctgatgacagttgtgacagctttgcttctgataattttgcaaacacggtaagtgctgcctgagaataaacagaattgagtctgcagtgctcaaaatgccccagatgctttgtgcgtgattaaaactgcttgctttttgcctacatttctatacagccgttatgaaaatacagtatgcactataatttcatttcactttttgctgtggttctaggtagtaattgttggaggtagattagctacttattctatccttttgaaatgtcgcctaacctaacatgcatgatgatttgccataacaactcagaaatcatttgtaaacctctgaaccatttttctttgtaacaaaagctgttctcttgtagtgcacttgtaaatgtgatttgctctctgcacggtttatggaaaattggttcttgaaaaagaaaaaaaatgcacaaccgcatttatttatttattttacagaaacctaaattcaggtcagatatcagtgaagaactggcaaatgttttttatgaggactctgataatgaatctttctgcggcttttcagaaagtgaggtgcaagatgtattagaccattgtggatttttacagaaaccaaggccagatgtcactaacgaactggccggtatttttcatgccgactctgacgatgaatcattttgcggtttctcagagagtgagatacaagatggaatggtgagttcgagaatttcaccagtttcaagaagtaagatacatttagaggcatgacatatttttagaaatttttttcttgtgattttgattttagtcatgccagcagactttgttgaccttttaaaaatttttagtgttttcttcatgtcttaaagcagtgtttactaatgtagtcggacttacaaatcatgaacattttgtaggctctgaaaatttggaaactggtaagataaaattggccaatctccagattttcgtttccacaaaaatccagcctaatcaggaagcacactagttctaaatattatctacatttgcatttaagttcaagtgcccagcctagtgcctgtcatagagcagacctttgataaatgttggtctcatagtagatctgtggctgcatcttgaaaacctgtgataacttacgtgcaggagctccattgcagataatgacattgagggcccttcctgctgctacttttgctccttggttggcttttcctatgcacgctaccttcctttaactgccgctgccactgttgtgctgtgcctcggtcccactcttctgagcatactgcttaattctgcacacattttcctgttccaaagactttcttgacaaaggaagcagtgcattcactgataatcaagtgcatgctcttcaactcactggtctgacatggatccactgcctgaggttcatggtttgagtaacattgatagaagtggcagtgcctggccaaggagtgttttggtccaaatcagtgcatactggagtttgttgcagggggtccagtctgcagatctggatgcgacacaaacattgtcaatagcctgaataatttctgggcagtgtttcagttctttgaagatactgtcatgattaataaaatgccaattcattataattgttaggaactcatgaaaggtttttgttgttttgtactctctcaatccatggacactaaaagtacaaaaagctgtttgtgggcatgtaagacttttgagacagggtcttgcactgtcaaccaggctggagtgcactggtgtgatcatggctcactgcagcctccacctcctgggcttaagcgattctccctcagcctacccagtagctgagactacaggcgtgtaccaccatgcctgggaacttttaaaaattttttatagagatgtgggctcactttgttgctcaggctggtctcgaactcctaggcccaagcaatcctcccgtctcggcctccaaaagtgctgggattacagccaagagccaccttgctggccttgataaatattttaatgttaaaactgagtctttatgggtgaaattctgggatttatgggtgatttttttcttctctctctctttttttttaacctgcaaccattaccatagtcaattttggaataactttatgaccccaaaaaatgactctgtacccattaacagtcactccctattctttcccaacacccccagctcctggcaaccatcagtctgctttctgtcgtcatagattagcccgttgtggatatttcataaaaattgaatcatgatatgtggtcttttgtgactggcttctttcacttaggataatgatgtcaaggtttatttatgttgtggcatgtgttagttcttcattttattgcagaatattctgttgtgtgaatcagccacatttgatttacccattcatcagttgatggataagtgggttgtttgcacttttttggctattatgaataatgctactgtgaacattcatgtacaagtttttgtgtagtttttgtgtatactcttaggtatatacataggaatagaattgtgggtcatgtagtaactgtttaaccttttgagaaatagacaaagtggctacaccagtttacattcctaccagcagtgtgtgagggttacagtttctccaaatttttgctaatacttttttttattttccttttgctttttttttttttttttgagacagagtctcactctgtcacccaggctggcgtacagtggcataattttggctcaccacaacctccgcctcctgggttcaagcgattcttgtgtctcagcatctgagtagctgggactacaggcatgtgccaccacacctggctaattttttatatttttagtagagacggggttttgccatcttggccagactggtctcgaactcctgacctcaggtgatctgcccatctcagcctcccaaagagctgggattacagatgtgagccaccatacccagccttcttttgctttttagctctactatgaagtggtgtctcactatgttttgtgtttttttttatttttatttttcggagacggagtcttgctctgtagcccaggctggagtgcagtggtgtggtctcagtgatctctgctcactgcaacctccgcttcctgggttcaagcgattctcttgcctcagcctcccaagtagctgggattacaggcgtgtgccactgtgcctggctaatttttgtatttttagtagaaacgggatttcaccatgttggccagactggtgtcaaactcctgacgtcaggtgatccgcctgccccggccttccaaagtgctgggattataggcatgagctaccgcacccagccttgcattgtgattttgatttacattaccctatggctaatttggataaatttttaatgatgaaaacctatattacttttggaatctggaaatattttcattttgaacttctaaaagtagattagagaagtacctagagaagtcaaatgtatagacagaaaataggatgatggttgccaggggcggagggaaagagggaatgaggaattactgtttaatgggtatggatggagttttagttggagaagatgaaaacattctggagatggatggtggtgatggctgcacaacaatgtgcatgtatttaatgccattgacttgtatacttagaaatggttaaaatgataaatcttatgtatattatattatatattttttaaagtagagaattgagatctgttaatataatttaatattgccataaacattgaagccatatttataggggaacacatttttttccctttttttttttttcaagacagggtctggctctgtaacccagccctggcatacagtggcacgaacacggctcactgagcctctgccccctgggctcaagccatccacccacctcagccttccaagtagctgggaccacaggcatgcgccaccatgcccagctaatttttgtatttttttttgcagagacggggtttcaccatgttgcccaggctggtctcgaactcctaggctcaagtgattcacccgcctcagcctcccaaagtgctgggattacagatgtgagccactgcacccagccaggagaacacatttgttcttgtcagaattcttttaaaatacataaagatctgtttctaaagaaatgaaaagcaggtggtaggaattttaacattttaaaaaaaggctcagaaccacaggcctagggactatgaaaatagcttataacagtgtggtccagatgggctacatggaattaaactgcactctgttgatgtactctttgtggttcctgattttgttacccagaggtatcaatgttcagttaaaattcatttcatacaagtgtctcattgaaaagggactttgtagttatactgatgcagcttgtctgctgatcaagtcctaatgactcaattgttgtgattagaggctgcagtcagttcgggaaggctgtaggacccgcagccagtgcaggcactctggacctctcagggtggcgatgaagtttccagcgcggagtaccaggggagcaaccaacaaaaaagcagagtcccgccagccctcagagaattctgtgactgattccaactccgattcagaagatgaaagtggaatgaattttttggagaaaagggctttaaatataaagcaaaacaaagcaatggtaggtatctgactttgtgttagaattaatttttcctctctaagcgactcattacttaaatctgttccatcacgcaaaagttatttttttctgttacatgaataaaaagttatttttgtttacctgtgaagtcttcaatgtgtgcctcaaaatgtgtttctttccctgaactactttttttaaatctgttaaaggcctggttaagtgtataggggaaatcagaaactctgaatgtgtcagcttactatcaaatataaaaccatgagatgtacttgagtattttccagaagttagttgctcattttcgacagttattctaagccaatgatatcagtttaatttcctccctttttagcttgcaaaactcatgtctgaattagaaagcttccctggctcgttccgtggaagacatcccctcccaggctccgactcagtaagtaccagttcttgtttatatacagtagtgttttgggcacacctaaggtcgatctgtgttgtatttaaaaatctaatttctttatttgtgtggccttctagacaaacgaaggggacctagaggaaaccccctgacagatctctggatgatcctccttgaatcctgggcagtttggtctctccttgctgtgctcctgtggcactaaactccttttgattggttctttctttccttcccagctagactaagcccctcatgggcaggtaatgaagattgaaaacttttttctgttctccagtgtgagcacattcctcctacatggtagatgtgcaatagatgtttttaaaattggagaatgaaaataaaagaagaaaatcacaatttcttatcaagttgtagcttggtatcatacacaattgcattctgaggaattaaggtggtacaacttagggagatttggtgtgtctgctgtgatagaaaagatttctttttcctggctttccctgaggaaaggaaagatggaaagagggaagccatacagatatccctctattttgcagtgtagaaactgaatgtgtttctacagggtcaagagacatcagagaaaatttttttttttagaacagaagatcatttcttacatcttcattaagtaaaagaataaatagctcatctctcaagttgaaagaaactgggcttggtattacaaaagcaaaattaagatggccatataggttttaggctcattttgccatgcattatgcaaaggacaaagaaaaagaaaaaatagagctctctttacttaaaacatccttaaggagaagctatgaattccccaaagtactacttctctttattatggaataaatggattcccttatacgtgctttgtttagcaatcaaggagaccgcgaaggcgtacattcccgggtgttgcttccaggagaaaccctgaacggagagctcgtcctcttaccaggtcaaggtcccggatcctcgggtcccttgacgctctacccatggaggaggaggaggaagaggataagtacatgttggtgagaaagaggaagaccgtggatggctacatgaatgtgagttctccgcattggtacttgctcttctgattctcatcttcggtaggcctggcatcatacacagcacaggtacacgcacatccttaacaccaggcgatccatagtaaatgttttcctctaaccattcagaactgtaaacgtcacataagcttacttggtaattttattagcaggcgagaattgggttttcttcatctcttcttaattgtaggcatcgtttccaaaatgtccagttaggctacagtaagcgtatggcctgttcccctaccataagctctaggagagatttccaggttgaagtttgtgtgaagaaattacaagtcaagtatctgagattcaaagctggggagagccagttttgaatctctgtgtttcatatttgaatctgttttttcagttttgaatctctttcagtttttcagttttgaagttctgtgttttgtattccttgtaatgcaggaagatgacctgcccagaagccgtcgctccagatcatccgtgacccttccgcatataattcgcccagtggaagaaattacagaggaggagttggagaacgtctgcagcaattctcgagagaagatatataaccgttcactggtgagagcctctaaattacacctgagaatgtaaacatctgtgagaggaagagagcttctgtccctaagcgttgcccaggttctaaagggcctagcatgtgaaatctgtacctatatgtttttttcacacaaggaaggaaaagttttacagtatccctgggatttagccctctttcacagtggaattatctgcttagtaagtctgtagtcatggtaaatcttttctcctaatttagaaatcaattcattcaacatatatttactgcatatctattatgtgtgtatacatagctaggtgctggagtgtggtggtacaccaaagataaaagtggatttgggtaggttattttttaataagaccttttcttaaagggaaagcggttttaccacaccaggctaatttttatatttttagtggagatggggttttgccatattgcccaggctggtcttgaactccttggctcaagcgatccactctcctcagtctcccggaatgctggggttacaggtgtgagccactgcacctggttgagttatttttcataccctggcatatacatgtgtatgtagagattcatagacaaaatgtaagcctatactacgaagagggacattctgtaaatatgccatttcctctgttgaaaaacagtggttttttttgttttttttcttaatggcttatttgtagggctctacttgtcatcaatgccgtcagaagactattgataccaaaacaaactgcagaaacccagactgctggggcgttcgaggccagttctgtggcccctgccttcgaaaccgttatggtgaagaggtcagggatgctctgctggatccggtaggtgcctgccaggggttggtcctgtgggcttgaaggtcagccacaaactgtgatgaggccagaaaaaggcattggtgaaggggtggagccctttctgttatggggtgctcttctttttttttaagatggagtctcattctgtcgccaggctgcagtgcagtggcgcgatctcagctcactgcaacctcctcctcctgggttcaagcgattctcctgcctcagcctcccaagtagctgggactacaggcacgcgccaccacacctagctaatttttgtatttttagtagagacggggtttcaccacattggccaggatggtgtggtggtacaagatctcttgacctcgtgatccacccgcctcggcctcctgaagtgctgggattacaggtgtgagccaccacgcccggcccagggtgctcttaattcagaacacaaatgaattcagagggatggtgctgcataggcatgagccgcttctacgatactcgggtctgaactgtccctgggaagttgctgctccatttatccctggtagctgcttgtaacttccactcctggaaggaagcattaggcattaggaaacattaggcatgactaatgcctattaatcatataaatttttaaccataaagaaggggttaaatgtaatgtagataagttggtgggggaggtaaggtttaacttaattgtgccgtttgacaatcctccttcagaactggcattgcccgccttgtcgaggaatctgcaactgcagtttctgccggcagcgagatggacggtgtgcgactggggtccttgtgtatttagccaaatatcatggctttgggaatgtgcatgcctacttgaaaaggtagtgggtgtttttttttcccttccacatctgaattttatattcatttatgtcttaatgagaagatgatagatgtcagaagagtggttatctctggcggggtggagactgactggaacggggcacactggaagggatgggaacattttctgtcttcacttaggtggtggtaacccgggtgggtgggtgtgtatgaaaaagtcaggtaatatacttgaagatgcgcacacttgaccatagtgatgttataactcaataaaaatggttttaaaaatgaattaggctttcaaaagagaattctttggttgaaaactatgtcctgacacatttccttttgtttttcacagcctgaaacaggaatttgaaatgcaagcataatatctggaaaatttgctgcctgccttctacttctcaaatctttcttgtaaaagtttccaattttttcactgaaacctgagttaaaaatcttgatgatcagcctgtttcataagaaactccaatcaagttaatcttagcagacatgtgtttctggagcatcacagaaggtatattgctagttacactttgccctcctgcagtttcttctctgctcccaacccccatctcacagcatccccctctatttccaatgctcctctccaaccgcttagtttctgaatttcttttaaattacagttttatgaaagcatattttatttacttggtgttgaaatagccctcataaaacctaagcacttggaaacacaataatagtattaactaactagatctattgaatttcagagaagagccttctaacttgtttacacaaaaacgagtatgatttagcattcatactagttgaaatttttaatagaatcaaggcacaaaagtcttaaaaccatgtggaaaaattaggtaattattgcagattgatgtctctcaatcccatgtattgcgcttatgttacaagttgttgtcacagttgagacttaatttctcctaatttcttctgcccgaagggtaagtggtgcgtccagcttacacaatcataattcaaaggttggtgggcaatgtaatacttaattaaaataatgatggaagagctatctggagattatgagtaagctgatttgaattttcagtataaaactttagtataattgtagtttgcaaagtttatttcagttcacatgtaaggtattgcaaataaattcttggacaattttgtatggaaacttgatattaaaaactagtctgtggttctttgcagtttcttgtaaatttataaaccaggcacaaggttcaagtttagattttaagcacttttataacaatgataagtgcctttttggagatgtaacttttagcagtttgttaacctgacatctctgccagtctagtttctgggcaggtttcctgtgtcagtattccccctcctctttgcattaatcaaggtatttggtagaggtggaatctaagtgtttgtatgtccaatttacttgcatatgtaaaccattgctgtgccattcaatgtttgatgcataattggaccttgaatcgataagtgtaaatacagcttttgatctgtaatgcttttatacaaaagtttattttaataataaaatgtttgttctaacttgtctgcttttttaaaaataatcttactgtacttaattctaattttttcctcatatttaaataaaaggccatttccaccttttc

SEQ ID NO: 1623 - DNA, 14158 bp, Homo sapiens; identical to SEQ ID NO: 1622
  source 1..14158: mol_type = genomic DNA

SEQ ID NO: 1624 - DNA, 2108 bp, Homo sapiens
  source 1..2108: mol_type = genomic DNA
tcccaatcccggggcggccgggcgggggtgggcagggggcgtgaggccgcccctgcgtcccgggggccccccgaaaacgcgctccgggtgcccggtccctccgctgcgccctgccgccgtcctcccgggggtctcgggcggccgcggccgtgtccttcgcgtcccggcggcgcggcgggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgccacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggccgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcgcgcgtccccctgccggccggggctgagactccggggagcgcccgcgcccgcgccctcgcccccgcccccggcggcgccggcaaaactttggcactggggcacttggcagcgcggggagcccgtcggtaattttaatattttattatatatatatatctatatttttgtccaaaccaaccgcacatgcagatggggctcccgcccgtggtgttatttaaagaagaaacgtctatgtgtacagatgaatgataaactctctgcttctccctctgcccctctccaggcgccggcgggcgggccggtttcgaagttgatgcaatcggtttaaacatggctgaacgcgtgtgtacacgggactgacgcaacccacgtgtaactgtcagccgggccctgagtaatcgcttaaagatgttcctacgggcttgttgctgttgatgttttgttttgttttgttttttggtctttttttgtattataaaaaataatctatttctatgagaaaagaggcgtctgtatattttgggaatcttttccgtttcaagcattaagaacacttttaataaacttttttttgagaatggttacaaagccttttgggggcagtaa

SEQ ID NO: 1625 - DNA, 189263 bp, Homo sapiens
  source 1..189263: mol_type = genomic DNA
gcggcggcggcggcggcggcggcggcagcggcggcggcggcggcggcgcgggggttgagtcgtggtggtgcggacgcgctcgtgctcgggaactatcggattaaacttgaatcgagtgaaattacacaaaggagcgccgcggaggaggcggcccggggacccggacaccctgaaactcaccagagacccgttcgcccccggccaactccgtgcccgtggattcagccccctggccgcagctgccgagccaactccggagcccgctctgcgttttgttttcccctcggcactaggcagcggaggagcccgaccgacccggtgagcgcgagagttcgcccggcgcccccgggaggggcggcggcggcggcggcggcaggaaatcgctccgggccggggccggggccgcgctaggagttgggagcgaggagttgggcgtgtgcggggcgaggggcgaggggcgagggcgggagggggccggggccagcgcaggagcgcagcgccgcccgcgtagtgtcgccggcgtcgccgcccgcggggcccgaacccgcgccccgagcgccgcccggcgccccaacttttgcctgcgtccgccgggccggcggcggcgggggcgcgcggtgcggccgagggtcacttcctcgcatgtaaatggctttttgttgtgctgccggcgtggggggggggtacgggggacaggagggagcgtgtctgcgcgcgggggagcgcgagcgcgtttcctcccgccggcgccgagcacgagttgccggctccattcgagagaaaaaggaaggaggaaaagttgggctccaactcaagtgcgagcgggcgatgggcgcgcgggcgcggggcggctgagcagcggcggcggcggctcggggacggcggcgacccccgcctcccgcccccgccccccgctccggaccgaccacgccgcgctcgccgggagctgcggccgcaccggcgcgaacaaagtgcgttcctcccggcgcggcggcgccagcccgcgcggggaccgccaccgagcgaggtgggtcggcggcggggaaagtgcgcggggcgccgcgtggggcgggggcagcgcgaacacgcggcgcgggaggcgtcccgagctcagccagtgccggtcgcgggcgcggagttgcgagcccggagttgggggctcctggggctccccggcggctcccaagtgcgctaggaggagaagaaagggagcggggccggggcgagcgccgggaggcgcggcgaggaggggaccccaccttgtcgagctggccgggccgccggcggcggcagctgcataatagcgactttaaccttccaacgcaactcggctcccccgccccccaacccgccgggggtcagcgccggtggggggtggtcaccaggtggcccccgaggtgacccgggtgcgctctgccctcgcagagagccgcggcttggagcgtgaacggccgaggtggctggaggccaagcggtcagcggggagaggaaaggagggcggtgggggacgcgttgtttgtttggttcgcaccggggattgggctcgctgggggcgcggggctcgggcgggggcgcgggcaccggctgggctgcggtgcggggcgggcgcggcggcgcggggctgtcgaggtcgcggggggggggggcgggggcggcggcggcggcggctcccgggcgggggtgggggcgctggtcgggaggctctggggaaggagccgccggccccgagcagccatcattaccgagccgcctttctccggatggctctgcctcgaggagcccggagccgtgggagcgcaccccaaactcccggccggccgcccgctttgtgagcgcccccgtgaagcgagcggcgcggagagtgctcctgctatgggtcggactcttttcctggaggtcacttttagagactgctcacgccttggtttaaactagtttttttccccctcttctgaacagacaatggacaaaagaaaagtagcaacccacatggagagagtttccttttgaattgctagaattagatacactatccagcgctccacttgctaagtatactttttagtttcccattgtatattatctagcaatcgatttaaataacttatcttaaaaagtgtcccttttgggggcttaatttctggaatacattacatgtcttaatttatttttaaaggattttgtgaggccctgattttttattttctaaaaattttaatttaagccgtctttgcagtgggcgatacctttctaaggggttaagtgttatttcaccccagttctctctcggtaagggagggagtactcagtatacgtagtaatcgaagaggaaacaaaatacgtgtctttatttcttcactgatcttgtctgacgatgacaaaaaatatcttagtgactgtgaccttagcagcatggctacctgatttatcccagttataattatatttagattgcagtaatgtctaagtacaaggtaattcctatttcagaaataacttgagcagtgattttacgaagttgaatccttctcccagcccccagagtacatctgtcgcgcagtgtttttgtcttgctgttgcacaacagaagccctccagtctttaccctaaaatggcagctttcatttgactgaggcccattcattgacaatgataataaagaggctgaaagctagatgcttggggcatggagtaggacttggtttgcctttctaggtgataagtaggagacattttatgtcttccagtttgctcaggaaaagtttattttccctgaaaaatctgtcttgtagaaaaaagttatagtaaaataatttggaaatgggtaaaggcttgagcagcaaattttagaagctaaattttcttattttgcccaatagtggaaatatggcattctcttttttggtaatctgctgataaaaggacataatggatttttgtcaggcttgtaacaggtgaatttcctcatgctggtactcaagaattgggattgttttctagcactgtgggtttttttctctttatattttctaattttttctcctgttcgagtcactaaattgaaccatgatgaattgtatcctgggtctatgctttcgcgattgaaatgagttttcagataagaaatgaattataattttaaaagactggtatatgaattttaaattattatattcatttaatcaatggccttatttttaaattagtttttttaaaaagttactttcttttatatgtcttaacatggaaggcacaatacaggaatggtagagtggttgtaccggtgatgtttaaaaacccaaatattattttcctctttcaaggaaagaaataactttttttcccaagttgaaaatatggaagtcaaatttataacaacgtattcagtaacttagttttaaaatagtacttttatagattcaccagtatttggtctagtttttaatcagttcaacttacaggaacatttcctaaacttttttcataatgagccttctttctaggttagccttacttttattgagttaaaatgaataccatgaagagtacctttataatacagtaacatcaaggaaatgttacaaccgtttttcatacagatgcgaagtcaataatatgttatagtttttaagcagttaggtcaaaataacagaaatattttgttatgagaaaatacactgtaaatgcttctgtgtgcctgctgtgtaacccataaaagccatgtaagtgccaagttagtgtagttctttcaaacctaagattacagcattgtattccatatgcttgaaaaagtttgcttgccacacagtcaccatgcctttagttaactttgattcagcaaaccttggcaagccttccatggttaaaacaataaaaggcagtactttcctttagggagtgtaccatctaatagagagcagttctataggtaagcaaatattcacatttgacttttaagataaacttataagtaatagttatctttcatctttcattaactaaatacaaccttttgggtttgatagcagacaccatggccatcttagaaacatcgaatataaatgtggcattgcaagaataaaaatgtttagtcaggtctgagcaaatggctcttaaaacttcaactttgtaagacagtgattctttttcagtaaatgatttctacatgtaaaaagtaagcacatagtcacatagctaaaatcaccaaaaaggatggagaaggaacatcttaggtgatattaagatgatgtcagcaatatattggctctgtgggaccctttcaattgtcttgttcactcatgtgggcatatttgtgtatcttaaaaaaatctgttcttttcatgcgattggaaattcagaatttagcatttttctagacaggtttccaaaaccattatggtttcattagttcaggagatactattttcccctttctctataaaactttattatttagtctttaaaaaaattgttgacattcaaaggtgactaatgttaaaatataaaagaaattgagatcaataatcgcttggtttttctacaaaaaatacaaagatggaatgatttatttcaatttgggtatcactcaggttgcagtgatggcagaggtccatagctgattatggtggttgttaagagctaggaaggtaatttaaaacatcatgactatgtgtccatattttacttttgtcaatagattaaaaattgtaaatgaaatcacatctgcatgataaaaagaagaaatagaaacaggaagttgtaatgatgttgtcaaataaaaattcattttatccttattagagaatgattggatatttagagtgtgaggaccttagagagctagttgaactttctcattttacagattaagaaactaaagtccagagagattaattaaatgaactgcctctgactggccacccactgttgcagagcttatctcagttacagttgtgttcctggtgcctagcatcgtgccagtgcaggaggggtgctggtcttgtctttgttggctctggaagagtacagctcttgctcatgttctgactcaaaggtacctttaggctttagaatcctacagcataggacaacataactcttaaagatgttcctaaaccaacaataatttgcttctgtttttggaggttttttttttttaactatgattatccatttaggaaaaatgcagagataattatttcaagatttgacaactgttttcactttagatgcatgtattgatcaccatagctagattcctgttgcattttaactaatgttaggtgactgactgcaaacatgattgttttttcagagaaggatttttttggggtttctgttctgcttttactttgaaaattagaaatgtctttttaaaagtaaaaaataacgtaggtatttatgaagaaacttaacttgtcagtaaaggctggttcactctcaggcttgtttacctatgctaatgtggaatctaaggcactttttaaagtgaccctttgagccttgcttcctctgtgcatgtcaggattggctttcacggccacagaatctggactgtgattagtcttcctgtttcatctgtggttttgctcattgattcggctgtttgttgggtacctgctacctgaaagatgcaatgctatgaattgtcaatatagtgatgacatgagaagacatggtaaactcacacaaaaactagagctactgtaaggtcataggtgtgatgcagtcggtgccaggaggagtgagagcttaggacttggggattccgtcagttgggtggggtattaccccttaggaagtggctttagcattaccatctgaatgatggtagaagaaggggtgagggcacttcaggcagtgcccctcacctgcagggaggctgtgtgtttgaggcattcaactgcaagatgagactcgaggcaggcagtatccaacttggtcagggctttcaggatatcaaatttgggatttttgaaaaaagcagtaggaaccactgatgagtgttaagcagcctttgacacgagcagagtagtgttttgaagaagattgaattggtgggtgcagagaggacaataggttgtagacaatatcctgcctgcttttgttgtggtctgtgggatggggaaatcacaatgatttggactagattggtggtggccatggggatggagagaaatggacagatttgagagatatttaacagtttcaacgaataggacttggggatagatgcgctctcaagagggagatctcagggcatataggtttctagcatgttccctgcttggctggttggctactgatcctattcacagaggcaagaatcagatctgctgaagatttgagaaggaagctcatgagttcttgtagcatatgactgaggtagctgataatggaccatgatgacattgttttatcctttgcattgctagtggcattccagaactttaaaaaaagtaatctgctagctttaaccaaaagatattggacgtggggagttcatcaaggaatgtgaatgggttcagtgaaatgggagaggggagggaagccttacttgctgaatacatagcactttgcttgttacttgcctgatacatagcactttgtaggagtttgctcattccaggttgagcgtagaatcctgtggtaaccagaccttggcacattttgttcttctgtatgtccccttacggaggctgctttctgttgctagtcacatattagggcaaggtctttgggttcccggcacgtgggtggcaggtcccccatgttctcggggctgcagtctccctcggagagagttgtattttagaagttggttgtagtcatacagaagcaaggaaggagtgaatacattatttaaataaatgtggagaagaataccaatgtttatcagaatacttacctggtttttagtggagtatgtataaaccagtttaataagtaaattaccttcaaagttactttgttcagttattatgaaaagtagattgtaaagcatggttgccggtggcagatgagcgatgctgttacacccagaaaagcttctgaattgctgactttaatattatataagaaaaattatgaaaatacaggacagtaattttggagcttttttagggaagtgtttgtatttttgtgtttgccagctaatatgggtgattgccagccaatatgggtgatagaactttttgttatagatcaaattttgttcttgtgtgcataaagataaccttcctgggactcagtgtctttaattaggggtctgtttcaaagatacttttattgtcattgtgtgttcctcatgggcctttctggtggccattgtgactcagtcaagtcttctgggttccttcctgtcttgtgttgtttgtagggacatgcttcatgtgaaagtttaccttcacctgcaatagttttgagtgattatttgaataagcttaaattcaggagaagtaatgtttccacgtgtggaatggcaggaaaacttggtgcactaacttcagcttcagatgggcttgtgccaactactctgtggcaatttatatctaatactatttcttcaacttgccagtttttcttaaaaaaaaaaaaaaaaaactctttaaaatacattctgtcattaggtccagccagcagtgtattcttagggtgtaagagatcatttctaagaggtgtagacatcgaatggaaaggcgcatgcaggcccctgtggatgtggctttaatggaagaatagaggggatgcttctttggggcctgccttctctcctggcatctgcagtggctgaggaggcagcagaggtcatgtggtggatttgagttttccaccatgtatttcatcaggatgaggttgggcaaatagccatctgctgctgagcagggaccgcgtgcgacctgggtttccacacccaccctttgtgtagggaaaggtgtgcaattagacacatgtgttaggttggacacatcacctcctttccctagtatcctcagtgtaaaacagtcagatttctataccatatttgcagtatgtctaaaaaagggtacatggcaccttactagttaattttctttctagttctgcagcaagtttggggaactactttaactttttagaggccactgtgtcctcttttcatcattttgaaagaaaccacaaacattttatttgttatccatttttgttttgtttcgttttcgagatggggtctcacaatactgtccaggctggattctaattcctgagctcaaaggcttttcctgcctcagcctcccaagtagctgggattactggcatgcaccactgtgccctgttatatcaacattttagaaatctgtctgttgatatttaaaacataattagcaaatgtgcatattatttcaacacacctaaaaactattaaacatctttaacataatactaagcagtcatagtgagaagtccctcgaagaattataagcatgcctttagtttccaaggcagtgcttgctagcatactaagtgaataataaaatcagtttgagcacaggaatatgataaaaaaaaaataccccagttggtgaagtattttgaagtgtatgagcctagcaattatttatggttagaactggcactatattgaaattgttgagcccatatccttaaataattttttaaaagtctctgttaaagtgttttatgttcttgtatacttggccttgtttgtgcttgaaattttgctttcattaatctcaagtgtaccgatcttgcaagaaaaatcatacatattcatcttgagaatttcaaaatcttgattaacagtgtaccccaccctgaagtatatgttgggccaatcaagtaaaatagtgcagaaataataaaacaatattaaaaataacagtaataaccataatgaccggctgttatttccagttgggtagttactcagctgagtgttgtcatggatcatttcatttcctcatcagagcaactctaggtaataggtagaactattatccccattttacagatgaggagactaaaagggatgagaagttaaattacccagggccatacatttctagcacgtggtggaggaggaatttgaatccagatgagctagactccacaatctgtgtacataagcatggtgctgctgttgccacgtagaccagctctggagcttgcattgttgccgtcttaatagacaaaggtgtgttaaaaatacccatgccatgctgtgatgctacctattgctgtgtcttaccagcccaggctatttttttctgtacttcctctgttggtgcctgctgtagttgtggggccatatgtcatgggatgtcttcgtacctaaaacgaccaggtccttgcctttcacacttaaggcccttctgctcacatggagatgaggagaagagttgttcttgtggaggttgccttctgaggcggctgagaatttgagttttgatgtcggacagatacgggtgtgaatcataaaaatggacataatacattctcctaactgcccagggttatggtgaaggttaagtgaggcactccagctaacatacttggtatagcatatggcatattcattgagtggttactatttttattagttcagtttaatcatggaacttatcaaatcatatgtattgcttttacttttgttttaaaaagtccctcaaaccataatcctacagatgactggacaagaatgagtggcctaaaatggtgactggctacacaattttcatttttcttcaggagaagacatttgaaaataacatctttatgtcctttgtccatcagtgcaaccagatgttatttgcctaattctcttgttgattatatagagttgattcagatatcccaggtactaaaagtgacaggtttgagggagtgcttatctcttgtcctgaagatgttcatctcctaccagagttatggctgtccttctagtgaaacagtcatttcttctttgtcccaaatctgcaattctccaaacatggtgggtgatgttatcctagatgatcagtggtgtaggcatgtttgatcagctctgggatattacggttttctgatttagaccagaggtcacagggtgttctcaaaatctataggagctccagatcctcaaatctcagaagctttgattcctcagtcccttcctcccaagttctctttaccatgtaaagaggagacaagatggtatctgaaatgggagtaggcttgggttggggtcagggatgtgagtagcaactagaacataagaaggttcttaggagagggaaggctctggggtagcctacttagaatctcactgctacccagattggcagggaaatggaagagatggagtatagacaattttcattttattctattctatttctttacttgaaaatgacttggaataacaaaataagtgagtcaaaaagtaaataactggtaacgtgtggatttatgggagatccttgtactattctaactttactgcaagtttgcaaatgtatcaatatcaaaagttttaaaagaacagtagctccaaggggttgatgtcagtagctaacatttatggagcataaagtttgtgtcagttagcattttgctaagctatttacatgaactatttctgctgaatcctaaagtaggattagtcaaaatgctgaggtaggaataataattgctattttacaggtgaagaggttgtttaataaatttgtctaagatcatagtttttaatgagtagtgttgggactcaaagcaggacaggctcatttaacagcctgtagcattaactgctctgcagaaattgctttggatagtcccatcaaaataacctaggtcttagaaggataggaacaacaaacatcatgatcttacacacctgcactttctagcaccagctcctggagaaaaatcgagaggctgaatggtgtctgttaacagattatagtcagtgaggcctctttcctcagatgttgtatcttatcaatggcagacattttcaacctgaaagacacatgctcattacaagacttagtagtgctctaaccctgttttcacttatcagtccaagacgtagccgacatcaaagtattcagcttattacagaattgacttcctcaaagtttctctcagtgtttatccaagatgtaattcacttagcatctttatctcgctgcacaggactagagttgccttcgaaaaaactcaggataccacttggctatagatcacagtacttgttcctcgtatttgcgttaacttgtgtgaatatgcagcctccgtgagatatttgcatactgcttctgtgaacacacaggacaacagactgtcttccgcagtcatacactcagtcatattctcaaataggtatacagttcaaatgtataaatcagtagtcttacatgttacagagtgggtggatgttcctttgccaggggattaaaaaaaaaaaaatcccaagtcttaatactgctttctcccacacgaatagtctatgatggtgtatttttggattttgtacatgtttatagtttttttcttttcacaattttgaataaactgttgactagcttgagtatggtaagcctctacttaaaatgtaaattttgctatttttggtgcatttaatattttaatatttgtcttgattgtgttaattttcagagctgtgtttatcaccagatttagtatgttaacttttcaatgttcccacttattaaaaaaaataaaaaaaataaacatctgggctggtgtatgaagcaaacctccagttttatagggaactttgtggctactctggggtgctgagagccttccatttagctgctaaaggccagcaggataaggaaaactgtcttatatgctgtcaaatacattaataaggacacaattcaaggacataagtaatttccccacactgtggagcacacaggtggtgatactgctgtagctgaattgctggctggcagtcagtgccactgccatagcaccacaattttcatttttgttgttgttttactgttgtctcggtatggtgaatggttgggctatgggagtggcacagaaacccaggccgtacctagcagaatggttgacagtcgccgactccctgtcattttctgcagctcagtattttcaggtcagggagctgcccatgtcatttgcatctttctttctttctttctttttgacggagtcctgctctgtctcacaggctggagtgcagtggcgtgatctcggctcactgcccacctccacctcctgggttcaagcaattcttgtgcctcagcctcctgagtagctgggattacaggtgtgtgccaccactcctggctaatttttatatttttagtagagatggggtttcgccatgttggccaggctggtctcgaactcctcacctcagctgatccacctcggcctcccacagtgctgggattacaggtgtctgtgcccagctgacattattctttatggatcactaccataataatatcaacaataatagtgtctttatttggcaaacctgtaacatgactctttacttctttataacactgcttcagcctgctattgatctagtgagtgatttgacttgtttcacctaatactaggcgagaggtaagaaaaacgagtctttttattcaaggcattaaagcattaattcatatatttatacagtttacttgtgcatcttttactctcctgatacactacttcgtgtaaggaacccccatcctccttttctcactgttttgagacaggtgcttagaaggtgcttgtccattatcctccaggcagaaaaagtaaagtcgtagttggtacttgagttgcatggggaggaggaaatgattgtctctgagcctgggcttctgcctcagtcctgcagctaatgttcttacccactcctcccttccacctcaccaggattaagaaggtacagagttgttttgcggaaataatgcatccattggtctttaaggaagattagaatagtgagctggaccgaggtaactttcttacctgttttctccaagaaactcgtaaagtgtgtttgttttagattattttaaagaccctgtggaatttgtaaaaagtttatctggtaagcttagaatgcctgaaaaaatagatatttattgggagttagaattagacagtcgcttagggtgcttgttaaaaatgcagattcctcaactccacacgagatttattgaattaaatctccctgggtcatctagaatctgaatttttatcaaggtgcttctgatgtactctgaaacttacgaagcaatgtggttagaccaatatgttatgcaatgaatgtactttggaaatacgaaaaatttagaaaatggcaaggaatatgcttgtccatcattcatattataagaattgcaaaaattcttacagtgtattttggaatattgcaagttatgttattctcttgcatgtaactgaatgaatgtggctgctgtttgacacactaattactataaaggtgaagatggatgactgattaagcgtttgaaaccatagtctttaaaggtggtgctaaaagggtagaagatagattgctttgtatttatttgttaaattttattttcatttctaccactgagtaattaaaagcttgttttgtatatagttctggtttaaatggtacatgtctgccaaactaatacatttgttaagctacagtaactattttggggcaaccatttcaagccagtgttatttccacgggcatataatacatttaaaatgagaatcatcttaaaaggtaatttagtgagtgggttagtgctttcttggaggacttgttagcataatttcgtgtaagacaggatgcttatatgaaaggcataaaggaagcacataaggcagcttttttcctggcccttcccccattcccctcccttttggatagaggccatactgaccacccctcttcctgacacttcaggttatcctggaccttggccgaaggcgtcattagggtcctgagctttcccttccatgctgcctcagttgcttattctttttcttcctaccccctcaatatagcctgttctcaggggtttgatcctggcatcctctgggtctagttcaggcccacagcaaccttatttgctactaactcctacgtctgtattcttatttctcgtatctcccccaaactcctatccttaatgttcccaatctgtttaaaccgaagtcatcataacaactccttcttcctgcaaaagcatgaaacaaaagtgtgaaacttcaagcccagccctttctcttgaacttaggctctgcactgcaagtctgcgctggtggtgtcaggtcctggcaacccagctgatgggctgctccagactccacttcctgtgtcctggcctgttggcatctttgttccctccactatgttgtgccctccgcgacacccccttggcggtcagagcgcagtcccaggcctgctaggtcattatggtcactgtcaacttgcacggttggggagagtacagcaaagacccatgttagggggaccctttccttgcttccttcctgctcccctgtggaacaagtccctgtctgtctgctgcaccctttagaccttgccaccccattgctcctgccgctcagccttccttggggcacctgcagagagagggtcccccctccagctctgctcctctggcagggcttgtggggtgccttccacaggcaagacctctgttgctgctgagccccaacagtttagtgtccaggctccctgtcttgggcagggcaaggttgccctgtgcctgtggcctgtccttccctggcctcctcagctatcgagcccctgctcagccctctcccagctggattagaatgtgggtgggaagaggaggtgagttattctggcctccccaaacccattaccacattcctgacatctgattggaacacattttcccatggtagctttattatggttaggcactggcgggacaccgtgggttagcctagtgcttttgtaggttaacacaacaatgtcaatagtataatgttatatccgagggaaagtgatccaactagcagctgaaggccttttggggaggagctgctttctcctgtgagcccccatggggaactgtcctgtagagtgtcatgccagcaccatggaaccatttggtggcacaagcatcagagcagtcacctgccttgccagtgggccctcaggtgggtttcagaaagctgggtctatccagactcataagcgtgaacttttacataaagaaccatgactgtggcaattctaagaaggactttaatgaatgcaaaggcatggccactaaagacaaggaaggaattcaataatgttttcagattgacatctctaaagagcgaatggcaatttcggtgtgaggcttataacagaatctttttggcttttggaaatgtagatgtgcctggtgaaaaatgttattaacttttttcaaagataaataagaaccatgagcaggcagatctttagtctgttgctactaacttgtcggtataactttaatgtttgtgaaggtgtgcagatgtgagattatggctttgctaagctctgtgggagatactaaaaatgttacttctagctaggtagagcaggttaacacacttatgaccctgtggaacaggatagcacagtctgtaattaagtgctaagaaggcgtgatgtgttgtagtcattgtatagtggagaaagaaatcagaaagcgtgacttgccctctcctttgataagttagaggaactgagtgataatgtgaaaaaaatcacggagaggctgtcagccaagggtcctggcagggagcaggtggccagcccagaacatcctgcaaggaccagggcaagagccctttgtctctggtgtcctcctgggagggcagctttgcaggagctatggcccccagggagagcaacacagccactgccaccccctgttgccctccccacctcaaccttcaattcaaggaccagtcttctgggactcagggaagatcagttagcctgccctgagggagaggggcagcaggttggatagatagggagaggttgagcagtggtgaaattggaagcttagactgagtgagattctgacttatattacgtgatggaaatggagttgaaaggttagtttggcagcatgtgatggattgcggttgaagagagactagaggcaaaaagtcagaggctgttgaaatagcccaaccaggaggtggtagagctttggctaggcggggaaaatggactgagagaggaaaagacacagccatggacattcagggtggggggaagagggactaggagcctggcatggagcggagaatagcttagaaagcctcctttcgagagaagtaaggttgacatttggaacttagatttgatccaaaatagaaaacatttgagcagggagaggtgtaaaaagatcaccttagaaaggtttagaaataaagctactccattgataaaggtctgcaacttacagttcaagaaaataggtatctaacatttaaaaacaagttttaaaataaacttcttataaaaatgattttggaacatataatttgacattgtttttataaatatccttataacattgggtacagtcagaataataggacagaatttgatattagtattatactttcagaatcaaaatagcacagtgataatagcacaagagggctacagaaatgcaggtactagaaattgaagtttatcatcttagcatacttgacctttcttttggaggtgtgtgttgtagcgttgggaagcattgtctcatgtttgatgctttagcaactctaatacttgtgtatgggtctactaaaaaggcgcatcagcatgttctgtgagagaatacaacagagaagcaattgcagtctgaaagaaaagcagtcaaggatataagcaggtaatgtgtggaaagcaaacttaattgtcaataaacacaaaaatttccaaattatggaataatttaaaaatgcaaattaaattaaaatgatatacttctcctcattaaattagccaagacttaaaaatattctttatgctgctagaatatggtgagacctgcacactcactgttgcctgaagtttcataagtataaacttctttttttgtgaagaaagtagagactgtgtgtataaagatctttacaaatggccattcctgtggtatcagtcatctatcccaaggaaaaatctaaaatccagtcaactgttataagccacagcatttctttttgacattgaaaaattgagaatggtgaaatttatgctgtagtcatgttagaatatcatgcaggcactgaaaatcatgtttttgaaaaatgtgaagcttgaaagagtacaaaagaacatactaactgtatcatgattagttttatacaaattaaatttttactttttaattttttaaatatttctatgaccaggtgtctacaacaatacaaattaaattataaacataagaaaagactaggggaaatacatcaatttaaaaaattattagtttcagggattggcagtttcacttaattaaaagctacaattccacagttaaacagatgtggtttgaatctgcctgaccgcttaactgtgtgaccttggatagtgacttactagttctatgtgacttactaactccatgaccacaggccaattacttaattgatctaagacgcagtttcttcagctgtgacatgggagcagtaacagtacttactagttcacaggcttatgtggattaatgcaacagtgcatctaaaatgctccagcagtgcttgttgcatcattagcacacaactaatgttaattatttggattgcaggtagtttttttttttttaattcagtctttctactttttaaatattctaaattttatactgcaaggattgtaaaactcaagaaactctctgatactgtatatggaaggaaggactctgacagtttttcagtaattttgtggtatagacaggaaaatctttttttaggtaccataattttccataattttaaccagcgatatatctgaaacaatactttcaaattttgcatgttttttttttttcttttctagattgcttggcagttttggctttttttaatctcaaagaaattttgttttacagtaagttacgtttaattggaacctcccccactttttttttaaagtttcctgaaatcaaggaacataagaataatttttaaaaattttctgtaggtgagatctgaatttgattaatattaactgcacatttagctctcagatttcagaccgatttagtgttagcttctgtgcatctcacctaattgttaaaatatgtgagcatgattttgatatttgggaggtggaagagaagcctcttgagacttttgaactaaagttaaacagtttattctgtcttggagttagttggtgtaggttagtaggaagactttaacatctggagctctttcaccttggaattgtatctttctcatggaagaaacacatttgagctgcagacagcctggaaaagctttcaggctatattttcttcacaggagggcaatagctttgcacttataataaaatagcttcaaagtttttgtctccttgacattatgttacctttaatttaccctcaaacattattatatcttctatagcaaacagaggaggataagaaaaggaaaaacagagacaaattgttaacattatccccaaaataataaatgggttgttggtaacataagacttgaaaaccatagaatccagaatatatgcaacttcattttattactgtattgcattaaatttaagatggtgtcagttgtaagatgtattctatttctgatacattgaaatgccaaaaaaaagtcgtggaattgatgaaatctagtagttaaataaaaaaccacaaaaacctcagtttgcagtcacctgtatttttcaatttggtgtatggaacaaaaaggacactcacctgaatgcatctgaaattggaacttaaatctctaatctttagcaaaaatatgtcccagctatgtatatcactttaatcacacgtggtgccacctctgatcttgctccttatgttgtgcacagcacgtagagtacagcataggtggactcatgagttaggtgtttgaacatgaccctcctcagctactggaccaaatgtaaacagtggtcaactttttatagtgttaatctgtcagactgctgtcaacacactgggtaccataaaacagtgtcaccaagactgttccacaggagtgatgccaaaaatctattaaaactcacagtaaaacaagaaatgtactgctaaccacttacagcctgacttgacaattatcaagtatttgagtatacattctaagcttcactaggccagtgcttaccttgtacataagcaaaagtaggaaaatgaatggttcctgtttgtcagaagtttaaaatcaaattactcagcaatacaaagcagggaaggaccccctttacctttctgtatcgaggataatttgagaggatttttgcgtcagttagggtgaggccaatacaggaagaatatagggtaggtggaccaattataatgatgtcagagaatcctcctccaccagccataggaaagaataatttcatataaaatgatagcaatttaaagatttctcaaatatataattagaggttggaggaggtaatatggcataaaggttagaggcaagggctctagagttagactgcctgggttcaaagcttagttgcagtactctctgcctttgggatcttgggcagataacctgttcctgttttcttgcttataaataaggtagctgatagtcccttcctcaatgcctggcatattttataccaaacattcattgaattgaactatagttaatattgttaaggcttgctttgtttcttagtaaagagaacatggaaatgagcagtgtaaagatttgcagagccttgatgtctagtggtatgacttgacttttcttctcttctctttctctttttcttttctttttgaggtagggtcttggtctgtcacccaggctggagtgcagtggcacagtcacagttcactgcaacctctgcctcctgggctcaagtcatcctcccacctcagcctccagagtagctgggactacaggcacataccaccatgcctggctagtttgtatatttggagagatggggtttcaccatgtggctcaggtgatcctcccaaagaggtgggactacaggtgtgggccactgccctggctgactctggagctttcaaataaacatggtacataacacatttcttggtgttatagtgaacagtatgcaacttgagagcaattagatattagcatatttaaataaaagattgtgaaagtatgattgtggcaactacctatagaacattttgctggtggtatcttggtcagagttttctagattttcccatgtgtcatgtggttaaatatgtagtggttttaacatggcagtgtggatttaagatgaagtgtaggagctgtgctttgtatgagatgacaagggcatatctattttgttccatagatttatttgtctgaggtgatataacccaatatcttaatgtcaccaacaaattatgtgatcatccagaagaactgaaatgatttcaaacattgatgatttaactgttttgtttctaatcacctagagggagccagcgtaatgtgataggtcttattttattacatttcacttaaaaaaaaatttttttttttttaaagcctggggtagcctgttctggagccagctctgtctgtcccattgctatggaatatactgtagctcctctatttccttccctagagcctctcagtactcttggatgaggtgggagaagctgtagaaaattataataaatagggcaagaccttaaggagtttctagtccatctccatttctaccccatgctcccagacttcacgtgtcatccgtcacattctgctctcacctgcataacaggttagatggcattgttttttcttgtttattgtttgataacttgatattatttcttttttttttttctttttcgagatagagttttgcttttgttgcccaggctggtgtgcaatggcgtgatttcagctcaccacaaccctccctggttcaagcaattctcctgcctcagcctcccgagtagctgggattacaggcatgcaccaccatgcctggctaattttgtatttttagtagggagggggtttctccatgttggtttggctgctaggctgctctcgaactcccgacctcaggtgatctgccctcctcggcctcccaaagtgctgggattataggtgtgagccaccgtgcctggcaacttgagattctttctatggaaatattttaaattccaaacaaccaaattttagaagatcattatgaatgaaactagatactaaattagtacttggtgattgcttgccttaggctctttctaaccatattggctgcttttcaccttcacaaaatgttagaagcttaccatcttagagtaattataactgctgatgattgttctggagtaggtgtatgttacttaacaggttgtggagcttgccagttgatgctatgttgagagtgtgctgacctcacaagaactaagatttcatatatatctcagtccaaactagaagataaagacaatattaagccccaaggcatcagcaccacggaagattactacatttggcctaacacaatgagacgatgccatgatgttaggtgactgaatagttggtagcaactattacgttgctcattttaggcagcaacctaaaagtcctgcctggttgggtgccggctggtgcccatttagccagtcacatggtctgtcaacatgcagctttctaatgccaggtctgctgttggcagccattggaggcagtataacctaacagttaagagtgggtcctgcagttagaacctggttctaatttagactcctcactgtaccatagtattttgggaaagcgacttaagttctgaagagggcccagtgccggacacacacactgtaagtgcaatgaggacgatgatggcagtgagacgtcaggggtacagctttggcaggttgtcactgcctcagagcacggtgcttctcacaagtggcacgctgctcacagagcacaggctgctcatttgaattctgtctcaggttttgagctgagtgaggttgtgataacgttatgtttgagttggaaagtgaatacaagatacatgctgacttatacttgatgcaattcagaatctgttatgtgaaagtaacaggtagcaacaatctgaccaactcagcagactgtaggtacaatttttaaaaaaagattcacaactgatacatcttcgtgagcagcagcaacagtttagtcactgtttccaagagagagctgtgtgtaaaatgttcacaggttatgtagtactgagtgtgcagtaaatggtcatcatggtagaagagatcccggctcagatcaccagtcttttcagtcacatggattcattcatttgtggaaagtcttataatcagtatctttatttgcggactgtcccttttgtttcccaaaataagtgtaagtccttaaggttaggtggattatttttgcctctgtttttctagctagttatacttggatggttggttaggacagatgggatctgctagttttaatggaaaggggattccttacctgaagattaattgtggcctctccacttacacagtcattagagtgtggattactttattgtatcatagttctttcttttatgtaactgtctaccttatataatgggaatatttcctgatattcttttcttggacacctttttatcagacaattacaatttttaaagagtgaattttatttggaaaggtaggtttgggtaaggaaaaaacactgttggtttgaaaggtatctggtttagtaacagttccatgtgaacttatgaaatatttttaaccttcctggagatcttgaaaagtttatcctgcactttttttggggagaggcagccatcatcattttggcttgtttaatttttctgtagggcacatgtgtcttgatgtagggttgttttctgcacccagtgccaatccttaagttctggtgttgtgctctgcagagtcatgaggagtggaggctgtgcctccctgcagtggtgttttctggaggtattatagaacaaaatagagaaaaaacatggactttaaaagtagtgggacctataatcaaataccagctcctccactcactagctttgtgatttgggaagactcacttaattgctttcagtttcctcatttacaaaatataggcagataatattcaggcatagttgtgaggattatatgggggcaggtggtgtgtgggtgggtgagagggtgtatgatgcaaagcccctagcgcagtgctctttccacagggagcacttactaaatgttaattactttttcttctactttaatactaattttctaaatgtggtgggtatataatctggaaaatataggatattcttattttagatgttctttcttgttagactaggtatcccccctactttttactttggtgtaaatatagttattgtattcatatcacatgttgtgtcttatagctcttgttttggttttctctgactgtcctttccgactttacagaacaactggaatctatgtagtcccttaagtaaataaagcttttaatgctaagactgtcaagcaataagcctgtgagaaggtggagactgtgatcttggttgtaaacttaaaaacgaaatctcttacaccagtcttttccctgttacagctttctagttgctggtgaataaaatgcaaaagtgacaaagaatttgcatatattcttagggaccaatagcttcgttttcatagtgaatcttattatcttttgctgtgtaacaaactacactgaaacttggtggcttaaaagagaagccatctatttagcacatacttttgtgggttggcagtttggattggtttcagctggactcacccctgcatctctggtcagctggtggctgatagttagctggggccatatgtttgcatgtgagagagagtgagcgagagagcgccacatattccagcagattggcccaggcttgttgacatggtggcagaaaagaaggccgctctggtgctcaagcacttttcatatctgtttgcctgaagtttgctattgtctctctggccaaagcaagttacatggccaggcagtgtagaagggaatacttcagggaggcccaacatatttggccaccactgcgaccatcttctacagagaatgtacgtcactctctctttctcctcctccttcctttttcttattgtggtaaaatacacatcttaactatttttaagtgtacagttcagtgatactaaatgcatattcataatgttacgcatccatcaccagcatccatctccataactcttgtaaaactgaaattttatacacatttcacttccccacatgtgcatatctcttaattcttctgtagaatgcctttgaccagtgattggtcatatagcaccagaatgaaaggcctggggaagaacatgttaaaattcatcgctttctcttcctcttattggtcaaggtagggttatggataggaaatgagagaagaaaacaaaacaaaaacagaagactacttgtgctttcattttccactctccccccaccacccaactgaaaaaccaaattcgtgatacttcagtaactggaaccatgaaacgctcccattttgtttagccacattataaaattaatgttacatttctgtctgtgagtacaagctgatccatgatcttgtcccacccctttatggaaggactgtcccgccaacaaacagccctcccatcctgggatcatgttggcagctgctttggattttaattgactaaactggccaccttccctctattgagccagctaccaagcctggtctgttattctgctgcatctctgaaacagctcataaactcctacctctccctgagcgaagtcagatataacttcactctgccaagtgaatcttgatttaaccatgcctcagttcctggatccacaatgtaaaactttctcttaatctttcaaggccctctgcttgcaccccctctttcatccagttcttttgttcctctccagtgttgcccagctccacttgtgccattctctgacttatgccatcttagggcttttttcccctgatgcttcccctgcccctttaaaaaaacactcctgttgttaaacctactcatagaaaaatttctcccttgtttgagtttcctcagtactcatgtcatatattttgtcttactcttcccaagttattggctatagaatttatcgttttgtgtttattaatccaaaaaagtattcatgtatatctgtgggctgggcaccatgatgagtgttggggatgcaggggcgaacacagttataccatgtgcccaaggctggtggacagtgggccaaatgaccacacaaacctgtgtaagtacaactgtaataattgcttgaaaaaaaggagcagtgatgtcatggagtgggtaacagaggcatttaacttagttcagaagatgtagaaagactcacctgaggaaggcaagcttgggctggggtcttcttgcccaaaggttctgcggctacactgggagagcttggtctgtaccccaagagcaatgggaaggagttactctggttgcaccatgtgcatagattggaaggcctggaaggggaagaccattgcatagtccaggtgagaggtggtagtgatttgatctagtgtggtgtggtccggctgtaagcagaagtgggtgggtctgagaaagatttagcaggtaaaataaaaaagatttgatgatgagttgggtgtgggaaaccacaggggcagaatgtgtcctaggtgacacatggattactgctttgcctaaatggctgatattcatggggccacccctaacccatatggtgcctttgcaacttaacaagaggtaccctttctcttgagcacatggcttggctggtggaatactggctggaattttacactcacttgcttcctctagtcccttgtgtagtgaagggactgttcaatcacatgccttactccggcagcccctggccagtcaccaacatgtaggctttctagctttctttctcacctggttaggataggaatctcatctgcataggagctctgaatgtgatataaaatctgatccaattgagaggtgagctataaaggaatatataggaaggagagagtaaagggtagttgatggtataagagtcctgaaaggtagataagtgtggagtctaaaagtgagggaataggtctcggcctggaagagcatagttgtcctggaaacaaggaggcaggaggaatggatgggtacagatgttagtgaacttgcgcgtttggctttaggaactcccacagttagctatcagaggggctcctattttctctgcaaagtaggaaatgaaattacttgtttatgtcttgcttctttaaccaaagtataaattcactgaggacaaaaaggtatgaatgcataaacatgcttatttgttctttcacagtactcgtttgatacttaatgttggatttcattgaaaattggactcattgaaaaatcagacttgttacttagggttaaataagacattgcatctaaaaaatgactcacccagtttgtaaaaatattaaacactgtaaataggtgccatattaaattattgctaactacttcctgaatgttaccagtttaatttatgattagatatccataaataaatcttattgagtaaaaatggcagaatttgtgctaacagtttggtgcctgggctttagagaaatgcacaccacctgtactttgagatttaaaaataaagtataaagataatggtgatgcatgtagaagagaaacagggagaaaagtgaactacttggaataatagatttttatatcaactcctatgaattgattaacattatataatagaataagtcacatttatactgtgttttattgcttaccaggcattttaatacatgctggcacaaataatccatatagaaaaggtggcattttataaaagaagaaactttggatttccccaagcacatgcatatagtagatggatgaaacatccttgattctaggtcttaggacctcaaaggaaagtcaagagcctttcaccctgggcattctaaaaggatacattttttttttttaatggtcctgagctatgcagttccaaaggacatggagaatctaatggaaacacacagacccttttacaccatggtgattacattcattggatctgattgctgttgagtgatgtagcaagcttgctgattcatattttttttgtgtgaaattatttaaagtttgaatttgggttaggtagttgaacgattatgaattgcttaagttgataatgttcaggaagtagttaggaataatttcatatggcacatcttggtagtatttagcatttttacacagttgataaaatagcgagttttatgataccatgaaatatttttgtgcttgactagaattttgcatatagtttaataaaaataatttaaacaatatcctggaacaatgtctgaacagtgtaggtgatgaaagaacaaggggtaatactagactacttgttatataattacgtattatgaaacttctttttaatagaggattttgctctaattattgaatactcagaagtaggaattagagctgtagcatataaaaagacaaatttgagattatcacatttatcttcaaattataaggacaaaactatagtaatttatgatttggtgatttaagaagtttgaaacccctcagtggaaatattttgctatttaaaaaagttgacatgctggaagttagttttcatatatgaaaaaaggaagttattttaacattgcttagtaatctacaaagatctttttaaaatatatatatatttattatactttaagttctaggatacatgtgcacaacatgcaggtttgttacatatgtatacatgtgccatgttggtgtgccgcacccattaactcgtcatttacattaggtatatctcctaatgctattcctccctgctccccccaccccacgacaggccccggtgtgtgatgttccccttcctgtgtccaagtgttcccattgttcatttcccacctatgagtgagaacatgcagtaatctacaaagatcttttaaaataacatattaagttaacataaaatgacactattaagattctgtgtagaagctctgaatatgatataaaatctgataaatattagtaagaaacaccttttgatgctgtctggtatggtcttggaacttgcttattcatgcatccacagaggctgaaatatgcaaatattgacaaaactagatttattgatagtgatttcaattacagtagtgtgatcctctacatccagcagtctcccttgactggcagctcttctgtggaaaggaatttgcttgctttccctgagtgctcttctgtggtcctgctagatttggagattgtcatttactgtctgacctagttcacacacgtgttccctgtgaaccaacttagatgtctgtcttaatgtaactgatagctcatttacttactaatggattggataaataaaaagtttacaagttacccttgtataagaacctactttgagggattttaatagtaactgggaagaattgatgaccagaattgggtaactattaatagatgaccagcacttgtttacttttaatttatagcatcaagtccaatctgacacatcctatgtacatttaagtttttaaatagaaatttaaactgtatttgagggtaaaagaaatctttagttataatttattcatatctcaaaaaaagggaaactatttgagatgactgagattttaatttgctggactatatggtagccatttcactataagtatatggaagcatcacgttgtaccttaaatacaattttcaaaacccagttttatggcaaagcaggatgccaggtacatgcaagtttgaataaaatgccgtgtatgtctgtcaaagcattaagacctcaagtgtttattgtatgtggccagttaaagtgtgggtgagggttcctggaggaattagcttttgtgcaggatttaaagaatctactataaccagagagagcggtgataaaggtcgaagggtggtgcgtaaagcagccaagttttgtatttaggaaccaggaagaatttggtctaggagaaatagagaagacatgaagatgcccaaggagggctttttgaatgaatctgggattatttttacactgggaatggtgacagctgagctgtgctttaagtatgaggtattcgaaatcacacctggctttctccccaaccattctgcaagtcacccaggaatacaatcgccatttcatctctgactttctctcctgttgcaatcctctgtatccagaatgttggcaaagtctgtagattttatctcccctcattgcctctcacatcctgcctgcatttcagtgtctactgccttctcttctggactcctgcagagacttctcagtctctctggtgcctgcatcttatcggctcacacttctggacaaccagctttgcatttaacccttgaaaacagattgcttcccttcacctgggatgcaggcctcccctactgcctgcctacatttctaactgtaggatctgctcttctttaaatatagtccacaacaggcctacctggattattcgtgatccctaaacactcagtcgtttccctcttccatgcctcttgcttttgcttcgccctatttcaagtacgattttgtccactcaaactcagctttgcctgtcgaaattctgcttgttttcaggttctgtttcaaatactacctcttctgtaaagccatttctgactcttttcaaccgaatgcaacttccttaccttatattgtcctttcattctagttatatgggggcacatgtccctatgtacataggctgtgcagccagtaaacacacaagtgaggtgcagaggtaaataaggcagcatcttacgatgccctagtggctcgcctgtctctgtggagacgttgctggcccttcctttcctggggtgactcattgctctgtttctcctctctctgactgaggctctttccttttgcggaattcctaagattttattgcacttcattatctacgttcctgttttcttcttttacattataagctctttgaaggcagcctagggctattttagtattttcctattaaagggttaaggtctgatttctaaaataggtagcttcattgtaatgttacctaagcaataacccaggtgcatttgtgtagcttgtaatattttgataacttgataaaatggtggattcccttaaaaagggaatcttgtgtatgcttgactggaactcagctaagttagaggaaggtggagatgataaacagtgtaaaaatcaccaacgtttattcactttatttttgtattcctgtagcagccagcaaacagcttagaatagtaggtttacaggttttggttgaattgaaaattaataaaaactcttaggtaaaagttacttgcaactaaagtatgctgaatgagtgtcattgttgctttcttttttgcttttctgactagattgagttcatgaagaatttcttgtttacttttaatttatagcatcaagtccaatctgacacatcctatgtacatttaagtttttaaatagaaatttaaactgtatttgagggtaaaataaatctttagttataatttattcatatctcaaaaaagggaaactatttgagatgattgatattttaatttgctggactatatagtagccatttcactataactatatggaagcatcatgttgtactttaaatacaattttcaaaacccaatttaatcttcaatagcaatggtaatagaaaatgccatttaaagatagctattctcctacagagtttaaaatgtgtcttatagtaataatttgtataaatttatgtatacctgatttgttagtaatggagtatttaagattagagatcataaatatgggttgctgggaatacttttatttttttaaatttcagatttttattcccttagtattgcttataatacaaaaatccactccattttgggggagagaattctcccaatgtcacttttttttttttacaccttgtttagatgaaatgttctcttctgttcacaacagtgggaggaggcagtggggaagagggtattcaagaaagacattttagatttcaaaatacacgctcttagttgatcataattcttgtgcaaactttgaaatgaaaacttttttttttttttttggtcatactcatggtgatagtccaagtagctgtattcggtttggcaacacagaaggcactcatcctggaagcactagccagcccatagagggcagatgccatgcctgcaatgcacacagttatgtacggtgtcgattcactcaagacaccccatttagctttgtctctgactgtggaagatggacatctttccttcttcactgtaccatctgtatcaaagttggtaaattgcctttctaacgtgcaattgatttcaggattcaaaaactcagtgtcttttctgttgttaagaacccagattcatttttatctgctttccactgccccttgacattgttttccatacccaaatccttaatcttgaggtattttaaatgcaaatatttgtcatggatgactagcctgaaacctgttggatttaaaaatggtgcattttaaaagaagagaatacaatgtgtacctcagagagcagtgtgattgtttaagagggcaacaccaagacttcacttaggagcagctccagctgcaatggcgatgcatggctgtgatggccagctcctagtgtcctgcgtaaaaaagagctggaaaatgcatactatgtgcagacacctatctgcacaagatcacctaggcaggaagggatgcacaggaaactattgagtttgttagctttggaaagttacactaggcgatgaaagagggtaataaaacatatttttttaaattcctagtcttctttactgtttgtttttgtccttttttatatcataagttacttttacactaagtaaaatagaccagttgacatttggtgagcgtgaggctgtgataacctgtgttccctacatttctgctccatgtacaagtacctctaagatcttgtggacaaggagggctattaaaaggctgtgactgtccagctttaaagtgtaaacattgaataactttattttgtacttaaggacttttagtagtaggcttaattatagtcccacatcacaattttaaaggaaaaagtgataactcctggggaaagcatctctatggcctgcagaattccatttcttgtggaggagatgaggttataatggagtccagagtttcaaaccaaactgtagcagcctcatcagatacagcttggcggcctactgacttataatgagggtggcatgtaattagaaattgtccctgtcttttctgagtactgatgaaaaccatggctcagaggttaattcaaataataattaatattggtctctgtcagtacagggtggtaatgaaatctttcgttatttgatgactttgactttagatgttgagcgaggaatagaaatggtgttattcctcttgctaattgtggggcagctccaacaactgaacactgtggtaaagcatacgatttggaagatgtcaagtacaaaatttctttgtagcctataattgtctaccatagaagttataacatgacacagacatattagtgttattttattttctagagtgataattatttagagtgaggtattaggaaggcaattgatcctgccattgtagattgagacgcttttgttggtctcccatttttcctactgtatgtgatacatagtagccagaacaaaattacccattcaaccttaacagattgcatgtgcacattaatctgaaaacaaaaccaccaaatggctggttgattatagagagccttgactatccttttcaaccttgaaagtcattgattctgtaagttggtgcaccacatttgatgaacatcttccatatgcagaggtgggtgttccaaatgatgtagaagatacatagttggtttaagaaggttatttggaaatacataggtatctgttaacacagattaactgtagcttttaaagctgcaaatggcaactacagttgtttcattaaaataattttggtggaagggagatgtttaggcaggacagtttttaaaaaataattacagatgcttcattacataacttgctttaaaattattattattattttttgaaatgtttgttgactgaacttctacagcttaatcacggagggtggtgtttggtatcattctaagcaacatcatattttatagggaaaaataataggaaaaaagaagaatttttacaatgtttgaggactctgagatgcttcagatacccaaacagcagaacctttctaacatgtaaaagtagacacgagcagaatcggccctcctgcatcggatgcctcatcaggtccattaactcaggcctgccttgtttattcacattctcactggtgtttcccatgtcctgtattatttagcagcaaatcccaggtagtatagtattttattttaaaatacttcaagtagtatcactaaaagggaagctggccgggtgcagtggctcatgcctgtaatgccagcactttgggaggctgaggcgggcagatcacttgaggtcaggagttcgagaccagcctggccaacatggtgaaaccccatctctactaaaaatataaaaatggctgggtgcagtggctcacccctgtatcccagcactttgggaggctgagtggggaggatcacccgaggtcaggagttcgagaccagcctggctaatatggtgaaactccttctccactaaaaatacaaaaaagtagctgggtgtggtggtgtgtggctgtaatcccagctacctggggggctgagacaggagaatcgcttgaaccctggagggggagttacgctgagccgagattgcgccactgcactccagcctgggcaacagagtgaaactctgtctcaaaaaaaaaaaaaaaaaagaattctttccagattaaattgctatagagatttttgtggacattttgttttttgttgttgttgggacagagtctcactctgtcgcccaggctggactcagtggcgccatctccactcactgcaacctctgcctcctgggttcaagcgattctcctgcttcagcctcactagtagctgggattacaggcgtgcgccaccacgcttggctaatttttgtattttttagtagagacggggtttcgccatattggccaggctgttctcgactccttacctcgtgacccgcctgcgttggcctcccaaagtgctgggattacaggcgtgagccactgcgcccggccagaaatttttttttttaattgaaaggcagtactatatttgagaagggattcgtaagcatgctttcttagctagaatatagagggtgataggcaattgttggacagttaggatcagtatttgatttcaatactgattttaatttgattttagcagcaatcctagaattctgaaatgagaatgacagggtcaaaacattattttattcacaaaagcaacgttctctctagggtgtcagtgttaagattgtttggaggccagaggtttggaggaggtggtgggcgttcacgaggagctcttctagagctgttgctgcctggggtaaaccagcacagattccaggagaagccagggaaaacgcatcccactgggatctaagtgacctttcccacaagaccaggtcttgtcacttctcagcttaacatcttagatcggcttctcattgcctgcctgaatatgagccaggaatttcgatgtgatttttttccttctttttcttattttgcttctcctcccgctcccactcccaatccccgttttctttctttgtagaaagatagcagacataaataatcttcaataaaaaggcagttaagaaaaaaggcatgccttcattccaaaaccccagattcagactcccagggctgcttagggggagcgctggggcagagccaggcctcggcgggcggggtgggccgggctgggccgcgcttccgggatgggtcagcgcccggagcccgcgcgaggacatgaggacggcgagcgggccccccggggggcggggcatcccctgggccagacgcagggcggagcggggtcatcgctggcacgcggaaggccctcataaggccctcgctgccggcaccgtggcctcccacccactcggggcgctcgcttcacctcatgcccgcctcagtggctcggggccggagctgcggccacttcctgaccggaaggccgagccccacctggcctgacaacatggcggccgggagaaggcccccccccccccccccccccgccccgcacaccgccaggcctctggacgctgagactgggagcgaagtgggcaggagtcagcgaggccatctcgcgcccgtgcgcaccgctgtagggtcatctccagcgctggcacctggctcagccctcagccctcctggcccctgggcttctcgaaatggccacactgccccccacttcgcggcctggttccgccctttcttggcctcaggtgctgcacaggccacgccctctgttccgagcccttcttgccacctgccctccctcatggctcccgctcctcctcactctggtcgtctcgggaggccttctctggatggagacctggctaggtccccgtaacttgacctcagcagcctgttttgccttcgtagcccacagcccacttgtaattctgtgttccaggtctgcccaggggaaaaggggatggtaatgcctgttgctgacatagctctatcagaaaggtgctcagcggctgaatgaatgaatgaatgcggtggagcatgagggcgcaggcgccatagtggggaggggcaggagggaatattctgccggcagccacaagaataggaaagagaaatactctgtccgaatggtttgtttttttgtgttggtgggattgctcaatgcatggctcttcttgatcagtgagaaatgtgattggagaaagacattagagttttatagctgatgttaaaaaatgagagccgccacattgacactatttgcttccggagaccgatgagagtgaagaactaacagctttgggctaaactttggagtgcatttttattaataaggctagatgaaccatcgctggctttccagttgtatgtatccctcatagaatcagacaccaactcagggaggggcctttccagcacacagagggctctgcctttttttttttttttttttgggagtcttgctttgtcgcccaggctggagtgcagtggccgatctcacctcactgcaaactccgcctgctgggttcaaggaattctgcatcagcctccggagtagctgggattacaggcacctgccaccacgcccagctaatttttgtgttttagtagagacagattttcaccatgttggccaggctggtctcaaactcctgatctcaggggatccgcctgccttggcctcctaaaatgctgggattacaggcgtgagccaccgcgcccagccccttcctctttttggcttccacttggccaaaggagcttccctttggggccgcgtctgagtcatgttagccgctggttcaagggagccatctgaaactccttggagcagggtttctcctgtatatggcaatactctaccttagaaaaacaaaacaaaacaaaacaaaacgtcaagttacatggtataatggaaaaaaaccctaaacttgggctagaaaatataggccactattttgtttctaataccactatgtatatggacagaacagttaactgtccacgccctgtgtcttccttcgtgaaaggtggtgacactgtaccttcacagcctacttcataggactttggtgtaaaatgagacagcagatgttaaagtaccttccgagaccattgtttccagaaccttcatcacattgtggtattagaaaccttggagtcctccttgactctttcacaagctacattgaatttgttctcaaagcctctggctctgcctttaaagtatatgcagagtctgataccttttctctccacttctaccacccgggtccaagtggccttttttccttgccggtgttactgcagtagctcccctactgctctccctgctgttgcctgtgttgcctgcagtctttccaatgttagcagtcaaagtcatctctcagagccagagctggatcatgtccctcctctgctgaaagcagttcgtgattcatcctcttgaggcaaaacctcagccctcacagaagtaccctctgctccagcctcccccatccagaatctcatgggacaccacactttgtccttgctgtcctttagatgctcaggtgccagttcccctctcagtcttccacagttgctctgatctcctcagacactgtcagggcctcgtagggcctgctgggctgactcctcagttccttcccgatcatacataactatcttccctgtgaggcagtcccttaccacccaatttaaaattgcacctccttcctccaaccggtccctctgctgtgatttggtttttctctcttactttccttttagttatttacttatttattttgtttgactctctccacaaacaaagcttaattaagctgcatgaaggaatcgttgtccataatgtttactgatgcatctccagtgcctaggacagtgtttgacagatgataggtgcacaatacatatttgttgcttaaaattatatgggagctaatcattggagggaaaaatgtcttcggttctctgtagcacactttttggcatagtatagccgatgaaactttgtaagcaagatagcaaatattgttacactatagtggctttcagaaattgaagacagtgtttctctttgagacagtcctgattagcaaattacacatttttcccctcttgttacatctaccttaagcctttttttttttttttttcctggagtaatgcatgaatggtggtatgtcttccctcaggtcattgcatctgggtacgtaatgttcatttgtcccgtttactggtgatacgtactttgatcacttggtaaaggtgagttattccatttgaaaagaaaattattagaataacattagtttactgtcaagttggaattatagtgatttgcttccttgtaaatgaaagatagtgtatcattgtggtgttttccatttagttatacttgttggctgcagagtaaacactttggttattagacttagcaataactttgtgtagaacttttctgagggcacaaagttatttcacatttttcatttcagagtatttctagcactatgtattttgtttatctagagagaaagtaactgtgttcttgatataggtcaggccttgcagtggcacagtatgtgaccctagtttctttactgttactttccttttggtcatgctacaactcaggtggttatgtagttaaaccttatgggtgtaggggaagggcaggtggcatgagctgaaaagtgtaaggtaactacccctgaaagttgattgattgaaggttcattatacagtcatgtgccatataatgatgttttggtcagcgatgggccacatatacaacagtggtctcatgagattataatggagctgaaaaattccattgtccactgacaattgtagtcatcataatgtagagcaacacattacccatgggtttgtggtgatggtggtataaacaaacctactgtattgctggtcttataaaagtacaccatgtaaaattatgcacaatacataatatttgataatgacagtaaactgtgttactggttcttgtatttgctatactatactttttattgttattttggagtataccccttctaccatttttttttaaatttaactgtaaaacatcttcaggcaggtccttcaggggatattccagaaggcattgttatcataggagatgacagttccatgcctgtgatggcctccgaagaccttccagtcttcagagtggcacagaatgtggagatggaagacagtgatattgatgatcccaacctgtgtaggtctaggctaatgtgtatgtctgtcttagtttttaacaagaaagtttgaagttggtcgcggtagctcacacctgtaatcccagcactttgggaggctaaggtgggtggatcacctgaggtcaggagttggagaccagcctggccaacatggcaaaaccccatctctactaaaaaatacaaaaattagctgggtgtggtggcaggcgctaatctcagatactcgggaggctgaggcaggagaatctcttgaacccggtaggtggaggttgcagtgagccaagattgtgccattgcactccagcatgggagacagagtgagactccatctcaaaagaaaaaaaaaaagaaagtttgaaaagtaaaaaactaaactaaattaaacatttaaaaatatgaaaaagcttttggaataaagatataaagaaagaaaatacttttgtatggctgtacaatgtgttcgtcttttaagttgtaaaagtcaaaaggttaaagtctataaaataaaaaagttacagtaaacagataaatttattgaagaaagaaaaattaattttcataaattcattatagcctaggtgtacaatgtttataaagtctacagcagtgtgcagtaacatcctaggccttcatattcattcaccactcactcactcactcactcacccagagcaacttctagtttacaagctccattcatggtaagtgccctatgcaagtgtatcatttttaatcttttatattgtatttttgctgtaccttttctatgcttagataccattgtgttgcagttgcctacagtattctgtaacatgctgcacaggtttgcagcctaggagcaataggctgtatcatgttgcctaggtgtgtaggaggctgtaccatcttggtttgtgtaagtgcactctgtgatgtttgcacaaagataaaatcacttagcgacacatttctcagactgtgtcctcatcattaggtgacacatgactatgtttacaggtagcctcttgccttctaaactgacacttgagtgatgcatgacactatttggatatgggaaaggatttgtcacccacagggtaggaaactttggagattggcagacttccttttttgattcaagtaagtctaaattatgatttcagatgagtaggctgaaaatattttgtaaagttccagagcaggaatatgaaaaatttggacacttttcattttgaagttccacaattgttagatttagatagatagattgattttatgtctttaaaatatttgaaacgtgtgggggctcaaaggtttataaacttttttttcagaattttcttgaaatggatatcagtctcagactgacacattcttacattattattattgattaaatatgttaggggctagtttgtcttgccatgaattattaattggtcaaacctttgtactgggcactctgggagccctggggtaataaataaagccctggggtaataaaagtgtacaaagcacattctgcacctgccctcagggagctccagcactgggggaccctcctcattcggcaggcagtgaagctcagctccagtgagcgctgtgaaggagcagagagtccattgtgagatgagaaaatccggcaaccaacttctcatccccacaggtcttcctgcttacctgaaaggaaactgaggccttgtgagggttatcagctagcagaacttggatggacaccagatctgtttgacaaaggcaaaaaaatcataataaattatttttctaacatctggctgattgtaagtatgcttattccaaaatattcaagccataaaacatgcatgaagtaggaagtgaaagcccccacccctgataaattcaggtacattaattaatcttctaggtttttaatgggagaaaggttgcagagtgtgagcatattatagatacacaactccttttttcctgaaatactgtggctcatcttttcataccaacacacagagctctgatttttttcagcgaggtcaaatgactgtgtcctgttccatataacttcacttatctgtcctctttcaatggccggttgggtcatttcagtgtttcactattgaaaatggcacggctgtaaagatcatcagccttttatgtacctctctttgcacattgggataaattcctagacaggggtattacagggtcacagactatgttcattttaaatatggtaaatgttcctggattggccccagaaaggctgtatcagttcacattcctttcagtggtgtatgagttacttttttttgtgcactcaccaactgtggaccttactgtcttttgccaatttgataggtgcctttcttttattaccagtgaagtcaagtatcattccatgtgtgtttttggccttcttcgtttccttaaagcctgtcctctgcaccattgtgctgttgagcctccagcttctgtgatcgccttctgtgactgaatatcatctccgtgagcctgtgcacccttctccgttctggtagagagagagtaaaggctaagacggctgtctctgaaagcagtctcagggattattcccattgctgccgcttaccagcagtggctccttggcaggctacttaacctttgagccttcagtttcctttcctctaatgggggtaacaaggattaaatgaacgagtgcatctgaagccttagcacagggcctggcatgtgagtaaatgtccaggaaatgcttgccaccatcagcagcagcacctgtgtgggaaattactttcccttctcccttttctatgggagtcccttagagccctgctcagcagcctggatcctcatcagttctgggattccgttggcggctgctgcttttccaagtggacacttttctctttgtcattccatgtcaagggctgtgaagtgaggtcccggaccagcaacatcaacttaggcatggagcctgggcattttccttctggttggtcttatggattgaattgtgtcactctctcccacccaaactcatatgttgaagcccctaatccccaaggcaattgtatttggagatagggcctttagggaggtaattaagattacatgaggttataaagtggtcataaggtaggatcctgatctgacaggactagtggtcttaatacgaagaggaaaagagagagctggctctcccagttgacaaaaaagaggccatgtgtgcacacagtgagatggtggctgcctataagccaagagaagaggcctcagaatgaatcctgccttgccagcaccttcgtcttggacttccagtctccagaactgtgaaaaataagtttccgtttaagccacccaggctgtagagtttgttatggaactctggcagactgagattgttggagaaccacagtcctggtggttgagtgcctgcctcaggcattattgtttttaggccagtggtttgtgcatcaaaatgcttggtaaagcagactgccagggcttactccaagaatttcagatttaggattgacatgagaagtcacatttctaaccagttccccagcggtgctgatgctgccgatgctgccaatgctgccaatgctggtccatgttcggagaaccactggtttagatggtgtgtcggagaggcttcaggcaagcgctgggagacttgaggtagggatagtggctctcccgcccaactaggaagttgtttaaactcagagcctcagttgcattatctgtataagggtgataatatttattctgcttatttcatgggattattgaagtcagatgcatgaatgaaactttttaggtcctcctgctcttcatacaaagtagttgggttggggtcggggatgttgcattctttttgcaaaaagagaaggacaaatgaaatgctgaagtattctaatagtaaattataaagcaaaagtaaggtatttccttccttttcttcaccagatacggcctggtcatctgatttgctggctgcttggacattggtctttacccacttcttttctctgcaatccccacagcaacttctcttaaaagccaggcagtttagctaagaagcctttattacagtatctgtggctcctttttctggccctgccctgtcaaggatgcctgtggcttttttggtgattgagacagtggaaattactgagtttctagttctactccatgggtacgattgtggtcatgcttttcatatccagggtattgtagttgaaaggtctttttttggatttcttttgccatgcttaaaatgttttgtgttgtacaagttttaaatatataattactggcatattgtattttcaacaatgttatcaaccagtaataaggttgcaaatcatttagagctatggttttcacatgagaaccccaaagagctttggtttatgttggttagatctatggataattactacatttgaaattaaatctaagaagtataaaaatacttagtttatttaatatcaacataaatccagtacaagttaatataaatagcgtaacttttgttttttaaaacaaaagttgttgacaatgagtgagattccttcctatttttataaatctctttaatgcctggtttgagaaaacagctagattctcatagctacttctgcattcagtctgttacaatatgttatttcagttgaagaacatgaagaaaatctggtctcatgtggacatgtattaaaaagagaggaatttttgcatagccttctcagataatttgatattacatcaaaactctacaaggggtagcttcttaaaggttagtttcaatgtggaatctgaaattgtatgattgaaatttttgtgcttgagttcattaaactctattggtctatcttgcactttgaatggatcttttcaccattcatggttttataacattgttcattggtagtttggaaaatattggtttaatgagttacataaatctttcaaatgctggcatattttattttttttaaatttgtatttgttaatattaccacctatctaatcagaaagcctttaagtatcagaaaactgtcaaattcttggtggtagttacaggttttccaaaattcctattttattcgaatacttattttattttatcattggcaacaaaactgtcaattgttttcttggaagtaacaggcttattttgttcatttttgaaatgtttgccaaatactcaagtctgtataaccgtagtttttcagttgtttttttctcccctaggtaaaactggtggtctttgaaaaaagcctgcacctcagttatacctcagttatgcaatctgcttctcctctacctcgaatggaatggttactgacatttaaccactatctagaaggaatgtaggaatgatggcatagagaacacatctctgtatagacgggctactcagagccatttgggggaagcaagtactctgctggttaaatgcaaaaaacctaatatagttgacaatatgccagaaattatgtaaatgaatgttgtttccttcaacatagtgaccttggagacaggacaccacattcagtgataacgcgaatggttagaacgtttttagaatgccaccttatttggagttgcttcaagttatgactttaagtttactccatagattgtgtttggatgtactgttttaaagttgtaaggcctcaaatgcttgttaagttttcccaattatatctaaatatagttgactagtctgcgaagaccctgttgcatagtggagaaattgtggacacattttttagcaatttaggatatttatcacacaggacccagcaccatgcagagcaagcataattctcagagtcagacctgggtcctcacctccgctctgccactgactggctgggtggccttgaacaaagcatttgccttttcactatttctctgtgaggttaagtagttggcttaggtctcaagtcttttagccctcatgttcaatgattcagagattctagaggcatgacagcaggattcccttcattatctggggaggtagttcgtcgggggtttgctccacagccttcctgtccctttcagccagcctgtttctggcctaggaagacagcagacttcgtgtggttgtgattttttaaaggcagtgtttaattcttattacagcacaagagttcagaacttgggtaacagcatttgagtattgtagatcatcagctcctacagagataccctgtatgtttgaggttaaactgggagcaaggaaagttgggtgactagattaaggttggtgcaggatagcagggagaacaactgacatttgctgactgctgcatgcaaggcattttgttaaaagccacttgtgacagttgaatgaatcgcttccaagtagccttgtgagggaggtggtggaggtgatggaatgcaaattttcatagatgaggaagctgaagtttagagaactgctttaatttgcctgatgtaaagagagtgtttgagccagatctagttggctttttacaactggtttcccccaaatttctccttttttctgcatgccttcccagccattatattccatttttcatttttctctatgacttaagctgttctaaagtgttggagagatgtcacaattggacatcaataatctttgagaagtgctgattttataaactttaacatttataaacttaatttttaataaaggccaataaaaacttaaagaagagaaaatgctgatgttaagtcataggcctgtgttgaaatagatggcccagggctattagatatatgaaattgagggcagataagctttgggacaagcaaggacagaatgtgcaaatctggcattgaggtgtttacaatttgcctttccatattgagaacagaaattcaaattttggtggattatttgtttaaaagaactgttatcttttactccttcaacaagtgcattcatgtacctcctttatcctagtcacagcgataagccctggggataaagaggggcgggaacacctagcccagggcctctcagagccacagggctcccagctagcagcttgagttcctaaactctggatttcagatgtgtggaaatgcactgatggcaggttgttagggatggagatgtcttaaaggaatgttcggttatctctcctgaagggttttaaaaattgtggaagtcaagatcaaggatgaagatgaaatttcttgtggtttcttcatgagagatctcttctatctgtatagtccggaattctgagtagtatcccaaagtgtaccatcaagacagatgatagcagagagttgaatttttatatatattttatattgctaagcatattttttgttagggatttgaagtagttaagtcatcctcacagcatccctgggaatgacagttgacattaagctattttattgttggaaaaggaaattatggaggttacttctcactcatattttttcagcaaggaattgggaaatggaaagaatatattaagcatctgcattataggatgcccttgcagttacattctgaacccttgaattgttattttgatggaagggttacagttgtgtggcagagagcttatattgttggtgattagggagagattgtgtgctgccagacctgtttaggagtaaagggtagtgagagatttcactcttctgagaaatttgcttcagctgactcgcttgttttaggaccaacacactccaggcttatgggactggatctgggaggtacctgagccgttttcctggaggtggtgctggcaggcatcccagtgccaacttcacttcctttaggtggggagcagggggatttcctccaatgagaacaagcaaatgtgttctgagaagtgatggtttacaacagttggcatcagaagtacacaagtttactaccaaaaccagggaggagcagttactttccgattactaatagtttcctggtaaatatcccataaaatgtaattttgcatttaaaactgaaacttcactgaatcatttacataacatatatgtattcgatttatttatataattatgttttatcacttatctgtgcttcttgaaatttggaatatttttctttcaccagaagtgtggatttcagaagaagacagctatacttagcatatttccaattgtgaagctagtaaagttagcctcttagagtgaagggacttttgccattctcttcagctccctttccacttccccattctggagataaaccaagaatcagagaggttaagtaactggatcaaggccacgtagcctagtttaatattttgtgtatttaaaattttcataaaatatgaaaaaatgaaaaagaatgctttcgaaattaagataacaaagtttattttaacttttaggtttgggggtacaggttaaaacaggaaatgtgtgatcgtctgcactgagtgctaattatctacaaagtactgcgttaagtgcattatatcacacaatctaatttggcctgatgaattaaaggtaggtggtatcgtatgtatttgacaaatgagaaaagaaatttctttgtagtgcaggttcagttatagttcagaatcagtctcagaccttcagtgggcccagagtgttttgttggttctttttttaacacaagcacctcatgaccaccaccccctgcataactcgttgagccagttgtagccatcagagtggaagcacatccactgctgatttccttcagccatctgcacccaccttcctgtgtgtcccagggggttctgcctctcctatctcatctcttcagagagatttccttaatttccctctttgtatctttgccccttcttacttgtctctgtccctctgtgcctacttctattagtgtttaattgtatattttatgtagcaaatgcttacatagtgctttctaagtggcagacgttgtaaatgctttacaaatactaatgtacttatgctcctaatagctctctgaaataaatactattattatccccattttattttattatttatttatttattttgagacagggtctttctctgttgcccaggctgtggtgcagtggtatgatcatggctcattgcagcctcgacctccaaggctcaagggatcctcccacctcagcctccccagtagctgggactacaggcatttgccacccctgcccggctaatttttgtatttttagtagagacggggtttccccatgttgaccaggctggtcttgaactcctgatctcaagtgatcccccccaccttggcctcccaaagtgttgagattacaggcatgagccactgcacctggcccatagtaactactcttaacagagttaataacagagttagtcttaagagagttaatatccaacttgttgaatctgatgggcacttgtcttaccttccctctttctctgtagcatttgaactggttggttggtcacttccttcttctcttggtgtttgcccctaccttgttggctgactcctctgcctgccctctgagtgttgatattcttcaggattctgtccttgctcttttctcttgtcattctaaatatgcttttgggttgacctcatctgctgcaactttgtcttccttctgtttgtcaatgacttaaacggccatatctcagctcagcattctctcttgagctctctgctttcatattgtactgtctcctggagagctctgtgtgaatttttttctacacctctcttccataccaaataaataaatcctgcttctcttctgttccccacatttcagtgagtggtttttaccatctgctcagttacccaagccacaggcctcgttgtcatcccagactctccatccagaaacaagtctctctcttgagtatgtctgtctccttctttgtagcaccattgtctcttacctgaactcctgtgtgagctcttgaactggtcttccaggctccagtcttgtacctttctcttccagtctgtgctccacagtttagtaaaatgcacaactctcttaaaaagcgtagcttaaaaactgtggattatttgactctgttgatgggaaatttgccaggccatgttaccttggagggtctactctgaaagctggaacagatcattacacaaacaaggaattgtaaagctgaaaaggtgtcatcagtgtgcagttcttttgaatggtatagtattagcggagagatggaagatgctttaattccctaccccaacccaaaacccacccctcacttatgtgaataaagtcttaaggagcctatacaatcattgactcttccatgtttttgtggcaggaggaaggagtgttagtgatatactgagatgttaggtaatggctaattccacacctattttaaggcaccgtgtctggcattgggggtacaagtgagagacataaaaggcaaggtctttctttcttttttttgagacagtctcgctctgtcgcccaggctggagagcaatggcgcgatctcggctcactgcaacgagcaaggtctttcttgatgtgcccgcctagctggggacactgtgcacatttatagagttataatggggacattgaaatggtttatgatgaaagaaatattgaaatatagtctatatttacaggttgacctttaaacaggatatcattttttcaaagaaaaatatgaagaaatgaaaaagaattctttcaaaattaagataacaaagtttatttattttaacttgtaggtttgggggtacatgtgaaggtttgttacataggtaaacttatgttataggggtttgttgtacagattatttcatcacccaggaattaagcccagtacccaatagttatcttttctgttcctctccctcctcccaccctccaccctcaagtagaccccagtgtcaataacagaaaaattagatttattctacaagtgttatacatgattctgaaaggttaaaagctactaaataaccagtttgtatgtagccaataaaagttatttggatatggtgatctaagcaattttgagtacaaagtggtatttaagaacttttgccataagttatttcactgtcttaggatggcaggattttggggctgaggaaatttggcatttgaatgtgtagagctccagacaggtgcccagccaaagcacagagtgcttgtgactgtgcttttgaagtagaagagtgagatatgtggtctgtcagaacattttttgccaaacctttatttatattctttaggtttgtttaataggatagtgattttttcaaatgatttctgagtaattggcataaagtagggaatttgctatgtttagagatgcagcagatatgggggaggaaacttgaaaatgtgggtaggtatagtatgatgcaagtattatccctgatgaaacctaattatttagatttccttatctggatcataattttattatcagctgatttatagtagttaaactcattaagaccatatagatgggtgggtgcagcagtcttaggccttagtaaacactgtattttgaaactgagtaggtgcctggttctgtttgtaatctttgattaaaccaagcacaaaattcgaagcttcataggtaaacttaaattattttcatcattctcattatgcaaaacaaatgtcatgtctggtagtagcttgtcttctcactgcacttactttttcttatattacagtctctttgctaacttgacatgtacttattgatctgtgatcaaaatggacacaatgtagaaatttatgactacttaaagtgtgatcttttttcaaactgaaatatgaagtttacttacaagttagattgctgtcctaatatcaagagtcttgtacactcatatgtatgaagtacttaaaattagaattggttagtcaaatgatttttagggaaaatatgtgagccagaagcatgtcattacagtcaatgctcaatgatgtagaatagcatggtggtgcaaaaaaagtaataaaagaatttgttacaaaatgctttgtattgtagttttaaaaaaagcaaatgtaacttgtaagttaattactgatagtattataaaagatgtttcttgaagttagttttcccccagtacatgactctctggaggaaggaaacccagatgactgctggggaataaggagagaggccagtttggggttgaacctttgttgaagatgtaggaagatgttaagttaaatatacagagtttgtggataaaactttgtcttttatcatatgctaatatgaatgaagacatttaatttggctaaaagatggcatgtttcgctgtgtgatatttatagttttgattatggtggcattgtagaacctacttgcattaatgataaatgtaggtacagtagaccccctgccccaccccagtccaagtttttgctttccaaggtttcagtttcagtggtttcagttacctgcggtcaactttggtatagaaatattaaatggaggccgggcgtggtggctcacgcctgtaatcccagtactttgggaggccgaggcgggtggatcacgaggtcaggagatcaagaccatcctggctaacatggtgaaaccctgtctctactaaaaatacaaaaaattagccggtcatagtggcgggcgcctgtaatcccagctacttgggaggctgaggcaggagaatggcgtgaacccgggaggtggagctttcagttagctgagatcgcgccactgcactccagcctgggcgacagagcgagactctgtctcaaaaaaaaaaaaggaaatattaaatggaaaattccagaaataactcctaagtttttaattgtgtacccttctgagtagcatgatgaagtattgcattgacctgcactgtcccatccaggacataaattattcctctgtccagcatacccacactgtagatgctacctgcccattcagtcactttgtagccatcttgtggttatcaggtcaactgtggcagtgtcaacgtgcttgtgttccagtcacccttattttacttcagaatggccccagagtgcaagagtagtgatgctggtgatttggatatgccaaagataagcaggaaaatgcttcctttaaatgaaaaggtaaaagctcataaagaaaaaagtttgtgtattgagatatacatcttataaataaatcataagtattatttatggtaagaatgaatcttctatcagttaaattgtggggaaggaaaaacaaatttgtgctaattttgctgttgtatctcaaactgcaaaagttacagtcacagtgcctgataaatgcttagttaagatggaaaatacattaaatttgtgggtggaagacatggatagaaatgtgttccaactgacggcaatggggtttggtactgtgcatggttttgagtgtccactagaggtcttggtacgtatccccaggatgaagggggactactgcatagaaaaaatgtttcccaaatttgttataagttgaaatgactgtgaaatattggatatgcaactgttaactctgtatttcagccttaattccatctcctttgtcaaatataacttgatttgaaaccaaaatttagtgtcatagtcactgaataagttacatttgttttcttcattttttttcttcctgtaggtttacctttttgagattgggtgcagttttccaaaatactttttctaatactcttccaaagatctcaaccttcctttacagtttgaactcctgtttgtattgcttgcttccctaatggaaatctgaatttttataattcctgtgtatttcttttttgcattgccttaacaggcatgggtcttcgaaagccctggagctccctgtgtggcccctgccattggtatgctgtgatgctttgcctgtcctgtgctcaggtttattcatgatggataagactcccttcctatcacatgtgcactgttctagcaaagagaatagacaaattcttttcagttgtgatgttgcccagggttttgttttgtttttttccctttaaggaaaagaatgtcagtggtgtatatcagaaaagactgtttacaccctttctatcccttgcctttcaaaccaggcaggattcagtacacttttaaactcccccagaatatgaaaaaagatcccttttcagctttccagaaattttttaaaatgtagaagaatgtaggaaattgccaaatcagttagttaatcagtgacaactgcagtcagtacacgaagagcacgcttcttacaagagcagctagctgtttgctgctttctcagcccctctgcatgcttgcccttgcctcacctctgcatcctcctccagaggttcagtgtcagccttataggagctggtgattgccacggggtccccagacagagcatggccacagggcagctccttccttcccttccttctgttccaccctcactttttgtaggcttgacatcacctggagcttctgtgtgtcaagtcagtagcttgaaataagtctagaataagtgggaaaatctttcctaatggtgatttttttaaaatcaggctaataaacatggtgttactagcctttatacaccaccctgggctttacaaaacccaggatattttataatattaagcaagatacatactagcaatcagcaaattttgtaaaatatacattactcttccataagtctgcactgtaagcattcttgccaggtgggttgaaatacatttctgaaatttaatttttttcctatccaaaataaattacttaaaaagttttcatttacttatttctagacctgtctcttcatttgattttcttctctaccatattacaattaattaggataacattcaaaagatatgagacctggtgcagtggctcatacctgtaaccccagcactttaagaggctgaggcaggaggattccctgagcctaggagttcaagaccagtttgggcaacatagtgagactttgtttcccaggaaaaaaaaaaaattagctgggtgtggtggtacacaactatagtcccaactacttgggagcccgcactgggaggattacttgagcccaggagttgggagactgcagtgagctatgattgtgccactgcactccagcttgggtgacagagcgagaccctgtctcttaaaaaaaaaaaaaagatatgggatagatacacatattttatgtagctacatatgtgatctacacctaggtatggtatatatagatacatgtttgtcttcatttctcttttgccatacaatgttgagtacttcaggtgctattagaatgtgtgcccatctgttcctaggacatgttgtgtacatggaatgaagaccctgctggacatattttcttagtgtctgcactgcggcagcaggtcagctgtctccacgttagggtcaaggtgctggccaccttctcagtgggcttagcctttaggagttagcttcagagaggtatttgaattttgaattgcagggtgtaaaggacacaaattttcatgatccttgtgcttttgtggcataatttatgtatggggtaatatactccttttgaccactttggaaaaagctagtgctgtgggcatgcacttagtataagctgttagccaagtgctatttcattagttgccttgaaaggaaacgttagcctcaatactgcatgaaggaacaaaagaacagctttttttttttatcataaaggctactcagaatatccagagtcttcaaagttatgtagaaataactgaaagatttctgcaagaaacctgtgaaatagtatgttatgtaacatagcattagatattaatgttaactgcatttttttgacttgcacaaatgattggcaaacagatgggcatatctttaaaattaaaccatctttagatacccactccttgtaaactgttacagattaaatttgtcactaagggctgttcataattctttgaatgaagtcagtattgtttatttgtcagacacaaatgtcaagactactttctttaagtgacatatctttgtattgctttataatattctttgtaacatgtgccatttgttgttgatccattatattaactgagtggtcagtgtgctatcctgtaggaggagctcagagtctgagggcaggacttcccaaactttcacatgcacaggaatcacttggggcctttgttaataaaggcagattctggtgcaggaggtctgaggtgagcctgagagtctgcgtctcttaccagctcccgggggtgccaggggtcctgtctctcaggattccacttcacatggcaaggctccagtcgccagaaagagagggaggtgaacacataagaatagtagcgtgcttggcacttttgtagcttctgcccatgttgatgtggtggtactgctagcaagggctttgaaatcagcctgaagagggagggttgagggtcaggaagcttccgaagatgggtgataacaaaggaactgagatgaaaaagaggccagcctctacagtgaggggataaggaggccagggaagagaccatgggtgtgaaggcgaggaaggtatgagatagctgatggatggttggtaaactttgagtagtttgatatacctaatgggggtgtttgtgagtgcttcaggggatagagggaagggagttaagggagttgagaatggacaggtcaataaggatttgattattagtgccttcaagcatgctggagcatttggactggaacctgaaagctatgggaggtcctttaaggattttaatcagggagaggtatgatgtaatctgtgttttataagatcattcaatcagtagtgtgaaagcgttgagaccagaattaggagaactgattagatttctaattttttgtggttcactaaaccatgaaggtctgattacttcagagctagtgtaaacagggaggaggagttagacccataaatatctgggagagagcattagcaggttgggaaatgcactgaatatgtgggatgtactggggcgtttattcaaactgcaagctgcacgaggacagggccacatctgcttcgttcaacactgtatacacagtgtctgttaaccttgaatattttttaaatgaatgatgacaggaaggatctaggcttatttcccattgtttggctaggttgaagaggtggatggagatggtgttactgtcatagcgaatgctaacataaggcgtagcgttgccctatacgatgtcagtggttttccttattaaaaatgtgtctcttctgttaatatcagcaaaatgggaggtaacctagtaatatgaatggaggttaccagtacaatccttattactatttatggttttatttttaatatgatgcttggggacaaacagaccttagaaggacttcacatacttcttttttttctaaatctttttctgaattgtgtatagttgagaattattcctaacatactgaaaattatttatgaagaaataagaatatatgttgggagataatacagaaaggagacataggttgtaagtatagttaacataaaatatgatatatggaaaaaataacatatatttcatcccaaagggtagatatggacctttaaaagaatactaatctctgaaagaggagaaaatattttttatgaaagaggattgctgctatttaatatggtctttgtttaaacatgttacctctaagaagaaatacataggagtgctttccatgtaattttctgcagtgatggaaatgttcattataggcactgtcgagtaggtagccaccaaccacatgtggcttttgagcacttgaatgtggcttgtgcgactaaggaactgaattttaagttttatttagtttaagtagtttaaataacaacatgtggctggtggcttctggattacacagcaccgtcatagagtattggcaatgccctagcatactaatgaggaagaaaatgtggtcttggccaggaagaaaatgtggtcttggcccccttggccaacccagggggttcaggaagggcatcatttgacccatgaagcaaatacggaaaatactttgtggtgaactgataagctggtgttggtgacttggggggcacttcctgattctttatccaggttcttgtcagttggatagatgtctccttcatcagcaagcattggtcctgctagatgttcccaagtggctgttgggggctgggttgtgggtggggcagtgggaggagattcctgttaaccggattcaggatctagctgaaaggactttcactttgagtggaagctcagcagtgtgagccctttgtcttcggtctgtccacctaccagtgtgtggattctttgcctctcttgatatgttttgcagccttgatgattgagaggtgtctccatgggttatgatgagggtggtgatgtgctgtttttttagctgcaaaatgcttccttggaaattctgattcatgctccaccctcatccccagaatcattatcacagtgatgttctatacctcacgctctttggaggtggaagagagaaatttaaatagaacaactcaaaatcaaaccataagcagcaaaatagtcttcagtatccaataggcaaatgtcctatgatttcactcttgcccacgtgttggctgtttatcaaaaaagtttcccttggatgacattttacttacacaataggacaaatagtgtttgagctataggagatactttgcatgtgaaaggtgttacgtattcacctatctccttgctaggtttctagtccacacctgtgacgctaaaaggttctgcgtcactacaaaattaaaactcagctatacaaatgccattctactttgagaagagtgtagtaaataattgtttatattgttttggaaggtcagaaaatcactatatataaaataaatttaataagtaaaaatttaacatgtgttataattaagaaattttatatatacatatatttttcaaaatattaatattttcagtgacatttctttcatcttggtttcttgcgcacccgttgcttttatcattgattctgtctgtgcttggatctgcccgtttttcatttgactatttcccaataaaatttaccaatagctccaatttggtgttgatatatgcttgtttcctaaaagttatatatagtatgatttaaaaacatttttggaaaggaaattcacttctatttgctgatggcagcagcagttttagtgattctctgaataaaacagacttgatgcaggcctttaatattttgtcctcactagtaagctgctgtttcattcattcattcatttctttcatctttgggaactgtcactaaaatgttttgtagaagaagtttactcctctcagtctataaaaggatttttttcatctgttaaatgaggaggggtttggattagaaggtcttcagagtgcttcctaactctgaaatgtttgtaattggtttcacagtgtgcctctaatgttgatgattctgttagttgagtggtctcgttgtgacccctcctcacccccaaacacatgcatcttctgaactgtcctttagttcacatctcagaaaatgctggccaatagggcactgagtagaaacttgaattactatgtctccattatatgcataggtaccgtttgctacatattctcacatttagttagactattcctcatcagaagttaccgaggagtattttgtaaaatggcaacctatatttttaataacataagccctgaatcttagttcttatttaagagatgcatcatttacagatatataagctccatgaggacaagagggaattttgttttattcacagatctctctccagctcttagactagtgcctggatcatagtaggtgctcagtaaatacattttgaataaataattgtgatttgagagttaatttttatgtaacaccaaataaaacataaatgcaacttgaatgtttattacccaggtgataattatgagactttaaaaaatttcattgctaatttgttatttctgtttcttctttttaaatactttatgctgtccagtatggaagccacagccccatatgtccattttttcacttgaaatgtagctaataggaattgagatgtactgtaagtgtaaattacatactgggtttcaaagactcaataccaaaatacgtaaactagcttattcatttttttatattgattacctgttgaaatgacagtattatgcatttattggtttaaatagaaattggtaaaatggatttcactcttttggtctactattaaaatgtagctactagaaaactaaaaattacatgtaatagctcgcatttgtggcccattgaacagtgttcatctagacacagaaaatctagatattgagtgtagacgagagggaagctttcaaaatagggctttgaatgaatatcttttatagaaacacaaaattatacaatgcagctgcgacttgggaaagtgggcattcagatggtcttgatcaaatttaaaaaaaggaccaaaacaaattaattagattatctcaaatcagaaatatgaaatgcagctaccagatggattcctggcatagttgccagctgggtcttgaggtcagaaaaggggcaggaaggcgttggtggctgtcccagtgagcggtcactaatggcagactgcaaagccagtttttgaacttctctgcctggaccttacctgagcatggttgtagttgtgccgagcgacatgcttagttgataccatataatgctggcgtttttcaagcgtctgggagatggacacttagtagaagggcgtagggaacaggaagaggagcacagccaaggatcagtatgggtactctcaggcagggctgtttttccctactcatgcgcataggcaacttgtccctcttctgaatcttaagctgataaaaagttagcaccaacttcatcgccacttctccaagcttgatctgactctgcctctgcctctgagctcagtgggcttgcaagagaaggtcaccagtgggctaagccatccactccctctgggctcacttttacctggagctggcctggagccccatcgagtcagtagcatttcttcccataacagttggcggaccctggaggatgaagctgctccccaggacacatatgtagacgttactttccttaagctaatttgaaaggttattttggtaagtggttgggctgcatggctggtttaagctattatcaagtccattccagtatttatttctttgaaagttagaatgagccttgaataaatgatgactgactgcttagccttcttaggagtgtatttaagaatatttgttgcaactggcactggagatgtctacttctctttattttggattttaaaatagttgtatagtaaagcagcgtgttttcagtaaaatagctttcatgctcaccttattttcacccatctgacctctgtatttggagaaagtagatcagaaaattcatggcagttagcggcagagtgaagagacctttgactttagttgacagctgtcacctgaaaactacaggcctggagaccctctcaggtgttatgtctgtagttctgacagtgaacaggaatgttgtttacattttctgtaagcaaaattctccccttgttaggaatgtgttagaatacggcaggcagaaacagaatttttatgtgtcttactggtaagttctcaggagtgttggttagcccattgttcattcccatgctcttatggaagggtgtcagtagaatttatgactgagcctgtttttatcatcactttggaaattcttcaacaagatattgtttttttcaagtgagctagtatcacacaatgcttaatgtccttataaaagagaaaaaaatgagttaaattccaaagatgtttaagatttcagtcattttctctatatgaattaggtctttattaggccgttgatttaattagtgttcaacaaaaacactttcctgtttagattgtcaacgcattctttaaattagttattttaatctgacacaggatctgttaggaagagtttgaataagatgcagcatgttacatagtgtacacagtgcgctggaagcacgtagggtgcgaacacaagtgcctgccaacttgtctcccttcctgcttaggtcctgccttgtcccaaaaggacttaaggcaatggtgaggagagcatattttgaactttattctgtaaaaataattttcagttttggagaaagttgtatttctagttatgagaatagttggtgtccacaaagtatccactcaactagttttctctgagtggtcacgtgggattctggtccaccagagcccagcatgcctgcgggtgaataatgagcctggtgattgggctgctctgtgtcagtgcagactgggaccatggtaggctcagagccatgagtgaaattggtcgtcttggacaatgaaagcttttcttttagtttctttctgaatcttgtatatttctgccattaaacataatgaaattatgaatttattgtactgttctcaaggttgcttttcaacatcattatgaacactttcttgttagatgcctctgttgcagttacatagttgtatgtgggctgtaaatatctaatttgtatgaaatgaccgattttggtatttgtataatcctctagtcaatttaactaacttgagcttttcacagcccttggtgctgctgttgctcatctgattacaccgctcaggggaataaggttaagggcgggctgttggtaaccagagcatttccagggctttagttcagcagatgagctgcttggctatattcatacatctgcttgcctgctgtggcagctgctgctgcttcacgttgtgttcttttgttctgtttcatccaagaatggaacgctaggaagtgtagtgaatggattaatttaaggttaaggttagtgttttgcttgctttctaagtaaccgatcataatgatgcttctggtagaagctaatgagtttctcttaaagtgaactaaatttataaaatacagctcagcgagggagctagattcgtattgttgatggggaccaaattcagatgtacaaaatactggcagtttttatcattggatcctaattctttgttttcttccttcttctcccccaccccaaactcccttccaggacctatatccagactttgcctgacactgcagggtccaagagaattaaagaaatatggaatgacatgaagaagattagttaaggattataggctttgagggcaaacacctcagtgaagtgaagcacaggcaagctcctgagctgtggtttggaggagccgtgtgttggaagaagatggcagatccaggaatgatgagtctttttggcgaggatgggaatattttcagtgaaggtcttgaaggcctcggagaatgtggttacccggaaaatccagtaaatcctatgggtcagcaaatgccaatagaccaaggctttgcctctttacagccatcccttcatcatccttcaactaatcaaaatcaaacaaagctgacacattttgatcactataatcagtatgaacaacaaaagatgcatctgatggatcagccgaacagaatgatgagcaacacccctgggaacggactcgcgtctccgcactcgcagtatcacacccctcccgttcctcaggtgccccatggtggcagtggtggcggtcagatgggtgtctaccctggcatgcagaatgagaggcatgggcaatcctttgtggacagcagctccatgtggggccccagggctgttcaggtaccagaccagatacgagccccctaccagcagcagcagccacagccgcagccaccgcagccggctccgtcggggccccctgcacagggccaccctcagcacatgcagcagatgggcagctatatggcacgtggggatttttccatgcagcagcatggtcagccacagcagaggatgagccagttttcccaaggccaagagggcctcaatcagggaaatccttttattgccacctcaggacctggccacttgtcccacgtgccccagcagagtcccagcatggcaccttccttgcgtcactcggtgcagcagttccatcaccacccctctactgctctccatggagaatccgttgcccacagtcccagattctccccgaatcctccccaacaaggggctgttaggccgcaaacccttaactttagttctcggagccagacagtcccctctcctactataaacaactcagggcagtattctcgatatccttacagtaacctaaatcagggattagttaacaatacagggatgaatcaaaatttaggccttacaaataatactccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctcctccacaagtcaggccgggaagtgctgggataccaatggaagttggcagttatccaaatatgccccatcctcagccatctcaccagccccctggtgccatgggaatcggacagaggaatatgggccccagaaacatgcagcagtctcgtccatttataggcatgtcctcggcaccaagggaattgactgggcacatgaggccaaatggttgtcctggtgttggccttggagacccacaagcaatccaggaacgactgatacctggccaacaacatcctggtcaacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcaggtaaggggacacagagcctacctctgcattgcagtgtgaaattcaacatggctaacttgtctgatcgaatttttctttaaactctatgaaaagctttttcattatgagtgccttaatttttatttgttattggcttatgcatttattttattcaggcatcaatctccctgtcccagggattgtgctagatgttaaggatatgtagataactaagactgggtccctgctgacaaggagctgggtcaccgctagcagggagatggacagaggactcagaatgctcacaagacaaacgcttttgtttccttctctcaattcttctttattctttctctttctttgtgtgtgtgtgttttaaaaatacactgacacttggtttctagcaaagatttatgcgtgtgtggtagtctcctccatctctccttttatattgtgatatttttcttgggaagctgcaaatcgtatacttctgtgatacttattttactaactgttgactttgttagtgtgagttttaattgcaaactgtagaaaatcacagtaaatgataattcacagaagatgtttggtctctaaaagatttggatacccagcactgaagtagggaatcttccttttttgtaagctgacgtttttgttatcattcagaatttataaaagaacagatttaagtttatcatattcacaaagacatctttccattataaattttgttgtttatgccctaggtctgtgaaagataaattaatgcctgtgtatacagattattcttagtgctattcaaaaatatatactgattatctaccagaattgcagctctgtttttggggtgcacagtagctgattttagagctataaagcatagtgcttgttttgatggacttattatcaattttggggaaataagacttgcatgtgaaaatacagaggagtgagagaccaggcatgattatgtgacaaatgtccagagagaggaaataacctgtagttgagagtgcttggaatttggctaggccttaccccggggaggtgaacccaggtcagcagttgagactgggggatggtttgctaaacaagggcacgggaagtcaagcttgctgcagggaataggttggaaagtatcagtcagggccagattgttgtgatcttggattcctttttaaggaatttggacttaaacggggagggagccagtgatattgattagacagtccacaggacagatggagaaggagaagatgaagtgtgaacctgttttctaggcctttgaggacagtttggaccagaaggatcaaagtgggagcagaaggcattgaagcagtgttgaaagtaaaagggtttagtcagtaaacaaagccactcagggcatctcagagcagcattttttttttttttttttttttttttagtggtgataattgtcttctatgctttttgtcagttcattaaaaaaaagaaaaaaaaagtattttaggccaggcacaatggctcatgcctgcaatcccagcactctgggaggccgaggcaggcagatcatctgagatcaggagttcaatgccaaactggccaacatggtgaaaccccgtctctattaaaaaatacaaaaaattagttgggcatggtggtgcatgcctgtagtcccagctgcttgggaggctgaggcaagagagtcgcttgaacctgggaggtggatgttgcagtgagctgagattgtgccacttcactccagcctgggcaacagagcgagactccatctaaaaaaaaaaaaatttttttttttttaattttagattcacgcaggcatttaatacagaggctctgaagcttcgtcctaagctgggctgagggagtggaggtcaggaagactcctgggaccacaggacaagtagtggcttcagggaagctgccctcagccggtgggcagggcagcttccctgaagaccttggtgatcctcatataaccacccttggtgattcttatataacctcagggcagaacgcctctcctcaaagcggaccaaaagtactgtctctgaggccagcagacctgggtggcttttaggacagaaatgaatgtgacttagtttttaggaattattattttcttattccctggaaagtttcttactaagcaagggatattttagagcagtggtttctcagacttctcattccgacatcctctgtcttcaccggagggtgagcacagtttggaagacaccctgtgattataatctgatccctggatgagaattgttgctctcctccagctttcctgggttttaagagtacagatgcctcagtgggcatttcagaggacatgtgtgagtctgtggcgtttgaatccttgaccagtggaggctccatgcctgctgtgtccggtgctagacttcaggagagcccacatgcattccctccttctttgaatgtgtcattataggcaaactcaggacctttacagggatgtaaactaggacatttgaggtattttcattctaagtacaattatgttttccattttgctcattgattatttgctttcttatttctgcttaactttgcatcctcttcagattttgaaacactcagttttgaacataaggctagggaggtgtgaagtctcaggcacagaacatagactttaaagttagaaagatatgtggaccccagctctattgcttattaacctggtgatcttaggcaaaggatttaacttctctttacctcagatttttcattagttaagcaggaaaaatagcacccagcacaaagggtgttagattaagtgggcttaacatataccgagtgcctagtataatgtccactccatggtatatatgttaattctcctctaattttagcttctgatctcctgaagtgcaaaccttgctacataattatgtcatttcccatgtagatacaatgtaaaattaactttatttatttattattttttgagatgaagtctcactctgttgccaggctggagtcagtggcgcaatcttggctcactgcaacctctgcctcccaggttcaagcgattctcctgcctcagcctcctgagtggctgggactacaggcgcgcaccaccgtgcctggctaatttttgtatttttagtggaaacgaggtttcaccaaaattaactttatttttaaggataggttaaatattatgtaatacagccttagttatgaaataactaaatttgatttgtgcaaatattatcccccttttagactgtgttgccacatgtgaggaggataataatatgggtaattcaaaatactatcctatacctttaaaatctctctctctgaatgattgacattctaccctaggaaatatttttatttaattatgttttgctttagagctactaaaattattttgcattttatatatgatggagtagtggctcaatactataccaggtatcagggaagataccagattaggttgaaatgtccatttaacttgataatgaaaatatcactttcaggtagacttaactcttcttgagtttttcgctttttaaaaatagaaattatgttctttatgtgtttcctggcttctgaatggatattttctagattatggaacacatttaagtatctttaaagataagtttaactttatattgaaaagtcaacaaagaaaaatgttagaacaaaaaggccacagttcatcagatcacaatgtgaaaaattacacattttggtatatggacatttctttaatggaagtgctagacttttcgattatttgataagatttacagggaagggaaaaaccctagcttatatttctttttcaatagctaattagaacagtttttctcaaacttttcatctcagacctctacacattcttaaaaattactggggactccaaagagtgtgtgttagctatgtgagttatatgtattgatatttactgtctcagaaagttttaagttttttattgtttacctatgtatttatgtctttctttatttttgagacggagtcttactctttcgcccaggctagagggcagtggcgcgttcttggctcactgcaacctccttctcccaggttcaagcaattctcctgctcatactccctagtagttgggattacaggcacccgccaccacgcccagcttttttttttgtatttttagtagagatggggtttcaccatgttggccaggctggtctcaaactcctgacctcagatgatccacccgctgtggcctcccaaagtgctgggattacaggcatgagccaccctgcctggctaaaatattgatgaaagtttaaaatattgatttgttaattatttaaaaataataaaccattatgtgttaacatacataatactttttaaatgaaagataactttttaaaaaatgaaagataagttttcgcaagacaaaattagtggcattgttttatatttatcaaatattgattttcacatctgcttctgaatgtagtctatgtgctagtcataagcctctggacaagtttacagcttatttggaaaaaatgaggatgaaaaagcaaataacatctcaggatcatgtagaaatagttctggtctcacagaccctacagaaaccctggcccacaattttagaaccactggtatgaaggaaagagtacaggctttggagtctgagtttttgaataggagcaccaccgcttaacgtcaccacctgacgttagtaagggtgtcaggacttcatttcattatctctgaagtgagggatcatatgccttcctggttagaggctcagtgagattagtagtaatgtcttttaagtgcttaacagtggggactcaaaaacaatacatctagcaagtgttcagaattgcctgttgcagagctttaagaagaatcttacatatttcaatgtcaaacattttcatagttgtttgactttacatccttggttttagtgaacacttatcaaatattgaggcttcgtatgtgcttttctttgagggagggagaacaatcttgctgtgtgagcaggaagatgcaggcaagaatatgccatgaaaagcacactgtagagatcagcactgatctttaaagtcattcttaaagtgggcgaggtgggggtctgggagggctttctgggggcagtgatgtctttgctgagatgtgaaggatcagtctaagttgagagaaggatggataaaggagggaaaagagtttaagatttaggaaacaatgagtgcaaagatcagaaagccctttgggccttgagtgtccctagtattgctggaatgtaggtctggggcttagtggacagaaagctgcatggtcctgggcccatggcactggagggcactaggaggtgttttcagcatggacacagcaccatggggctctttgcagcacccaggagtacgaagagggtggagagggggtggaaccaaaaatgaaaggtttatcagtacactgtgaacatggatgagaacaatctgcaaggaaggcacagagcaacattttgttcatttgaagagcttatctaaagaaagactaattaagtggattgttcttaaggttacaggcaagtccctgagtttctggatagaatttacactgcacagtccatagacgtgtcccagatcatggattatgctcttaaatggaaagttctagttgaatttttaggatctgcaacaaggtgtccttaaaataagtttattttggatacatttgtacctttttcattaatttggtcctgaaataacagtcatcatgaaacggaagtagaaaaaaaatttaaaagctactaagattgaggtgataggtaataatttcccatctcctcattttcccttgagattaaaaaaaacctggaagaatcagtggtacaatttttttttttttttttaaaaaaatagcctttcagggaaaaccttttattggtaaatctcaagtagcatcaatcttatactgagattctttaagtttacccagtaaataaagaattacaaggccgggcgtggtggctcacgcctgtaatcccagcactttgggaggtcgaggtgggtggatcacaagatcaggagttcgagactagtctggccaacatagtgaaaccctgtctctactaaagatacaaaaattagccaggcgtggtggtgcatgcctgaaatcccagctacttgggaggctgaagcaggagaatcgcttgaacccgtgaggcggaggttgtggtgagccaagatcatgccactgcactccagcctggtcaacagagcaagactctgtatcaaaaaaaaaaaaaaaaaaaaaaaaggaattacaaattacagacatgggcagagtaattggcaactaagtaaatttatggaaaaaggtggctgtgtttcttaaggattacgtatgcaggttgtaatcagaaatagacaaaaatacctttttaatggagagcagatgtatcttgtcaatactacctttctcacttctaaagacatctgggaaagatgggaaaacaaaatgtctctaaaaaaaaatcagcttttacctaagtggtattcaggggcttttgcaggtatatgcaccttcagaaaacaggcacccaggctggacctcattggagcaggttgccccatctggtgctcacagaaggaaggcaaaagaaatcactgctttctcacttgctgtggcccactgctagttcttcatgacatctttagttaaagcaaaccatccagcctttactggtctctctttcctgggccataggttgctctcaacagcctgtggtttctcacgaagactcttaaagtatttcttttgactacttcaatttatatatactacagcttattgagtaacctgtctgcgtttttcctcaacatccaacaagctggtttatcccagaggtcagaattataccaggtgtcaagttaaagcacagggaaaaatctactccatctgtcctttcaccccatagtctgaaagcatgaatggctgatagcctcgctccttagatggcttttattttgtaaaagagtattgttttatgtgacatcaaaaattttgtaggtgataagaatttagtttgttagtttacctttgaagcctggatattaggcctctgctaggtgtcccaattgatattcttaaaagaagccacttttggtgctgcattttcatcttggtgtcttaggtaccttcatgaaaggcagtaccacatgaaagaaatacttatttagtgcctgttatgtgccaaggactgtgttaaggagagattgctggtatggtggaaggcagggaggagacagcaacctccaccgaggtggaaagggaattttgttatttaagtataacatttctggctgtcctatctttgtgtacttactatgttctagaccagaactgtccagttatatgatgggagctacaaatacaacgcatttatgttgatacagattttctggtaaccacattttaccattaaagaaactggtaaaactaattttagtaatacatttaattaaaccaacatatccaagacatttcaacatgtagtcagtataaaaaattgcttgtgagatattttacgcaagaatttaaaacctgatatgtattttacacagattgcgtgagctgcatctcagttgctcagtgaccacacatggctggtggctgcatattaaacagcacatgctagactctttccctatcagttgctgcaaattctttttaaaaacaagtcagagtataaataattttattcacatgtaaataaatgtaaaattgttagtgtaattatgacagtcatcctccaagacaggtgttacccacctttgctgtaaggttaaggaagtagtagcggtgtttttaggtataatgaataaatgcagtactagggggtgtgcctgtgttagggatattagtatcagttcttgacaagatacgttattgaagtttgatttcatttgtttgagtttcaaagaaggctacataaatggtgtttgtcctgtgggaaaaaatagcgtgtttgtctgaaaggtggattacagacattttcaagattttagttttgagtggcgtttggatacttttggtagttaattcctcacctctatcccctagctttttgcctgtctctaatacaattgcttgtttcttcatgaaattgactctccaggataagggaaaaagccttcatttttattaatatgcatgatcccccctccccatttctttcacttttttcttctgtgctgcctttttcttccctgttataataatctttcagaacggcagtctctggtacagcagagcaatagttggctgaggaagaagaattgggaagtgggttagggggacaattaagggaacagcattgtgagaactaatctggagaatttaccctagccttgacatcttaatgttattttctattctctgtagttacagctgtaaatctatagataatccttaagtagccatgcagagatggccctggtatttcctttgttgctgaatgcagctcttgtatcagtgaagaaagtcagtagcaaacttgtacttgtccttttgccttgtaaaactttagtagtttatggtgtgtcaccaggagtgaggttttattttgtttttccttcacttagtgtaaaaaatggaggagaaccttcgagggctaggacatgactgcaggagtggtggagggctaggacatgattacaggtgatggagaacttgaagttggcaaaatgccaagaaattgacagcgttgcatttaaaaaagtcaacgtagatacaggactacctgcatcatcttgcttgttttttatcctggacaatttccaggacgatgggagtgatggccagggaaggctgcaaggcacttccttacctcttattttaaagattggatcaaaaacatgcctttttgatgctgtttaatattaatgaagactataatatttgtgatattctttaaagtgtatttgtcctgttttcctctactgctttctgtgtttagttctaaatcattctgtaccataggtttcgggagtcctagacgttaaccttaactatgttaactgtgtaacttggctcactgtgtgaaagcaaaaaaacaattgttttagggtgtaagcaagtgttattaatcttaaagagtctttttgtttgttttggccatgggtagaaagcattggagaatattgaggaggtgcaagcagtggtgctgggagactgtgtggagggtttttcgaatggcaagtgttctagcttaacttatgcctttcctgtctaatctattcatagactggctgaaacaggtttgcaatattagcataggaattccactctcacccatttggtgggctgtgaagtgttctggcctcttgccagcggctgctcagtttaggcagttgggaggttgcagggtgcatatcctttcttgtgaacaggcaaagaactttagatcattctttttctgaaaactttttgttttttgaaggtatgtatctaaatgtgctctttaatgaaaggggagggtatagacttaaaattcttattgaatatagaaatacttgacattaaagtttgatttttagatcatgtttcttgatggactcttgtaacttgaagattttcttccattaaaaaacaataatagaaaattgtgggatttttgcaatttgtgatgtgtttgttttcactgttatttttaaaaacaagtctagcatgaagagataccaagtttaaccactttggagtgtgctagaaataaactgtggggaactaacttggagaatttaccttgatcttgacatcttaatgttactctccattctctggagttacagctgtaaatctatagataatatctaagtaaccacagggagaaatggaactgggacaataaataagtagaatatgctgactttgctttaaattggcccattactaagctaactccatttttggctgctcaaatatgtcagagacatttccctgaatgagagctattgaaatgcatgaagacatcccttggattaaaggagataagtcagagttttttagggaaagtgttttatttaagtaagatgctaagtagtatttcatttttgtcatcgatttctctgaatgtttttttctgttcactttaaatatatttatccagacagtggaacatgtcaagggagtagtcatcttcatactggaataaggcgctgtgggaacccctgtgctcagtgtcctgcctaacctgacctctgatgcaacaacgtgtctttcttacttgaaaatcatggtagaagacttagatcaaagaaggaaataattcagtctaattttggaaaacatctttccttagatgtgagcttaaggcttgcagttttactttttgcaagaaagttcaaaaccaatattcacacataaataaggtctctaagctaggatatcattgatgaagaaaacaaacaacaacagtaagagactagccattcatagaataaaaatgagcccaataataagatcagttttttgttttgttttcttttgttttgttttcttttgagatggagtcttgctctgtcgcccaggagatggagtttgcagtggtgcgatcttggctcactgcagactccatctcctgggctcaagtgatcctcccacctcatcctccagagtacctggggctacagtcgcccaccaccgcacctggctgatttttgtatttttagtagagacggggtttcaccatgttggccaggctggtctcgaactcctttcctcgggtgatccacctgcctcagcctcccaaagtgctgggtttacaggtgtgagccaccgcgccctgctgcaaatcattaaatcagttttaataagctccccacgtcaaagagccatgttagatgctagagtggtatttcatactgaatataaatttaattccaaagtaagtaaatgcaaagagacaagtgtcagtttatttctttcatttaatgttttctctgtcattttttaagcctctcacccctccactattctgtgtagtggtcacacactaggtggagctgccaggactctgcccctcactgctagcacaggttgctgggcaggcaagagcacagagttgtgaagaccacaggcttcatatacactgagaactccatttaaatgtggctcttccatttttttcttaagtcatcttaaatgatacatacttaacttccctaaacctcagtttcttgatacagtgattgtaccgattatacagaattatgagaattaaatgagataatgactgtaaaatttttagcacagcatgtggtatatgcccaataaatgttaaatattttttattttaactactgttgtagtgattatcaaaatgagcttttggaattctttctttttttaccttctactctttcactttgaagtagactgactttcccttattttggaaaacaggacatcatctatcagtgccttaaaaatcaacttactagattctccataaggcagacaaaaattcataatgttttgtaggggggagcaaaaattaccatcacactactgtatttcttttcagttgaatctctaggaaatattactgtatataaaatactagctgctttctaagtgtttctttctaacttcaaccaaggtgaaaaccatcacttagttttcagaaacttcaaatggcaggttaagttgacgtcctgtttcatattgctagggatggtcgctggtattccctctagcatgcaagaagttcatccactgacctataatatatgtagttctacatagagaaagttcagtagtactaagtctttgttaagtataattttaaacttacaagtaccttaaatccagtgatccacttcatgcccttgttgttactagcatcttaccatgttttcatggtgtgctctccaaaaccctgagatgaacttatactttagtggatgggttcctgttgactggcactgaaggccctgttgtgaactcagttgatttatgaaggctatcccacttaagatttttataatgcttctttatcctaatctgtttttttttcttaaaaagtaacttcataggttttaaagtgtggaagacacaaaagaattgaaaggttggctgcagtgtaatttagtagctaaattttaaaaaataagaaggcagttcacattttttcaaataagtaaggaaggtttacatttttggagacagtttttatccataaaaaacatttatgggcagcactgtaacaccattgccattttttttaagaatttactatttagagcgagaagagacttgtgtaagaattgagcttggagccaggttttctctgcaagaaagagtggttctgtctttgctcaaatttaaatatagggagaagacccttttgtttattatcttccaactttatacactatagtttttaaatatttttaacaatattttaatgtatttttaaataaaaatattggtaaaaatgagattgaaaaaagtaaacagaaaacctatttatctaatgtccatcagttgtaatatgtttactaaatattgtgtatatttttatatgtattttattgaattgtaatctatatacaatctgtgtattaaatgaaatgtttcctgaattttatactatagagtggttgcaatccaggctgtcatgtatgttcagtcaactcaaggtttaaggaaagaaaacccttttaaatataaccgtgtactgaaatgtatcagaaagtatctaggattttccaagttattttttaaagaaggtttgccgtgttctttgatatcatgctaataatgagtgtttgtagaaaatatataacctagtactgtccgtgatctttctgtcatgatgaaaatgttctatatttgctcagtccaatatggtagccactagccacaaatggctactgtacccttgaaatggggctagtgaggctgaagaactgaaattttaattttatttgattttaatttaaatagccatgaggctagtgactttcatataggaccactgaagtataaccacacaagccaaattatttcaagtatcagaaaataagatgtagagcacaattaaaaatagaaaggagagttttttgttgcatatgtagccagtgtaagctttgtgtttccacttttattctctctcacctcttaataggtggccctgaaaccatgggtatctcgtgtctttggccttgtgatgtagtgataggatatagtcatctatacatggtaatgctgacataagtcacttcatgattttttggaataaatttttgctgggtatcagccaattgttaaacacagcatattgttttaactaatgcaagtatagcatcttgttttatggtataagtgatattttagaaagttgttaatcccaaaaaagtccctgtcacaaatgcttcatataaaatatttaaggccaggcacggtggtgtgcacctgtagcccagctatctggggggctgaggcaggaggattgcttgagcccaggagtttgaggaggttacagtgtgccataattgcacctgtgaatagccactgcactccagcctgggcagcatagtgagactgtctcttttaaatgcacacacacatacgcgcatacacacacacacatttaaaatggatggggtgggtgcattgcatatcttagttaatatccactagatttttggtttattaattaggtcatgggtaggaccttgatagaaaataatttgccaaatcctttaagtcatcaagtctaagcaaatatattaaatgccattgaagtgctcactttaaaatgcttaattttatgttacatgaatctcaacttgatttttaaaaagggtctaaagtactaattttacatcttattgctggagagaagagctccattctttgaaaaccagaaaagaggatcgtaggatgaatattctatattgagtctctaacatttgtcctcacctggatggaaatttcccacattctgctgggattggggccttaaaaaatgactgtaggaaatccagccctttattaaatgaagattccagagagctctgtccagtggaattttctgggatgatagaagtcttctttttggtgtccagtatggtagcctgtaggcccttgtggttaggaagcacttgaaatggggctagtatgacagaggaactgaattttaaattttaattttaaccaacttaaacagccatatttggctactgactactattggacagtgcaattctagaatcataattggtagagaagtagtcttcaaacttttttgtctcctaagagaattttaaaaaaaattctctttttcagtttgaatacatgcattaaaatgtgtttgtcttcatgacaattatctcactaaacaggcatttgtcacctggatgaaatgaaggactgccctcttgatatttattaactctctgctttgctgccaagtgactcttcctaaagaggttggtgtcccagaggtttttatactccagggcaacacactgtaataatatttgggatgagtgaaagccattttggtaaagagaagtgattgtaaaaaggaaggtggaaagggggacttttagaaaatagataccaaagatgacagtgttagttctgatagaatgtattttgagccactctgatttgatacttagataccagaactattctagttaataaaatgaggcatgattagtataagaaagaacacttaaccttcctgctactaaggcaggtgggggcattcatccagattatttaatatgtgagacaaatatgttcaggtaactgcttgtctgtttataattgttttatttaaagtaatagttctcaaatgttttagttttgaaatcctgatgctcttaaatattgagaaccccaaagagcttttgtttattctggttttatctgttgttatttaccatatcagaaatgaaaactaggaaatttaaaaaatacatttattcatttaaaaataataataacccccttattggttcattgaattatgccaatcttctgatttttgtatacatttttttttgaggtggtcttactctgtcacccaggctggagtgcagtggcatgatcatggctcactgcgtcctctacctcccaggctcaagcaatcctcctacctcagcctccttagtagatgagactacccacctggctaatttttttgtatcttttgtggagatggggtttcaccgtgttgcccaggctggtctcaaactcctgagctcaactgatccgcaccccttggccttcctgagtgctgggattacagggatgagccactgcacccagtctacaatattttttaaaaatcacatttgttggtattaccactgacttctcagaaaagtctttaaagattgagaagttgttgagctcatgggtgttttcaaaattctcacttttgtttgagagctcatattttattattgtaaataaacaccatgagttactttcgttgaagtgattggctcactttatttcaagagaattactgccaaatacttgagtctgaatatctgtggcttgtctttcagttggactttcaagtaaaaacaatattccttaaaaaaacaaaaagggtggcccattcaactcacaactctaggcagttgcgcgagcgctcttcttggtgatagccttccttggtgctttggtgagcagcagatatccttcatgtgcacttccagtttcctcacagaaaagattaaaaaggggcaggaataacaaatatcaagttttactgttttgtcaaggacatctttaaatgagttggcttactttttttcctaatgtgagttggtggccattgcaagaataacaattaccagcgtatttttctgtcactgccttgattgtgcttgcaccactgatgtaaatgtcaacacagtgaaaagggcagcgatgtcttagtatattatgaaaaagtgctgattttgtgaatgtcctgaaagagtctcagggacccctgagggtccacagaacacactttgaacactgctggtttaaagggaagttacaaacagtaactttttcttacaaaattgaaaacccatttttatctagaaaaaaaatctaactgtgtttgggagtgggaaggtaaagtgcagctggggtgctggccaccactgccaggtcatgtcttgagcaggaatgagtcagatagcctgtgagagaaggcagcgaatggattggtttttgctcttaagcaaacctattgtttctgatgctgtttgcttctctccctctccatctccctctccctctctctctctccgcctccctttctccctctccctctctcccgctctctgtctccctctctctctccctccctctctccctctctccctctctccctctccctctccctctccctccctctctccctctttctctcagtctctctcactctcaccttctggtgagagagcatttatggtaaacaactcactttaaattgaggcctggtactccgtaattgagaggtattcctgttgctctgcagaggtaagcccccgtcagtcatgcctagactctgctgtcccagggaagtagaacccaccatgtaagcctcttcttactcatgtctctagtatgggatttaaaaattctcttagtgaaaatcatgtgttaaataatgagtttaagctggagtgtgaaaaataaggttgttgagaacggaggacagctatgtagggtgagtcttggaggacggctgggtcttattgaggtcattcattcattcattcatccatctattcatcggatgtttagtgactgcctagtatgtgatacgtgctgagaatataatgttaaatgctatatttttcttgctgccaggaagctcagctgtggctcccactgagtggtaagcatgcatttggattgctgtgtagtaatgttggtgagaatgagcacaagtttagttcagggaagaggtagactgttcagtttggggtcagacaaggcttcacagaggttttcagctttggaaatctgaaatatacatatactcagagttgatgaggctttgggattgacttcataagatggtcctaggagttggtatctgaagacggtggaggccagttagtactttatagaccttaaaaatattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaggtgctggagaggatgtggagaaataggaacacttttacactgttggtggggctgtcaactagttcaaccattgtggaaggtcagtgtggcgattcctcagggatctagaactagaaataccatttgacccagccatcccattactggatatatacccaaaggactataaatcatgctgctataaagacacatgcacacgtatgtttactgcggcattattcacaatagcaaagacttggaaccaacccaaatgtccgacaatgatagattggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacgcatggacacaggaaggggaacatcacactctggggactgttgtggggtggggggaggggggagggatagcactgggagatatacctaatgctaaatgacaagttaatgggtgcagcgcaccagcatggcacatgtatacatatgtaactaacctgcacattgtgcacatgtaccctaaaacttaaagtataataataattaaaaaaaatatattcccagttccaccgttgcctttttctgctctcagggtacatgggaactcaaattcataatcagaccatgtttggtgcgaatagagtgggggcaaagggggtttatgtttctgaggtttatctaggatgttcatccaggcttccctatatctctgccagacagcagaggtctttttggtagaaggatttccataatccatgtattttctagaacttgttggctaaatggctaagtgaatgttttttggagtgctaccagaccctgcccttcctgttaataaatagattaattaattaatcagaaattttcttaaaatttagatgtacatctaagttggataaagtaagatcttcaggagcccttggccagtgtcagtatagaacatctacctgataatttcttctagagaactgggcccacttgggcttccccttggtaagagatgctgaggttctggttgggctggtcaggatctgatatgagtactgttgtattctctttacttcctttccaattgccatgagaggggagtctctgccccacatttttaaccagtccttcaccagactcttgggtcttagtctgtgtcatctcttcatgggcccttagcatgttctgtctgtgtaggtcctctcagtaaagtccttcttaaagcacaaataaacaaaagccccatcttcctctaactactgctccaggcacagtgaactgattttagttcttcacaaccttttcacccctgagcttctggcacataacactcacccctagtttagaaatccttatgtctgcaaagcctctgctgacactgctgaatgtggggtctgggcttctcctccacaccagtcttgctgtctctgttacgattattgctcctctgcacactttggaaggcagcacagcacaatgttgaagagcatggccctggagtcccgactctgtcacttagtgagctgtgtggcctggggtgaattacatagcttctctgtgcctcagttttctcacctctaacatgggaatcatacttggacctatttaaccgtgttattagaaagactgagataatacatgtactgtgcttagaattgtgcttggtacatagtaagttgtctgtaaattattactgctatcgatgccacattattactatttttgctgctactaggactctgtttttgctagtatactctgttgcccccactgtactctgagttgagtgaggtcagggttcctgtccctcattttctctgtcgtagcttcagtgtgtgggcacatacattctataggtgcttgttgaatgtgtgatatgctaggacagaggagtgggagcgaagagggatcttgcagggtggggagacaatggcattcagaggcctcctgctggaggacgtgtcttcagggctgagctatacctgatggctggaagctagccaggaccaaggatcacatgacagtagcacagaggccccgagggttggtgggggggcggcagggggaggtgggagaagatgggactgcagaggtgaggccagcaaagaaatgggagtcatgctgggcaggtcggtccagtgaggggagcagggtgtggccatatgtgccgtgtaaaattatctagtcaccatgttaaagagcaaaaagaaacaagcaaaattaactgtgatatatttcatttaatgcaagatatatccaaaagattgtgtcaacatgtaatatttaaccatttcaacaaatcatatttaatagagaaatactgatgagatattttacattgtttttgtactaagtctttgagatctggtgcttttgtacttgtagcacatctcagtttggattggccacattccaggtactcagtagccacacatggctggtggctgccacgtcagacagcatggcttggtagaagacagttgagaggtaatgggttttgaattaagacagtgtgggtggggagcggtcaggggagtagaactttacaggatgactgccatgtctcttgcttactagatgagtggtgacctcccagttgatggaagaatttaggaaaacaatgcaaggtttatttctttaatatttttcaggaataaaggggcaggaagtaagatgagttaagttttagagtttgagatttcgttgagacattggaccttgtggatagggagcttagtagagagtttatgatcttgaggcctgggaagaggagcagaagctctttaagcccagcataagactccctggcctatcccttcccctcctgagctgagcccaccactcacttggacatcctgtcactactcccatcctttctctggcttgagggctgtcttcttgggcttcagtggaagatagataatcacctcccaccccgaccagtcagtgggctgtggtcagagaggaaaagaggagcatagatgggtctgacttcacaaacatgccttaaccttcatctgcagtgactgaaatagttctttcttttgttctttctttttttttgagacagagtctcattctgtcacccaggctggagtgcagtggcacaatcttggctcactgcaagctccgcctcccgggttcaagccattctcccgcctaagcctcccgagtagctggtactacaggtgcccgccaccacgcccagataattttttttgtatttttagtagagacggggtttcaccatgttagccagggtggtctcaatctcctgacctcgtgatccgcccgcctcggcctcccaaagtgctgggattacaggtgtgagccaccgtgcctggcctgacagaaatatttcacagttcatgagccattcagattttaaagtttatttaaaaattatgtacaatgaaatcacaagccattttgaattaaaaagaagtaagattgagatagttcaactgctactggaaaatgtctgtacctttttatttttgatatcaaattctgagatctttttctgggtctctttctagcagtacttttgtttggcagtgtctctgggaatgagatgagggattgcaattagttcatggcagaaagggaatatttgttgcttgttgactcttatttagaatattcaaagatgaggtaagaagctcatccatctattcagccattcattcattcattcattcaccagtcaacattgttgtgcatttacaatgtgctggatgctatgtgaggtcctgaaggtattctcccctttaaaaatcccagttaccatgtagtgatgtaactgtaacaaagagataaatgcagacttgtatgggagaagaaatgcagggccaggaaggaaggtgaagcttgagccaggtgaaaggggtgatgaaggagaaacttacgcagacatagtacagaacatgtagctttcatagaacagcaaatgttgcaatattgccttgaaacagtcttcaaaatgtgctttcatttatgtgtgcatttgttagttctacaaaaggttcaaggcactgtgttgagcgctctggaggtgcagctgctttaaggtgtaaatgcacgaggcagcatgagtgcccttttcaagagcagagagcacatgagcagctgcagtacccagactgaggagatgtgacatccacattaacatttgaaggtgtcgtgggactttgatattccacccgcagacaataggcctctggtatgtgtcagtccctgcattagatgttggggatatgcatacacacacacacacacacacacacacgcacacgcatgcatgcacacacacatgtatttatatatgtgcatacacacacaccccacacacatatgcatgcatgcacgcacgtgtatttatatacatgcatacacacacacacacgtatgtatatataaatgacaagagtataacatgctgctgtccttcagcccctcacagtccagaggacctaataatagtcagacaacatgatgtatgttacttggccttgtgggagcacttgactccacctggagagattggggaaggccttgggaagaggttatatttaaactgagttttgaaggttgagtaggaattaacttggagaagagagtgggaaaggacattctaggcaggaggaatgataaatccacaagcactaaattgggaaagagcaaagtgcctttgtgcggctgctgctgctgagcttggtagggtgcagcgtgtgtggtggagaggaggacatgggccaggagggccgggggcagccccgcaccagtggtgctgagggtttcagctttcagtgtggttcacagggaatcaccagtcagttgtacagaagcatgggcgctttacattttagaatgatcttgctaaaaccagaagatttgctgacgaagatgagactagcaggagactgtgccatgcagacatggaatcctgatgaccacccagacttaagggagaacatagaggaaccaagtcaggaaaggacagacgagggaagaatggtcagtgacaagatataacagagagtagtggtgtagtagcaaagggtttccccaactttggtttttgaaaaacttctaatccacagaaaagttaaatgaataatacagtgcacacctgcttatcattcacctagaactaacagttgctaacactttgtcacttttgctttaatctgttgctgtcattgccctcctaaaggaagcaagggtggccatggagatattttggcaagaactctgagggcagagacagcctgtgcaaagtccctgaggtagaaggatgtgtagcttgttgtctgctggtaaggaattgatgtggctgaagtgagagaaagggggggaattatagaagtgttagggaggtagcagaggtccatatgattgagggccttgcaggccatggtgaggtgaggactttagatttttctgtgagggagatgggaaggtactggagatctttaagagaaacgtgatgcgatctgatttgcattttgaaagaattgctcagactgtgtagcagattaaccagggtagacggtagggctagcaacaggaggtcaggtagagaggtgactgctgtagtccaggcagggtctgatgtcacctgaataaggatagcagtggggacaggccactaggagtgtgtcctttgtctacattgaaggtggaggcagcgtgatttacagaatggattagaggtgattcaaatgtaagactaagtgaagggtcaagggtgactcaagtttttggcttctgctactggtgcagtaacagtttgtggagaaatcaagaacctgttttggaatgccttaaatttgaggtgcctgctgggatatctgcatgggtatatggactatacagctgaatagagaagtctagagttgaaggaagtggtgtggactggagaaaggactttaagaatcattgacatataggtagtatttaaagcaataggtagattctctcgctgggagagaaaaaagcacagatagagttgagatccaaactcggaggcctggagcgccccagaaattataggtcgagaagttgacgagaaccaggaagagcctggaagataggaggagagagggctgtcctgcatgtcatgcgaagaagcgaggagtgagcagctgtgacaggtgctgctgataggtcaggtgggatgagaaaggagagccttggagggcaccttggtgagagcaacttttgtggaatattagtgtgcagtcagagcaagttcaagaatgaatgagaggagaggaagtgaaaacagcaaatattgttgctctttcaaggattctgctctaaaggggagcagtgctggaggaagatgtgttgagaggctcagtagatgcttgaagaagtgaagaaggtgaggtagaaggatgtgcagcaggaaggaaggtcaggtaggagacaaattcaaaagtaggttggtaggtcactttggaggagatagctatttaaattagtccttgaggcagacttgttttaaatgactgaaagaatgttgctacaagggtgttctgtgttagagtgactgaaagccagtgcagagcttgccttggctggtgctcagtggctgccgaagctcatggcactctggtggtggatatctgtgctgttgcagccacatgctcagctgtgctgggaagaatttgggtccccagaggcttcctgtccttaactccctgaagtcaatgctgtctccctgcccagcagctctgtgcgggactcctcacggtgctgggactcactctgagtgactgctggttcttgtcctttctgctttctctttcttctcccctctctcttcgtggtttgtttgctgtggatctaggacttcagaggttcacaaacatgaatgaagtttttatacttaagcataattattctgtgcacggtgaactgtctaataattattattttatgacatatattcagcatagactaaagttactgcgagaaaacctcacagatgttagttaggtatctgaaatgagatggtatattataggtatgttgttctgaaagtttttttatgggaaaagtaaattgtatttgaaggtttagtttagatttgtattctagtatattttattttattctggcatttcatagtttttcaaatcaattttatttttctgtgtgtatctgagaaacttccttaatactcccctctgaaatcatttttacttcccccaccccgtcttacaaatacttcattccttactccattttcattttcgaagtgtggagatagttattattgaagcaggaccagagcagagacccccagatggtctgagagttagaagagactttatagagatcagttcatccaattccattctagatgaggaagttgaggcatcttgagttgttttcccatttgattattatgatcagaaaccaaacctaatattaaatccttcaaggtttactatccttccttctaacaacttctctaaaaggagccactcacaggcagtgactggtgtacttggatggggtggctgcagccctgcaataccatgggctgcccagtgttagggccatctgggccagcaccgctcagaccctgccctccaacttgtattagtttggtccttcctcattgagataaattcgttctgcatgttgtttcctgtttgccagctgtccctggggattgtgggggtggtgacagattcaaaaacctgtgagattgctcctcaagtaattgctatttacatttctgaatttgctgtagtagaaactgaagagaaaatctttaggctcttggtcagtactggactagatatcagacgactattacattttggtactacagagttcattcaaataattttgaataataacgttaagctaccatgaaaaaaaaaacctgcactcctttgtttgcaataattcatacataaatactgctaaaacaccccatcttatgtgactaagtacattcttattcatcaccccaaattgtattttaaatgagaatatcagaacattaagtatttgtattttaggctgaaatgaagatattctgtcataagtcatctaaagtaatatgttttcaaagtagggatgaatctttgatataaagaagttgaaatagaaaaaaacctcaagtataaatccttttgtaatagcatctctgtagcatttttcaaagcgttcaggtatttccaaataaactcatgtttaagaactctaactaaggctgctgaatagatgctaaggccaggctaaatcacacagccgtttaaactgaaacagctcagttcagagggtactgctgttttataaccatatttaaaaatgtgttcctcttttactccctcaaactgggttcagggatataatggatcccattataggtaaaaggtctgtgactcagccatcgagctactcaaactcttggctgttttaattgccaccattaaagctttagtacttttatctcataaaaatagatatcattgatgtaaaatgtgtgcctattgaagatacgtgtgtacctctgcccttatagttagctaatcaaccatttgagtttaaagttagttaggttttatgcagatgggaacatgacatagatcacagatttgttcaggtttagtcatttaattaagaaaaaaattccatgtagtagtaagggcaatatctaactagaatgtcttccaagatgaaacttattttgttttggtttgccttttaactacatttaattgacggaacgatggtgaatttttactagtctctttcttgaaagagaatagtgttttttttgtgattctaatactgtgacttcagtgattcaaggaaatacttgaaccactcttctgtccctatttgacacatctgtttaagtgtggtaattggagatgtttctctggttgtattttggtgtatacttgtagacaaaaataaagccctgcaaaggggaaaataccaaagtgtgaaggaaacttcaagaacacactggaaactaaatgttaagatgtgaaaagctagttctttctgggctttttcttccagtatttgagcatgtcacagccattcattattcatattgtgctatgcaaacaaggtgcagtgactctagaagagttctaaaatgagtacatctcaggaaagcttaactgcctaaccactgcgtacatacacattgctttctctgttgtgaaaataaattagcaaataattggtgggacagtttattaagttattctgttctgcagttgttattgagggattgtattcagataagagagaaaatctgactgtaaaagggactcaaatctgaacagttctaaaactaaaacctactcacacaaaacatttatgagctgatatacataaccaggcttctattcttgcccagctgtgtagattcaattataataattttctcacttgcacaacactgctgtttgtttattattgcgttattagttagtgaatgaacctccctctttttgacccctcagcagtgtttataaaacacttaattgctttggtgtcttctgtttcatgtgtagttccagctggaaggagtcatggggacacagtcccctctaagtgttaaactgactgtttgtaatatgcagcaaactttctttccaagtaagtatcaggaacctttaatattgcttataacacagctgcttagatatttttgcttgaaaatgcagaggtttttaatttttttttcttttttaatctccctgtgatgatttacatggtagttaactatctaacttgttagactctagctttttaaaatgctcttttgcttatcgtaggcactccctttatctcacctggactcttcctgtctgaacgggtcctacctctgcccagctgttaccttacaccaagttctctttgccattacatcttccacttctttggagaaacttaagcagaattgtgtgagcaacaacgattaggtagtaggcataatgtttgagaatgtgggctttgccagaggttgcctggtttgaatcttgattcttcttataaccagctttttgtgatgtgcagcaaatttcttaacctctttgaatgccttcatttccccatctgtaaaatggtgataacttcactggttgtctggaacagtgctgggcacagaggtgctcagtgatatcacagcagtggcctctttacaaaggcttaatgaaggaagtcctgctgtgctgtctttatgtgaaaggataaatatctcactaggaaaggggaatcctaggtagaaaaacaatttcagatgagagttgcagaagattttaaagtatacattagttatttattgttatgtgacactttacaggttgactatctctcattcaaaatgcttggattgagaagtgctttggatttcagatttgtttcagattttggaatatttgcattatgcttatttgttgatcatccctaatttgaatatctgaaattgaaaatgctccattgagcatatcctttgagtggtatttcagtactcattaagtttcagatttcggagcatttagatttcagatttttagattagggatactcactctgtaccacaaactttatggcttaaaacaatatctatttcctctctcagtttccgtagatcagagtttgggcatggtttagctgggtcctctactcgagcctcacaaggctgtagtcagacgtcattaggactgtgttctcatcttgactggggagtcttgactggggaggaatccatgttcagattcattcaggttgtccacagaattcatttcctatgctatatgacttgggtggggggcttcagtaattgctggctgttgcctggggccaccttcagctcctgaagtctgcctgaagttctgcaccatgttgggttccctggcaacgtagagttcccaccctcaagaagggtccccaccctctttaaaagtgtcccccagtcagacctagccagaataattgccctttaagtaactccaaaccaattgatttggaaatcttgattacacgtgaaatccttttaccttcgctgtattctgttggcttgagggtcgcaggtccctccatagtcagaagatagagataatggggccatcttggaattctgcctccccacaagatgtacgtgagtttttataggacaagagtagtctgtcattaagcaattattgaaaactaaatttgccagactctcaatctttgaatcctggagaacttgcctagagtgtgtaaattaactttatcactatgctccttataaattgattttttttcccttcaaaaattgttttgttcccaattctgcacaaacccctgggattgttcagtgttgcagacacacctttgacagtctttgaagtttgacttttaaaattcttaggaacagcatagtaagttacttttaatattgatccttttaaggtagtagaaacttaaatgcaaatttggtaaaaattgcttttccagaaccaaattctgcatttcttctttccagtttaaagattaaacatgcaaagcgttttgaccagccaggaagcactgctgttgtcttttgttttgccaagtttgatccttagtaagctgggtagcttcaggtgtgggtgtccactgccaaattcaaacttccagacacctctttgagaacactatggaccttagggccaacttgaaacaagacagatgccttgagactgaaataggttctatagattctcattcctgtatagttactaaggtgagcccactaagggaagggcaatatgcaaggtgatgaagaaaagagagaagggagagaatgaaatttactttgttaaggcccatgaacatactgtctttgtcatttttacttctagaaaataatgtccagtagaagaacatttgctgatttactgccataaggagctcaggaatttagaacaagagggtgaaagtatgactgtgtctcagattcctctaatgggctcatattttggtttgcttatggttagtcagaggcaccatgatgttcacattggagaccctgcgttttgttgggttattgctcttgttctgtcatttccattcagtcatttataaagcagcaacaatatcacccacctcaccaacctcatagggttattataggaatccaagagaagaggtatgtaaaatgttcaacagagaaaataggtgggcaggcctgctgcctcaggggggtacccctctgcttgtggcctgggagatctaggaagttactcactcttactgcaataaactttgtattgtgttgcatttgtggtggtttttgtttcttccctgcccagagaaatgatggtttctgttggccctcttttttctcacaaaattacttcagggataggagatgtaagatcaggaacacagtctaaatactggcataccctttttagaaggctggcacatgtaaaaacatcattcaagtcttgtataaacaagctaatttttgcaagcatttatgaagcaacagagacacatcaaaagcatgttcaatttagcattagctcaactctgtgccctaggggtgtgtgtgtagataaacaggctgtttcaactatatggcccctaagtgcaagcctgtgacttcatctggtacttttcctaagaagtagcaatgaatctgtgacaaagatggcgaaaactggcttagttacagtctttgaaatatagtagatggtgatttggggtggggagagttttcaaggcagggcaaggagcgggctaatttttttgtggttcctgaggaattggttcagtccctgggacaaattaggcctcgatattgattgcattgaattatgctagtggagtgatttttgagaatcatagtggataatgtttgttggctgcaaaacacaataagaatgccagttcttacctacatttttatctttgggtaaaaggttagtgattctctacagctttagttcggaactaaactagagttcttccctgaccctttgaaggcaaaaatctcaaatttgtattaaattttttagccatcttaacctgcagattagggttaggatcttaaatagaagtaaggcctttatggttttggagaaggacagcagtctactccctaggcttgtgctgtggctacaactagggttggagaactccacagccactccctctggctgaggataccactgttgggggtcctggtcacattccagaccttctcacaagaggcttggtaaagtatgtggattttgtagcagagctcctatgttaggattccagttttgccattttctagctgtgtaactttgggtaaattaatcttaaggtttcggttccatcatttatgaagcagcaataatataactcacctcaccagcctcatagggcattacaggaactgaagatgaggtatgtaaaatgcttagcagagcacatgccacatgtaactatacaacagatgattaaaggaaacattcagtacagtgttgcaggatggctttaggactggtactttggtgctgtctctctgctcagcaccctcttcccattgccctagaagggccaggctggggcagctttgctggcccagcagcgtggctctgtgcttgcagagctgaccctcgcccattggtacccctgggcctgcagggcagcacccaaccaagggtggacaactggtcagagtcatgttggttgaaaacagagagacaggaaaggggagaaggctggaagggcagtggtgggtatggcggagggtgaaggagctgggagcaaacaccttgctctcctccacttgcggggagctttgtttcatttagaatttctcagacatttagaaaagggtttagcattggcagagtttcactgcttatgttatcccagtcaatctgactatagaaacaccacagcatagtgttttacacattgtgaatgctgttggacagttcctgtggtatcactccactcctaaatatggagaacatgcttagtatgctgtttctgatgtgaaacttttcaacagtaaatctaacatgactgcttggttcattatttccattgtttcagatgctactaattcagaatgtgtttataatttagatgccataaaggtggctcatgttaatttgtagccatttaagattttgtttatatggtgaatctgttctaaggacagctttaaaacacaagcagaaaggcaaaggttcaaaaacgccttcagataatttttcagctagatgtttcaacagtaatttaaactttttatttttaaaatttaatgattctgaggtacatgctaagataaattatttcattatgctatttcaaaattcattttattttactttgtaattatcttgacatataggaatatgtaacaaaaattatacaagtcattcttatatgcttatactactttattcctaccagtaacttaaattgagaataaaataaactcagccaattcagtgagctgtttcagtgcattttatataaagttatatttgtgcatagtgtaatatactatcttttgaaacatttgataatcaatgttttgagaaagacagatggacagatacacatgcttacgtacccctgtgctagagaaggtgatgaatttgccatgctatcactatatcagtataatcaaaagtatattttgaaggacattttaattcaagatcttcatggaaagaagggaagccatggctaaacacccttaggacactctctgtactgtctccagtgccccctttcctcagtctattaagggcttggaaagtcctgcagtgaagaaaactgaattttggttagcacagaattctttatttttgaaacggagtcttgctctgttgcctaggctggagtacagtggcgtgatctcggctcaccgcaacctccaactcccgggttcaagcaattctcctgcctcagcctcccaagtagctgggattacaggtgcataccaccacgcccggctaattttttgtattttttagtacagacggggtgtcactatgttggccaggctggtctccaactcctgacctcaggtgatctgcctgccttggcctcccaaagtgctgggattacaggcgtgagccactgcatttagcctatcacagaattctttaaactcatgttacctgagacctgtttttatgtgacacatttgaatatccttaacttgttctatactttttgccttctcaattaattcatatagtcattcagtataaatatgttttcctggaaattgttaagaatgagctgaataaaactaactggcatatcaaaagacttgaactcagggccctgaattcattaatactgattttaatcaagcagaaaatacttcagtccttgattctcttaagaatatttttgtgctttttattttatatcaaataattaaagtttattaccccagttgaccattcaaactactatccgctcatcttgatctcctcccttacaaagcagattttaaaagcttgcttgtgaagcatttgcatgcctgcagccacccagtctcaggcaggatttgttgttcaagctggttcctctgcctccccctctctctcagcctgggacagtttttagaaagcctccctggtctcagcctgggttaggtgctctgcactctttcccagcaggtactatggctgccttgtttactgttagagcctcaaatatttgttgaataaatatatgaattgggtactagataccaaatgcatcttcttttttatcagtgtcattgttataatctcaataggacttgccgaaacgttgctaaatgctcttttgaatcattgcacactcttctggctgaagatcgagcttcacttttcataccagaattccttttttgaagagtgtagaggggtcaagaacctggggaatactggaaaaaataaaagttaagaatgtctgtaataaaaatgtgtctccaaagccatttttaagataccaaatagtatgtttcagtcttaaatgactacttgctatttgtattttcatgagccatttaagcaatagtttagtgttctaaaagcttgtatttatgttacttgggacttaattggcctgcctcttcttcaccagaatcttattttctctgagagcacaagtgcctcctcctcattgcctccctttagcttaatttgtggggaggcttttgttttcataagtaccatgttattctggtccgcttggtaccatcttttcttttcctataaagcattgttttgattttagacttgtttgtatgtaaataaacatgtaaataaatacatttgtctgtaaataaaatgtttatccttgggtgccctgtatgacaaaatgttggtttgcagagatcatacatgtggaagcattgcacacactgttaacattgcatcacttgctcatgctatactcaaaattgctaacaggctgaggcttcagcagtgtaattaaggcaaaacatgatgaaattagatagctttttaagccagaaaatgctgatgaattgtggaagaaaagcacattgagataaataaaaagttgcttttttacatatcttttcattttctttgatgattcttctatgcattttgggttggatttgcttaaaagaagcagagggattgctctcacttcccccatcgggtctcctttggttaaatttgcatcttgtccattctgctgttttatatacgataatttagttgtatgtcttttctgatttatatgttgtgaacaatggagttaaggaaaagaacaattgtctgtagcttatggtaatgttttcaacaaaacacactcaccttagatcatttttatttatagtttaagtatcagttatgctgtttaagttccaaaagttcatggcagtctttatatattccataatgttccaaatgggatatggaattatagtagaatatatgtcaagcagaaagtttgacaggatgttatttaaaaatacctttggtatctaacattctccatgtttgctctaataaatgagaggttttaggaatgccctacatggtaatatcagatgttaatggcattgattacctgtcaggcagtgggaattgatgggaaaatgtctgctgtaaaattaaatagtattagagaagactgtaccatgcatctggtggggtggggggtggagggggggacatggctgggcctgggagactttgtcagggtattactgggagctccaggtttttttccccacatgattaaggcaggccatctgttctttgttaaatgtttacaaaaacagcttttctctaaaagatttaaggagatgtgggtctggtaaacactgtaatatttctgagcacctttttcaccctatttcagatagtaccaaaacataattctgctgcatatcaaacagaattaatacttttttgtatttgatcttcacttttttcctccttatgcaagattaaattttttactgagttactaatttattgcttcatttattactaaaaggagcatctaacatgatttgcatgctaaagtgtgtaaactttaaatctttttgtgttatatgttttatgctttttctaattcattactgtgtgctggggaatctctcattagaagctggtgttctgttactggagcaaatgccatgcagattaaagaaaggtaaacatacctggtattaattctccattctaagttttaatcattgtttagactttcctcttttcctctctttccagaaacagctttttctttcatttcctgaaaaatagcttgtcccaaataagtttgatctccgtgtcctgtgcaaaaaagatagggctttttcctttttaattacattaaggaataatatgtacaaactaactcaacttatgcaaactaaatataaaacagttaaatcaggtccattgatacttaggtagtgataatttggacagtgcctctgttgatgtgtaagagtgtttgtgaggaaaggatagaggggcagagggtaactttggcagtgtttagttagttgtgttatccctgcatggaaatctgctcatgtagatctacatctgtgtattcttcttcaaactttgaccttgcctctgtgtttcctatatatcgttactcttttttcagcctcattctcccttagctatgaccagcaaagggcaataagtattttaagattttttaatgccacaggattttggaagaaactttggaaatcacctatcaatcacctaacccaaaaccttcattttgcagaaaaagaaactaaccccagatgggtgaagtgattttttcccagatgatatagctgacggtagggcctggacttgaattttaatctcttaactcagagttctgggctctttctcttacaccagtgcaattgagtgaaacctgtgagcctttcccagaaagatgctgtgtagaagatgttaggaagaggtggacagaatcagaaagtactagagttaggaaactagattcaaatcttagctccgtcactaactgtgtgacctggggtggccacatcaccttcttggacttttcctttctgaaagttgggggtaaattatcacttttttgttatgagattcaggggaattaacacatctagcaaacataacctagcttggtgcatggcatcaaatagccgctcagtcaatattaggtgtattggaatcgaatttacagtacctgtattttaatgtttgattctaaccttcctccttttctcgtagtaagccttggcgtgtacagtagtcacgaggctctggagatgtgggcctgggctcgtctgcctgctcctcttctgtaggtcatgtgctgaggagtgaggactctggagctattggctctgatggcagtctcagttctgtcacttaacatctgtacctcctcggacaagttacttcatcttagagtggcggtgtcttcaactataaaatttgaagaatcacctaacgcttagggctggtgtgaggattgaatggtaccacggtgtaaagcatatatgcctggcacatagtagatcgtttacattacagttagtgttacatgccagaagaagcatatgagaaaggcaggaaatgagagacatatgtagatttaatattttcaagtattttgttgaaatataaatgttcgttagatgtcataatttatggtatagatgataatccaggcagccctgctctggtttggatggtgagctatgagggaggctgttgtatgcaggagtcacttcctctgatcttggctgaccactcagaatcccattctaaatgtggttatttttctactctatttaagatagtctctgggtgtatccctagtgaaagtcaagaacctcccaaaggcatgtcacattaatttatttgggttatctctcccttggtgaaattttgaaatataaagccttaaagaggttaagaaaaacatgttccacctttcatgtcaatgcaagaaatttcaccaatccaaaatcatcaagtttgggtatgtgcttttaatttgatattttaatgttgtttaaaccagaaatgacttgtattgtattagatttatgtgttatgtttacacttttatttcagactttcacagtactagaatcttgcaatgttcagtatacttgctcattttaaaaatggctaaattatataccttttatttgagctcccattcccacatggggctagaactcaacttagatgtattctttgtggcttagtcttggtgctgttttgccattcaccattttcatgtaggctgtttaaaaaacagacagtgtcttcagttgagtgagtttttacttcctgaactgatttttttttactgtattaactaaagtgctattttaaaactttctttcttaaaagattctctcttaaacatacattttttttggatgagagaagctgatagattctacaactgtatagttggaaaaatatttgctacctgagtatagaataagtttcagaaacatcagccactaactttcagttcttttctttactgtgaagaatgataaactaatttcaattcctatttgtgtctctcagcattccccgtcggagccctttctagagaaaccagtgccggatatgactcaggttagtggaccgaatgctcagctagtgaagagtgatgattacctgccatcaatagaacagcagccacaacaaaagaagaagaaaaagaaaaacaaccacattgtagcagaggatcccagtaaaggttttggtaaagatgacttccctggtggggtagataaccaagaactaaataggaactcactggatgggtcccaagaagaaaaaaagaaaaagaaaaggtcaaaggcaaaaaaagacccgaaggaaccgaaagaacccaaggagaaaaaagagcccaaggaacccaagaccccgaaagcccctaagattcccaaagagccaaaggaaaagaaagcaaaaactgccacgccaaaacccaaatccagcaaaaagtcaaggtaggctgtgggcagaaaaaacaactgcaaaacattgagagtacagaaattagcgccaaatagttacagcctatgaaatgaggggtgggaggggacacaatgatttttgtcatcattgagtttctttccctaatatccaaactaaaaagctaaggcttttacgcattctgaaagttaggacttattgttgtgaactgttgatttacagaccttactggatacaaattaaaaatcaattttttatatttttatgaaaacttatcatttagcaaatggaatgaagttagcagtataattatttataagaatagaccagcaacctcattttcagtgatgatataaaactggataagaaggattatagaagaaaggtcactatatttcactaagcattccagcccttcttcccagaggttgaaccaggattgttaattctctccacttggcggagtaagccttccaggagcagggttgaaatcctagtgagcagcgcaagagaaatcaaatagtacttgtccattggatatgcattcaagagtagcatgaattttaggttctagggaagaccctctttcactccatattccccccatcaattctctgaccgctcccccaatttcttaccccatttattcggtaagaaaaactgagaggagaagacattgaagactaatttttttcatttgtagtgaatgtttcttacaactgttctgaaccagttccagacatctgaatctgtttttcagaatgtggctcatgttagaaaatatagtttccagatggaactatggtcagccttggttaatccgaatctgtttgcaaactccattagaaaacacgcccaccccataccctcatgtgcacgtgtaaacacacacctgtgcatgtacacagtcagttctgcatttgctgtgaactttttgagattgctgccctgtgtgtgcatgcccaagtacacaaacagaggagattaattttgtggctagaaagatgttgccttgaagtgaaaggacaaacttggacttgcaacttcctgctaaaaataatctaaacaactccaaatacattattatgtgatgttttaaaagtttggatcatagccatttaggaaattttgccctcaacaccttttatggtgccaaagtaactgaattacattcagtagctcagtcttacagataacttaatatttgcatttacttgtgaattttctttgatgcctcagtgtgtggtctcctaattgaaaaccatcacttttctccccctctttgtgaacatgtttttaaacttaacactttataaaatctgtttttatttaagaaatattaagtgcttattatttgcaggtactgttttaagagttagggatgtaaggatgaggaagaaagacatgggtagaattttagtgtgactttatgaggtagtttaaaaaataagtaattacctaaatctaagtatatgcttttggtaggagaaagcataagcttatttctcccaaggagaaagaaatcaaagcaaaaatcttaaaaagaatataatcttttttctttaacttaaaacataggagtctgtgttctaaagaagctttttggagctcaggaaatacatcattaatattaatcttagcatcaagatatatatctgattccagctttcatcttaatttttaaatttatcacctaatggtaaaaatggattaaaaaaagaaaataacactttatattagatattgttatgaatttccaagtatgtctttttaagttctgaatctacatcagactggctctatgtttaaaaacttacttagcatacccttacctcttgtagagtcctttggggcagatattaaaatgctgtatttaacaatgaaatttgttaaaattttcccaacaactgtaagaaactgtttgaaagttggagcaccaaatctagttagtcccaggcatgccatgtcttcttggtgcaaatatagaccctgtgtttatccactagagaaacattcagtgcaagcctcataggcttgctgtccaccctgaagtatgaatcagagtctgtgcagagtaagtgtttggcattgctgaatctgagtgttggctttgcaccagagtcacaagcttttggtaggaagaaaagggtgtattttctctgaaaaagtgtctagtaccttcccccctcctgcggcttttgattaatagtctcagtcaatgcctgctataggcaacagttatttttaccctaagtggtgtgaaaataattggatggaacacgtctgatgagcctgcggatttacaggttaaacgggagctgctgcagtgtggcccaaagacttaggatgccacactggggggggcggggcacaaagagtgttggtggcacctctgttggccctggtcacttgaccacttatagggccactctgatttacaatgaagggtggtaaggacattcctgaacttccctgttgttgacagtcaaacagggatggctgtccaagcatacggtagttgaattgaggttttaagtaaattaacaaaccagaccattattttgttgaacctcattgtttctcttgatctgataaattgagtatgtcgcattgtggtctcgttgttctactaagtgtagaaaggaaacagcatccctggagcaaggataactagagtgcatacaactacatgtaaattctgaatagcatagtagaataattatgtaaattgaatatgcagtgatgaaggtaatagggggtttgggttatgttagtactgggtttgaattgccgtagcagtttgcttttaagcactggaatacaacagtggcaattttgttttgcaaaatgttatgtgataccagttatttccatccttgaataagttaacttgatgaatttgtttatacagaaaataattttcctacagagagctaaaatagagggaataaacagaaccgaaatgaaaaatttagcacagaactgctgacatctttactctgcagccctgtatgccatatcattgctgtgttgtacaaacaagtgtgctgttctttgagctggaggtaaaggaatcggcccgagggtgctctagctttctctgtgctgtgtcactgtcagggagagagcttggtctgcatcacttacactcaccatggtaaaggacatgtgaaggctggccgttgtcaggggctgattttccttgtgtgtctcctcactgtctggcaccccatcttgttctgtaaaatggcagaagcttgaatttgtgaccattcccagagaactggcctttttgacaactaaaatatgatcatacatgtctttcctctgcaggaggacctaaaagaatctgcccagaaactgttacatagagtgatggtgaagcaggaaaagatgttcagcatcacagaaaaagacatgtaaaaccttgatgagaaaaacgggccacattcctattctctaatcaggctgtatcttttttccctttcccgttttatgttaaatatatattttttgtatcgatttttctagtgttctccccagttgtccttacagctttcaaatattcgttgctaatattgaaaataacagcgaaaacatttgtgggttggagaggataccgttttgcatgtggaaggattcatggagctggaatatgaggatttgcatccttttcaatgcattttctgttgtgcatgcatgtgccttgtgagatgagaaagaatttggaggaagtgcttcctttgaatgactcttgaaggatttaatggtccatttagctatataaagattctttgaatgtacagaaagaagggaacttggccaaagattgtgacttgactactgaagcttaagttaagtagaacaacacagacttgctgctaatgcagtttctaggaatgcctttcattccttgctctatgctctgtccctagtattaaacttagtagaaaactaaaatgttatttttcaattaagagtgaagttttatttttacatgctactcttattttaaaaaaacatatatagtacgagaaacatgtgagggtgctttttgcaaatcatactatcattatcattaatagtagtagtatttgtatagcagctttctctgaggaactcagcttttcaaacattgttttctcagttacgagcttacagagtagcaacgtttacctgagaaatacttttactcagccaccaagtccaatggtggtgtatttttataaactaatacatattttatggtgtactcttgtatatgtaaaatttcttaatagagattaggcacaaaagtaacccattatgctagttttggtagtaagtacaaaaacctaaatagtcagatatcttcctgtcaggtacatgggtaataaaataaattaaaccctcagccttcctttgattttttttttttgtagctgtcctgatgattttcttattctttattttactcacatgctatgatttactcttggtggaagacattggacatttgaaaagacagaactaaatgttttgcaccctgtgcctgtggaagagggtagagatttcttatgtgtgtgatgataaatgaatctttgagccctttcagtgttggtgcccatggacatagtgtggctttgtctcccgacctgtcctacccagtctctggttcattaaatccaagcttgtgctccctttcctgctgcctcaaaggctgtcttttcttcaacaaaaggaccatagcatcttttaaatcccgaatccttctttcctttagggtaaccacctcaaggccttccttttgctagccagcatcagtggccccattgtggcccttcctctatttaatttcatcttaaactggctgagtaagcagggtgagagagtcatcagctgcttttagtacagaccccggtgtctttgacgtgtgtggttcagttcatatccatcaagggaagagattgcctaataatactgaccttgaaagcaagtttgccaactcatggtctgtgccagatgcagggtgggctacactgggcctgctggaaatttgtttctgcccatccagtgaactgcagtggactccaaagcagtggccttgttcccactttggtttatatgggagaaggtggtgtagatcccactttcaacttccactgcacctatcaaatggaagttcaggtgtaaggaggccgtgagccgcagtgggatgttaaagggagatttttctggagacacattccttgaaagtcctaagtggaattttcagatggagcgtatgttgccatacagtagatgtggttatgatgttagggctggcaggtaaagagcagaaggaatcataggctgattttatcttttatttaaataagtctatatttgtgaaaatgaagtgctgttgaaaaatgaaattctgtacaaatgcagtttgcacctgatatgtaaagatctttatgttagttgtcttctgcgtggacgaaggcagtcttcgggtgcttgtgcaaagccactgtgcagagcatcagtcatctgaaatgccagccctcacttcagccacctttatgtagaagtctatgtgacttagcattcagacgttaaataggaaatggagagtgcaaatcaagaaaaaagacacttctttttttttctttaagttagacaacacccttaaacttccatagaatactaattttatgtgtagccctgacttctgtaggaataatataattttgtgggagtttggtttctcctgttggggtggatggtgatattttcttctttgttgtttttaccatttatttaatctgccaaagtctcatctcacctgaggcacctgattgaaatgtgggtgggcagcatggctcatttgttgtgttagccaccctggcagattagagaccgtaatgatgaatctagggagggggttctgactgccagagtcccccttcctacttcataggattgctgtgcgtgaataagagcggcatcttaaaatgtggcacagggagtcaaatgtgtgccctatagtttggcacttggaaagatacactatgataaaaggccattgaaaggcctattttttatatagttttgtagtgtctaattggtttaattctttatgttatatctaggaagtggagagtgtgaatcaagaaaaaaggcactttttttaagtaagacaacacccttaaacttccattagaatactaatttttatttgtagccctgacttctataggaacaatataattttgtgggagttaggcttccattataatgccaggtgatgccacatagccaaagtgttaatgtctgtgttaagcttctgtgatcagataacacattagctaactagacttcttttccatgttacttctggcagatctgaatttaatccataaaactcggtaacttgtagattttctttctttttttttttttttttttgaaacagactcgctctgttgcccagggtggagggcagtggcacgatctcggctcactgcaacctcaggttcaagcgattctactgcctcagcctccctagtagcttgggtctacaggcatgcaccaccacgccctgctaatttttgtgtttttagtagagttggggtttcaccatgttggccaggttggtctcaaacgcctatcctcaagtgatccgcctaccttggtctcgcaaagtgctgggattacaggtgtgatcactgcacccagccccaggtgacttttttttttttgagacagggtcttgctgtgtcgtgtaggccaaagtgcagtaacacagtctcagctcactgcagcctcagcctcctgggctcaagcagtcctccctcctcccacctcagtctctctttttttttatttttattttttgattctttcagatccagacctacagagacttttttgtattttttatagagatgaggttttgtcgtgttacccaggctggtctcgaactcctggcctcaagcggtccacctgccttggcttcccaaagtgctgggtttacaggcctgagccaatgtacccagctggtgactaattttgaagaacttaaaacatttattaataattcttcattgaacttgaacatttattgtccatcagtaaaacagaattcttccctcttcctttcctgctaacaggtctcctctttctttttcaactagaagagtagggtaaagaatttgtggctggggcttaggagttgagggtggcgaggcacctgcttggagtgaagcatgtgggtgccaggccagacgcctgagaaccaagggtgcctgaggctgctgggtgcaggattgcagacatctgggcagcgcactgagcactagtggggccttcgccaaaagggtactggatatcttggtgtgaagttgttgacctctgggtttattatctgccattcagagtttgatttgtccccttcctcattagtttattctgttgtccgcgttttattacattctagtttagctgttaaattttagtcttagaactttctttaaaatttttattttgtggggttgattttactctatgatgtaccagattttatgctgctttaattggctttttagaacttcatactttatcttttttagtttgcctttttgtcttttaattttctttttcattgtctaaaaaacttaaccaaatagtagacagggcttaaaggaaatgctctgctcttaagttgagaggctagacactctcctctgccagtattgagcccttggcctctaccatctagctgtgtattttagtgtggcagctcagatcattttagagttgtattttgtcacaaacaccctgcatcacattctgtgtggcatcccatgccacaaaaacatctcttttacttcttatccattaggttcatttctttattcagaagtcttttcaggatataaagtgtaagaatatgctttaatacctttcagtctttaaaagattataatgtaacattttggagaagcttgagtctctgaaaacaaacctgattaattctcatgacctaagcctcaaggttaatttttcccaatatggtgagaaacttcactaacttatcccatctgaagagactgattaagaactccttcccattgtccagacattctcattagctgaccatattcccatcacatttgggtccacaatgtggttctttttcaagttttctttctgttcaggacttagatctattaggccgacactaatcaatgtttaactgtgttctcttttgtaataaatcagggcagctacctggctttccagtaaattatggccgtttgtatcaagctttgtttagaaagccaacagaaggaattggttatctatactgaatccatccaaccccatttcaggtaatagcactaggccgtccttacgaacttacagttgtaagctgaacatgactacttgcataaaggtagattgcctagactatctctccatgtgacatatactgctctctgaatataaagtttgtgttcttcaaatgcctgcttctaagagtttgcattaagttggtgtatgccttggtgccattgggggtgattgcagaacttaagaccttggtcacttagctatggaccctgagcacatccagctacccaccagtgtaacccaattctcatcatgaaatgtgaaatgtaagtaaggctggaggaggagcagtggcccttcagacctccagcagcatcctcagaaaatgttctccatctgattacaagggcttgtctaaaatgaggagcagatggctctatatctcattgtcttgcttcatgagtggatggctctgtctctcagtctctagcctcatgagtggttggctccgtgtctctttagcctcacaagtggatggctctacgtctctctagcctcgtgagtggatggctctgtgtctctctagcttctctagcctcaggagggatggcctgctttttggtcattatcagtaatgatgtgagataatggtcacaaaagaggtttgtgagtatggaggcaaggtatgtagatggtattcttttctgttggttttttaaaaaatgctaggtttcactctatttttttgaactttagcccgattttactgagctttataggcgtttcatcaaggttgacgctatgtgggggtttcttatatgagttaatgagaaaaatatttagagtagtgcctggtacatacccagggctatgtatgtttctgctgttgttattgctattacttgtactgttgtaactagaccagttaacaattataagtaacctaccagagtaggctctagaaatgtaaacgtaataagacacagtttcttctctgcttgagcttacatgatagttggagaaagacacacatatagtgctttgattttaatacattgcagtaatgttaccaccaacttttgtgtattttatatatcccttgtatggggtacatcatgtgacatgtgggtggagtgaggagatcatgtctgatctagaccatggtgattagaaaatgcttcttggaatgagtggtgtccgcgcagggtcttgcagatgagtaggttgggataaaagtgtaagtagaagagatacatgtgtgttttggggaatagttctgtatgcctggaagcataagaggcaaaggttctggtacacccatatggagaatctcagacattatatgtagaggtttgaaacagaggaatgccccagtcagatttgccttccagctggttactctggtgacttgagatgagttttcaggtgatgttttggtggcattaccatgatgctgaggtgggaaatacaggagacagagcaggtttaggagaggaatgagggcagacatgatttcttcagtgctggtgccattcagggctggaatttacaggtgttccctgcacatggcctagttattcttccaactcacaggctgccatgtggctgtcggcttgagctaggcccatgagtagccatcactgcagctgttagaggagtcttgtggttctgtatctgcgtcaagcagctcagtggccttatcttcaatattgcaatgttggtttaaggaatgttacttcttaaagacattctcatccccccgacctagaacagtggcccttttcatacgttccagcttctgttgtaatttggaagaggaatatatgtctgtgttttgagtttgacattataaaagactagttttgacccttacggatataaatgataactatgcatgtggactctatgtcctttctccaccggtctgatgttgtatagccctgcatgtggggtgtgagggtgatgaggcagtggggagctgttgtgattaatagcctgggcgggaaatgatatgtgtctgaactaaagcagtggtcatgggcatggggaggagtgcactgtgggtctgtttgcttgcttattcttttagctagtgcttaggaatgtcgatgaaggctcttccttctatgtatgttgcttggatgaagtcatcctcagtgaagggggtcctgtctgtaagtctctgcagttgaatcggcccaaatgggtctgagccatgaccagagaatactttccagactcagctgcttgtttttcacatgggtgtggatgttaactatctgtgccattttctcatttaaacctcataataaatcttggaagactgtataaaatattaacgttattttacagatgaggaaactgaggctcagacaaattaagtaacttatccatggtcccagcctataaatgacagttcgaactggaactaaggtttgtcttgactcatatcagtgctcatatccaccattctagattacctttgtttgttaaaagaaaaatcttgacttggatatttttggacaaagcagttttaatacaacacttagttgaaaaatctcaattagcttattgcagaatagtagcaaaggcaatttaatttacataacttaattttgtccttgatggaaatgttggagggtggacactgaagattttgttgctttttttttgacttcctagggtgttctttgatttgtatattgatggatggaaatgcttagctgtccgttaacaacatgaatagtgaaaggtctgatgagtttagaaatctttccatactcagatctgggataagtgcttcccttatctacaggctttttgtctaaacatttggagagggactgtctgactttcagctatcttggaggttccatacagttcattcttgggaagggcagatggaaaatcattagcacttctctccttcagcaaattgatgtttcctcaaacctgggctctggtcggtttccagatagtaagccttttactcctgtaggaccacgcatgcagggcctggcagccctctaaattaaaccgtgtacatcgctctggtatagagaggtcactgtgaaaagcgcgagctgccaactcactttacctggcagtggttcaactctttgacaggcctacctctgatttaaacaaatttgagaaatatgtaaagttttggaagcagttttgcactgatttgataaaagaaaccacaaaacactgcagcgcaggtgttgagaatgtttgaaagctgattgagggaagcagatggctttagtcagtggcatccagccaaaagagcaggtgctggtcatgtgaccgctggttaccagggtaatctgattgctcttggcgtgcagatgaaaggaaaggggcccagtgttcagctgtagtattgtataatttgtggcagttagagcggaaataaatgctggaaatggaacctcatagtaggggagacttctgtccatgtgtagcgtaaacactaggacagttggatgaggaacggttgtatggatttttttttttaattttaaaaatattatgctttctgtggatctttcggagacagtttttagagcacggccttttttcttttcttttaaataaaaataactttttaaacctaactgccatttgctataatcttgaattgttattttcttatgtagctatttactatgctaaaatgttaacaaaataaaactctgagtattaagaataactagtttaagatgatcaaatattttatttagttgaaaaaatacattttaggtgtgtgatgggtagtttattaacaatacttttgaaatattttacatgacatatgctttattctaaaagcctatagatatcttggcttcttccttttgtagtagctgagggtaaaaacatgctgtttaatgcattctgtcagcacattttcctgagaacttacaaacttcaataaataaaatttttgaaggtttttgaaatacagcttttgtttttcacaatttattggaatttgaggctccctagaaatattttttaaaaaatcattactgaggttggattattttcagtgttggataacaaatagtaattggtgttagaaaatttgcaactgatggccgggcacagtgactcaatgcctgaaatctcagcactttgggaggccgaggcaggtggatcacctgaggtcaggagttcaagaccagcatgaccaacatggtgaaagcccgtctctactaaaaatacaaaattagctgggcatggtggtgcatccctgtaatcccagccacttgagaggctgaggcaggagaatcgcttggacccgggaggcggaggttgcagtgagccaagatcacgccgttgcattctagcctgggcaacaagagtgaaactgtgtctcaaaaaataaaaaaaaaactggagctgatttggaaatagaaatggaaggtagcgctaaatgtacataaagtcaggtaaaggttctagaggtaatggcaaatgtaaaacatttttttcttgaagtttatgtcttttgtcttatataatattcaaattctaataacatttgtcagcaacatactatgaaacatgcactttattagggttgctttactgtatttttatatttcagagaactgtctttcaaaaaaagggctaattgtgattatctcaaaaaacacgtagcaccaaaataaagcttatatttaattaagaacacagtacctactaaaattatgtacaacaggaaattgctatgtatttttattacattctaaaagattataagttgaacaaaaatgtaactggatggtataaaagaggataccttctagtactggtcaaaagaatacttaagtatgtaaaactatccacaaaaggcacaaagagaagatcatgatatcgtttttcatgacaattaaaaaaaagtgttctgtaccttaaaaattcgatagcaaaactacttcttaatctgattttttattatggcttgatatactggcaggcattttgcacaaatgtactatgtgtggtattagtttttgcatgcagtttatttttaattaggtcatatatttgctaaaagtcattaatatggagttttgccaggaaaacttaattgggagttgcatttaactgtaaatagccaatatgtatggatttatcagttgtcattgatacttttgggatattaatgtgggaaatataagagacatgcagaaacacattaaaagtgaacactaagcgatccactttgaattctagtaataagaaacctgactcagaagcaagtgctttgaagaaaaaggtcaacaagggaaaaacagaaggttctgaaaattcagacttagacaaaacacccccaccatctcctcctcctgaagaagatgaggacccaggtgttcaggtaatacaattattgtgattcccgagccttggttatttggcatgggtaactttagccatgtatgaagtacacaagacctcccctatcttgttatagagatgctcttgagatgtctttattgtagtctggaacattatctccatagcgatgtagggagggggagcgggcgtggaacaagaaattatactcctgacaagagtggcttggttttgctatctttgactctataattaataaggcaaagattcttcatttatttctgtaaatgtatattttgctgtttatgttattaacattgttaatatactggctcatataaagcttcattcacatttttaaatttctctaaagtttggttgattgtcacttttttgaattttgcagaattaaaaatcaagatataatttgtagtagcctgtctaaagtttctgacatctggcactcaaagttgagatatagtcatgtaatctaattcatgtaatactaaagtttctatgaacaagccagtgactttccaaatggcaactctgcagaatattctcccgactttaggagagttttataggaatgagttgaaatgctaaccctgaagtaaacgtgaggaatgtaggttcttgtgtgtaaagcatactgccttcactgattggactgagaaggacccttacaagtgacagttaaaaattatttccttgttaggttccctggaagcatgccagtgtggtccactgggatggctgggaatgtaacttatgtgaatgacatctaagttgtcaaggagcagttactgaagagttgtcctggagtaggaagccagcctctagaagcttactggactttttcttatttagtacacactcaggactttgcacctgtacccccaccagtcagaaacaaaatatttgtagtgtgcagctctgttccaaagaatttcagatatttttggctttggctttttgtttgttagagtagaactccctgatacctataacttcacagaatagccttaagctagacctgaaagggagggagagagagatgaagtgaatgaatatgttttggtttagttcggtttggttgtgtaactaacagtgatacctttggcagtgtgggttattatgtaattttattttatacatcaatggaaagatattgggaaggtaagtagatatcattttttaattgcgtaggctgttttacaactaaagtgttttattgatttttgtttttttactgagatctggtcttactgaatcaagtgttttaatgattttgagttttatttttatccgtaagggtattttctcctgatttatgtttgcttaaagcaggacctttatgtcaatagtatttggacaacattaagaatttgtttgcatcagtagaggaaattctgttatgttgttatttcacaaatactgctattgtttttttaaaagtctgtttatattaattcagactcagatggaccttatgaaatactagctttagggttttttttttttttcctgctgcatttcaaacatagaaaactgctaatcaattcaagtgaacattgatgtatcctttctaattggctagggcctaactgttacgtgttcaatagctaatataagcaaccacacaagatctgactttgaaagctgtgttttcttggtatgtctgacacaggaagtgatgctgactggttgtttattatgtttcttcctgtaacacatgcatgaagggcttagcattaaaattcttgagttttgtgattgatttactaaggtacatgtcatataattttaactaactcaaaattgtgtcacaaggtactgcaacagtgagatcatggaaacatttaaatgttctatttgttatacctgttttaagtatcttttctaaagcaatccaagtttaaaaagttgatatattattttagtgtcaattcaaaagttttgaattatggtttaaaggcagttcttacatttcattttgactcacaaaaatctttcagataataatagtttaccagatcacaatagaaacatgttatgtattaaataatttaattttacattggggaattgtaaaaggaaccttgatactcaaaataaatgtaagatcaattattattttaaaactagagaagccacgtaacattaaaaatttttatcaaattgagttataattgtattttggggtgtttttacataggaagtgacctcgtatccactgctaactaaccccatcactattgcacagatttatatcacaaagttgatatcaggaggaacttacattttaaaagttatacttaccaactcataaatttctatttaaaaagaagaaagcacactgtcttattgtactggatggaacccttctttaacatcagggtgggatttagcataaagtggatttgtcttagaccctatccagttacttatatggcacaacactgtgacagtggggtcttaagcagggaaacctgatgaaacatggcaggtagatcactaggagcacattgcttcttactggaatggtataaagatggaaatataaatgaatccatttaaattgagttaaattgacatatcaaatgaaatacaacatgttatgctaaattttgcaatattaaaattgttcttgataatggccttttatatcttgaagaaattggtggtccagaagtgaggaatggtaaagtgggcatgagagcaggagtaagtaggtcagctttggaaagaaaagggaagctgtacaaggtaactgggccatttttctttggaaagctggagctgattaatgatgactttagtcctactaattacatctcacattatgtaccatgtactgttctaaaagctttgaatgaattcccttatgcgatcttcatggtattcatatgaggtagttactgtcattaaccccattctacagaccaggagtccaaggtccacaaaattacttgtccaaggtcacatgataagagtcggggcaagttcaaacaagagcacttagctctaggacttacaaggtcaaattgccacctgggatgtgggaaagtattgcagatggcagaatactctgctggaatctctgtttcctccacctgggattgatctgggcagtgccaaagctttgtcctgtagaggagggtcccaggaggaacctctggcccatgtcactactccctccatgtaagccacaaggaagtctcttaataaactttttctagaatggtctcacatcagaaaagtactttgcacctctgtggccacagctgtgtgtggcttggagctaacaatatctaactatctatttgatggtcatattataccgagtttgtatcgtgaactgtctcaaatccctttttaagagcagggagaacataaacttaagattaaaatcaatcagtcccactctttggggaaaagtactgggattgtgttcatcctgacttgagaaatggtagtgcctgtcttgccttaggtgcacacaatgaatgttttgcctctctctgccttactttctcaactttaacattcttgagactctttaaaaagtgttatttcataattcttagaaaaaattttgtgtcaaaattttcctcaatatttttatttcttctttgtgctttgcaaactcattccataggttgtaatattcttgaattcattagcagcttaaaactttacatgtgtcattttcaaatttagatttgacatacatatatgaataaaaaggttatttctccttattaattagcttccaaaatgaattctttgacaaaacagttaaataatatagaattactctgaacagagttcagaacctcttgttctgttccatttgcttctctccccatctttatagctattaataatctgttgtctgtcttttcacattccttatttaaagccatgtacatatacattcatcttttagcaaatactcattgaggcatagagaagtaaacaagatatacagtctttttgtcttaagaagttaatatatcgatgaactgcacgtctaaatagatacacaacattttttatttatcttaaatagaatcttaagctacttcttgttatgtggcttgtttttcttcttattttacaattagtcttgcagatattcccaaacttcctggaagtgaaagtagtgagtcaaaggtctgcatgtttaagttttgatagataggaccacattgtcctgcaaggactgtgtgggttgcattttgaccacaggattgtgagaatacccagtttgccagtgatcctgctaatactggctattaccaatctttttaattttaaccactatggtaaaaacattatattttaaaaagtaaaattactgtccatagtcattcattatgaattttgccatttaacccttcatctcttcagaaattttcagagtatttcttttaggatcaagattaaaatacaaaaaccttttatttaaaatggcctgaaatatctggggcaccttggttagtattataacaatatttgtatagaactttgtaatttacagattattttctaaagcactgattttttttggactttttatatgggaaaaatgttaaaatgtacaaaggtagagagagtagtataatgaacccctatagattcattagccagctccagtattgctgccacttttgatggacatactgactgactgaggaactagatttgttatttccattttcccagttgaaggacatgtagctgggagtggcagggctacagctgtcccaggcgtctgactccagatttccacccatttctattgtatttgttagcactgtgatcttttcacatcatatataggattagcattatcaccttttccttaagattaatttaaaaaaattcatccttccactctgcgccattataaagaacatttttctttttttttttttaagacgcagtcttgctctgtcgtccagactgcagtgcagtggcgaaatctcggctcactgcaagctccacctcgtgggttcgcgccattctcctgcctcagcctcccaagtagctgggactacaggcacccgccaccacgcccggctaattttttttgtatttttagtagagacggtgtttcaccatgttagccaggatggtctcgatctcctgaccttgtgatccgcccgcctcggcctcccaaagtgctgggattacaggcgtgagccactgcgctcggccacatttttctttttaatcattaatttcaaggccactgtcttgggtttttgttttagaagagacggtccagcagacaggtgaagagaaagcgctacactgaagacctggagttcaagatttctgatgaggaggcagatgatgcagatgctgctgggagggattccccctccaacacctcccagtcagaacagcaggttagtaccagatctgtgggatttatggatgcattttaaagatggactagaaatttcattgctgcaatctgagaagtgcagtggaagcattggactttcagcaggggaacatccacctaatgttggataatgtgctatgggaaattcgttgtttagcaatatcttttaaaaagccctgttcactgcaatttatttttatataagactgtgatatgtaatttgacacaattttggagaattaatgttctatgctgaggaagagtcagagttggaatataaggaggctgaatatacctctgagaattcagtgctgtggcttctgggactttaataaaccactcaagcttgtctcctgctgttaggcactgtgagaacccctttatgaaattactgccttgtagtacccagcagggtgtactttattctctgtgcaatgtaaatgatggataaaacagtttgtataaaatatgggtagtgtaggattgattattgtaaagatcttttctaaaaaaataatgcttttttcttattgaaaagtatattaaatgcatctttgcattttatttggtaatttgttctatgttaagttgttacataatgttttatgtgacctccatagataaaagatgcctactatagcagaatgatgagtatatttaccccatgggtatagatgaagaaaagttatatttttgactgctaacgtgcagagattattttgtcttggtggctagaatttctgattgctctctagctttagggacctaggctggtccacgtaattaaaccatataatcatgaagtaatattaagcacagatctcctttttgcctttcagtagagtgagatttttgttcctttcaatcgtgtttctcactgataactttgtacccagtgacttaaaaggtgtggaggtggtagcaaaggggaatgatttcttgctcttatagcttaggatgagatgttttctatttggattgatgcacatgcctttttttttaggaatctgttgatgcagaaggcccagtggtagaaaaaattatgagcagtcgttcagtaaaaaagcaggtgagtgccattggagccattaaaatctgtgaggtgtatgtgactcttacaggattgttggctttgtaattttcttttaaaattctaatattataaaataaaacttccagtaatatttctaatcctgtctaatttattaacccaatatgaatctttgggatatttgaccccagatgaaattaaaatatatcaagcagtcagtgctttattacaccattcagagtggactagaaactcacaagtctccaaataaatgtatgggactttcagagttgtagactgcctttttcataaatattattcataaaaatcaaaacatgaatttacttctaatctctctcaggaaggttcccccctctttcatgttaggatggaaattctgtttgtcattttagcaagtaggtgttttctcatgtgttttgtaacattttctcatatacaattgaattattcattagtgtctttcttgccagtgcaaaggtgaaatacaggtctattttcagtgtaattttaaaaaatagttttgacttaatacttcagagttattcaaagtttctgttcatctgcaaaggtgagctctaagtatctgtcactagcctgctagctttgtcactgaggtactcatatgctctttaacaaaaaaatgccagtgacataccgtgttttcttttcctgatgaaaattccctgttttagctaactcccttcttacagcccactttgagaaaatgctttgcttagtttgaataattacataaacctgcaggtgcattaggtattacaacatgcagtttttcgtgtctctaggaagtagtctcctttagacataggtgtctgtgtcgcagcttcagtcattatcaattccacacagttcttttgtttttatttgctttcaagaaggatggaactacaagttcatgtttcagcatgtaaaacaaactttaaaaaataatatataataaagacatggtctagctgcgaactcctgggctcaaacatttctcctgccttgggctcccaaactgctgggattacaggtgtgagccatcctgcctaaagttgtttatttttagcaaaatgtatacaaagtatctcccagtaagagagttgaggaatggaggatttacaggactcagtgagagtcctataataaagtgagatcccaggcttatcaaataggaaaccattactattcaaatactgctattgagtgatccttgaacatgttattgcaccagcagtaaacttctctttactttcatttcattagtttgttttgctattgtgtgattcaaggtatgaatttttatcggaatatacatctctagtttataagaaaataatttagagcagtatgtcaaggtgttttccagttgagtataggggatacggggtatggagtgactggccatcttggtgactctttgaatgtgaagatttcctgatgaattaaatttcccacctgctcaagtaggaaacaagcactatttaactcattagaaggttgcatttttgtcctactaatgactctagaactgctaatttatgaattgtagatatacagtaaaatttaaatacttgacatgctttgaagaacaatccccttcactgaattgaagtgacttgtttgagtaaatagcatgtcgtttagatgggatatattaattttcattcaattggtagtgcttcagcaggcatactcagcaggtttaggggttgcaaattataattagctctattattcagagctatttagactatatattatgtagaacattgctttttctttctgttttgcccactttagggtttttgtcttcttttcctctttagctaccttttaaaaataggtacccatggtttaggaatagatactgttaaccatttaccgatgactgggtttgtcttatcataggagattaaaaatcactgtacaggagggtggacatttgttgagttgatgaatttgaagctggagaaaattaatggaaaaaattcttctggaagggagatatgctttgaggtatgatttaaaataaagaagagatgtggagctcatggaattgcttgtcagttactggtatttcttaaagggcaataaaaaaatccattagaaggtactaaacattaacaggtgctaactttttaaactgctaatattctcaaagtagatactttagttatcacctttaataacattggaagaaagtgttgcaaatagaaacaaaaggaaatttgagattttttgtggattcaatctatgcctgctggtctgtttcttattaccatgaataatttaataattggcagtgagaaggtgtctttatctctgccaggcagcactgtagaaactggctatgagctctcagagcctgtccctgcatggtgttgacccagagtggagactccatgtttttcaaagtcagttgacctcatcactgtggcctgagaagcatcatgatccattatgatggagttgtgcaaacataaaactcacctggcagaggcaccgtaagtcagcacctcatgttaaataggggtggctcaagcatttatgttgttctaaacccaggttaatgtctatgatacctagttgcatgaaatagttggtgcctatttgaattttgaggtagatatatgagtagatacttggattgtataaagcctaattattttgttttccttgtttagtcagcttgtagctgtttctgctttgagccattcatctttggaggataattcaaatccttttttttttgtatcagaaggccaaaagtagttttaaaagtgaattgtgactgtattccctaaaattctttatttttctttaagttaactacaggacgtattttcagagtgtgtgttttaagtatgtagctgagcctcctagagtgtaaagaaggcaaaactcttaatctcatccattgtcatgtccttattttttccctaagtgaactgtgatttggtgtctctagtaaagtatacagtagatagggccaaaagtgaaaagggattcatacccacgccttattgataactttattgaggtgctttttcattcttttgtgtattatttgacagagtgttctgtttttttgctctgtattttagtttcttgactgtgactacttaatttagtagtaggatgcataggaaaggcctaagttaggcctagactctgggtggctatttagaatccaggtggctggagaactcatttattgccttctcaaagtttctggtttgtttgaacagtgggacaagtatggcttaatatgtttgaaactttaagtgtcatatgaataataaggatttccctagactaattttggatctaatgaaaagatatatacatttctcagaaaaattctatttaattcataatattactgggttctcaaatttaaaggtagctgctcaagaaataaatctgagtgttgtgtgtatgtatgggaatagttctttgacttagttattcattgcctatgcctgttgtagaatggcttctgaaaatagggcttagaggtgagaggttttagggtaggggctgtttgaagctgtcaacagaggctggtcaaactgcctcccatttagtaaataattgaaatgatgtttctgagggcttatgaattcacacacttttgttcaattgttttactgttcagtaaaagaaaagaggtcagcatgatcatatttatatgaaaggaacggtgaaaaacagctctatttatagttttaggggcaagaaggtggtgatccaatatgtgtggtccattaaacagaaccaagtgttgtattctgaaacatccaaaagataacaggccctgggacacttctgtaccagctccaggtgctgctaaatgaagtttcagaacctggttggttcctcctaggcagccctagactctcttgtcaggcatcttcacagcaggttcccagaggaatagctgatcatgacaagaaaatgggtagtaatgagagttggggacagatggctgtaagagtcagagctttctgggaacagacttgagacaaaataaaaagtgtctttactgttcaagatttgatcctgtatgtgttggtgcccacttagaattatgggatgatgagaccatttagaatgagaagaaaagggacagtatgggagaaaagatcagacagaagaatcaggagaaataatacgagcatagacatgataaatcttgtttatgatttataacatatatatcagttatataaatgatacatttgatacatttgaaggcattgaaaatgccttcaaaattgaaaaaatataattattatcagaagggcaaaagctcagacatttgagttccattcttgatttgaatttcatgataatgctgtgtgaagaatcaaaggatctagtttcatccttgcttctctttttccctgatcatctaccatctttttgtctttctgctggaagtctggttctatataaagataatatatcttaaaatgggaggctgggcgcagtggttcaagcctgtaatcccagtactttgggaagccgaggtgggcagatgatgaggtcaggagattgagaccatcctgtctaacacggtgaaaccccgtctctactaaaaatacaaaaaaaattagccgggcatggtggcggggcctgtagtcccagctactcaggaggctgagacaggagaatggcgtgaacctgcgaggcagagcttgcagtgagccgagattgcgccactgcactccagcctggatgacagagcaagactccgtctcaaaaaaaaagggagtagaatggggaaatattaaggctagagagaaaaaggtagggtgggtcttggatggatggccacttgaacttggtagtatttatttataaattaattccatgttccatttatgttgctggttcttgaagccatccaacaaacatttctttttattttggataactaaaagtttatgacatagaaggtgttctgatacattggtttaaaatagtgctttatagttattacgtttcatagatccattatggcacaaccagatattaatagatattgaccactcctgcatatccagactccttcttgatgatttctagacaggccaaaactgtttaaaatataggtttagctcggtgtggtggctcatgcctgtaatcccatcactttgggaggctgagacggggggattgcttgagcctaagagtttgagaccagcctgggcaacatggtgtaaaacccagcctacggaaaatacagaattagctgagcatggtgatgtgtgcccgtagtcccagctacttggggaggtggtagggaggggcaggggttgctgaggcaggaggattgcttgagcctgggaggttgagtttgcagtgagccatgtttgcaccactccactcaagcctgggtgacaaagcaaatcctatctcagaaaagaaagaaaaaaaattaggtttaactgttataagtgagagtttcaaagaaaagtttaagttcacaatctttgaaaatggtttgaaggttggagattgaggggactagtacctttgaacagatctgtgccagtctgttatccagtagaagcctttgctcttttgtttgttctttgccatgttcctacttgccttgattttcttcgaagcatttcggaggtggctgaacagccatacatgaccctcaaggcaggcttggggtctcttgtaagagtgtaaaagcaatccccaaacatctgtaagtggtgtttatattttagatccctgatttatctgatcaaatgttccagaaggaaattacatattatgacttgtttaagagcctaaaaccaaaaggggaataaaaagagatgcctaaaataccatctgaacatcatcttctgcatacactacagcagataggattaagggagacattatagataatcttactactgaaaactcttgatttggctgacatgtatcacaattttaaccttacctaaatgtagtatttggagtgttaattttatttggctgctatgtgtgtgagacatcttgtctgagagattttaattgtaccattgagtgaaactaagactatgaatagtgatgcactgaaattacagcataagaacaaggtttacttttatatggtttcttgtttagagttattaagtatatggagaaataaatgtcttttaaatattttaaaacattacaaaacccacaatgtaaagttgccatgaggcagccaaaaataatacatatggcattcaggagagcagttgctaattggctgctgcctgagaaaatggtacacttggcgtctacttaacactgtgggtttggcagaaggccaaatttggggtcaggttgttgtgaatgaagctgcatgtggttagggaggagttaaagtgattcatgtcttagaagctctcgcacgttgagcagaggtgcgtgcatgggcctgagcgtggcagtcttcgtggccctggccacctcccagcacacggtgtgctcatcttacgtgaaggtcctttgctgctcttttcagtcctattttgtgctcatatgggagtaaatcattacttttaaaatattctagtagatggttttaaatacatgcctgaaattttcttttgttgcagaaggaatctggagaggaggtagaaattgaggaattctatgtgaaatacaaaaacttgtaagtaaattgtgattctgtttttaatggggggctatattttccaagtagtaaacgaccatttttttttaaagttgggaaattaagaaactttggtatgatttctttagtcatcatggcctgggaggccattttttaaccaacttttgtatgtttgatattttatgaatttttctggaaaatgtgtaattggtgtaaaagttgactaacttctgtgtataaccaataagtatttttttagagaggataaaaacttctacaataatagaaaaatgaataaagcagtatttccctgtcctctgatcatgaattctaccctgtggggctacacttcgtcccttcacctgtgcatagtgtgcgaggccctagagacaagaactctcctgtggaatgaaagctctagagaaccatgacatcactcaggttctaaaatgcagtgagctatagctttatctgtttttgtttgtttctgatatttatttagtagatttgaattcataacttaaaaatctgaattgaaaaacacggtgagttgttgtccttgtagattctgttgtaagcagtacacctggcccagacagatattgtgatgagctaggatgttttcagagtcagtaatcattctgctgaagaagactgaggccattttgtaacctaaataacaatcatagaacaaggacaaaaatgttcattgataatgtaaacattaaatttcttttttaccccttttaaggcaaagaactaaaccaccatattaatacattcttagggctttaaagagaggcttttgtgagttgctgtgcgaacagcctcagaaaatttaccccaccctagaaaatgaaagcatcaggtgccatgggttttctgtcattctctcttgttgtagttggcactgttaataaattgatgcacttctgaagaagttgtgagtaaaaccttttatcaagtaaaaagataaagaagtctctatcagttttatcatgagagttcaatgaaatacagtctgacaattttaaaaatgctcggaaaatgttaactgtcatcattcttttgtcctcagagcatgtcagtttacacatgtggaaattatgcctacaacacgatttcctatggtaaggaggaggtaaactaagtaaaccagagggagagagttcccttgtagatttaccaaattgaaacaagagcaaaggagttcaaatatcaatcaccaaaataatggcactaccagagagacctccagatcagtgtgtgacagtgaggcctgagctgcctccttccagtcagcctgttagtgaccccagagatgggctccgagttcctgaccaggtgccagtgccagaccaggagactctagccctcctcaaaagtcatttgaggtgaggtaaagggagttttgaaaaaaaaaaaaaaaaaaaaaaaaaagaaaaaaaaggttttctgactgtcattattgagagctaagagaaattaagatttccataaaactaagagtttttgttagccttatatttggatacaatttcacatttatagaaaaattgtaaaaaatagtacaaagaatttctgtttttctttttgtagttaatgtgtatcttccggaaagatactttaagacttaaatatggttgtggttgctaaggggtgatttactaattccatcatttcttctacattgattggttgggtttttaccgtaaggaagagctttaccctcttgtctatttgttaatttatagctgagcggacttgtggcttctcattttattcaagggattataactctttactgttgtagtatttactttgcccacattatcccagatttggtcagtgggagccccttcagactggctcttctgtctttttgccttgtccccatttttctttgaacattttcttgctttctggcaccagaggatgttccaggctcatctcgtaacttccctgttttagttatggagtcagttacttctccaagaaggcttggttgttttcagtgaaggggggggcattgagaaaccaagattggggctttaggtgtgctcctcgttgctgaggaattgttgcttctagtccctctcagtggataggactgggagagagagagagtgtgtgtgtgtgtgtgtgtgtgtgtgtgtatcgagttacacacacacttatctgtttattatatacacacacatatttacctacctctccaacacaacagcaaaaacaatgtgtatatattgatacttccagtattattccagcagcccagggttcattctctcctttcccctttaatattagtaattcccttcttcaaccagaataaacctggctctcttattttttatgtttgctttttttcagtcctaacatatataggaagtgatttcagagttactagcccatatttctgtgacaaagaagcctatatttggttagctttttgtctttagtttgagggcatagggactaaaactttatccaaaatgtccttgggttggttattctcttttcctaccccaccagtgtggtttgttatttatttcaggggtccccagtccccaggccatggatcagtactggtcagtgtcctgttaggaacctggccgcacagcaggaggtgagcggcaggcgactgagcattaccacctgagctctgcctcttgtcagatcagcgtaacattagtttctcataggaacgtgaactctggttgtgaactgtgcatgcgaaggatctaggttttgtgctccttatgagaatctaactaatgcctgatctgaggtgcaaccgtttcattccaaactgccctccaccaaggacccgccccagtccgtggaaaaattgtcttccacgaaactggtccttggtgccaaaaaggttggggcctcatgatttatttgatacacagtatgtttctttagttttggtttgtatttgtattcccttttagcccccgcttgttgatttttattgtttttcaagtttgtgaaatattaatatgttacaaaagtcagaactatacacaaaagaagtgtagtcctccctttccaccccattcctgcttacttccttactaatcccaggtttatcctttctgtaatttttggcatgagcatgcaggtataatttcctcttcgttcttacaaaaaaagaaattggtatactgttagtacatttttgtgctttgctttttttcacactacatcctggaaatcactctacatctgttcataggggtcctcctcattctttgtttcagctgtataatattccattgcatgactgccgtaaccattcaaccagcctcctgtgtatgtgggtgtgtaagtggcttctgatgttttccaattacggataatgctacaatatatattctcatacatatctatatattttcaaattattggaggcatggcttccaggtgaattcccggaagtgagtttactagatacaaaaggcaaacatgtatgtatttttaagagatattgccaaattcccttccttcatgttgtatgaatttatgttcctgtcaacaaagtatgcaaacacctgtttccccacaacctttctaatatagtgtgctgttttactttttaatttttgtaagaaattgtatttcagttgaggttttaattagcattttctcttattgtgaataagaacaccttttcataagattaatggccactttttacatcttgctttgtcagttgtctgtgtcttttgctcattttctgtcatgctcaacttttaagagctctttatatataagggatattagttctttatcttgggttatatgttgcaactatcttatctcagtttcgattgtcttttgacttcatggtgtttattgcattgcccattaaaattttttgtacggtcagatttatcaattttttcttttattgtttctagctttagtgtcatagctagaaagcctttccctatatccagattacagaggaatttgtccatgctttccttgtggtttcattttatctatttaggtgcctgatccatttggtgtttattcttgtgtattgtgtaagtcatggctctaatttaattctttttcaattgttgttctagcaccattattaaagagtcaatttttggccaggcacagtggctcatgcctgtaatcccagcactttgggaggctgaggcaggctgatcacgaggtcaggagcttgagaccagcctggccaacatagcgaaaccccatctctactaaaaatacaaaaaattagctgagcatggtggcgggtgcctgtaatcccagctactcgggaggctgaggcaggagaatcgcttgaacccgggaggcagaggtggcagtgagccgagattgcgccattgcactccagctgggcgacagtgtgagactacatctcaaaaaaaaaaaaaaaaagagtccatttttgactcagtgatttgagatccaaactttattttgtcctaaagtttttatttatttattttatttatttttttatttttctttatctgtactttatgcctttgaactgcttgtctatttataagccagtaccacactgcttagggaggctttatagtgtattttaatatctggtagatctatttccctagtagcttttctgttttattgttttccgggatattcttgcatgtttatttttatatataaaatgtaatactgtttagccccatataaatgcctgtttgcattttatttatttacattgtgttaaatttacaaatgtatgatgttgagttacacagtgtgacaatgatgtcttttcagttggtccagttctacttttgtgtcttgtaagagttttaaatattttcttatacaaattgtacacatttttaattaaatttattgctaagtattttatctttgttggtattgtgaaagaggttttctctaacatatccccttattggtaattgttgttgtgaatgaagacaatatgttggcttctgtatgctaattttatattctgctacattgctggattattttattatatgaattagttttctaattgattctctagggttctccaggtacctgatcatataatctgcaaacagagatagctttacttattattttctaattattatgtctcttattgttttgacttgtcagttacattggctaataacctcaaatacaatattgaataacagtggagatagtaggtatccatgctttctgatttttgtggaaaactgtggtgtttcttcatttagtaagatcctgtctttagaaccaaaatcttcaaatatgtgttaacaaaatacctatcaattcctatcttcctaagctttaaaaaatccattatgggtgttaaagtttgtcaaatgtttttgcagtgtcaatagaaataattgtgtgatttttctccttagatatattaatattgtgtatttttagtgaatttcctaatgttgaaccaaccttgcattcctgaaataagtaactacttggtcatgacatattattgtcttaatgtgatgtggagttgtgtttgttaatattttacttatatttacttataactataaatatttataagtattataaatataaatatttactactttgcactgatatgggtaagggatatgctctttcttttttaactgtcaagattaggtataaatatatacctgtttcataaagagtagttacatttttaaatgaaattttgttttccaaagtgaccatacactgtattatctgtagggcctagttcagattatttcttattagcttcataatatttttcttacattgacttcttcataacttttaaaaaatattttagttctagtccagttaggacgttttcttgccttaattatctattcagacaaagcagtcgtatttttgaccctttattcttccttcctcttcttcctaagcctccagaatgggttatcatcagagtctagaaagcagagtcacactgaaaatttcatcccagtttatagcagataaagcagggctggagccacttgcttatatgcttgtgtccagttcaaggctacacaggtggtgctttgaaggcttttgcacctcagccaaggcaagaatactaactgactgactgcacatgtgcctttttctgtcaaataatttggagactagagcagattatttttataatatgtgtttctttttgtgtgtgtgtggcagggggaagagggtctccctctgtcacccaggcttgaatgcagtggcgtgatctcagctcactgcaacctccacctctggggttcaagcaattctcccgcctcagcctcctgagtagctgggattacaggcacatgccaccacggcctagctgatttttgtatttttaatagagttgggttttcaccatattggtcaggctggtctcgaactactggcctcaggtgatctgcctgcctcgtataatatgtgtttctgattatgacagtattgcatattatttattggaaatttggaaactacaagttgaaagtagaaaataaaatacttgcagtcctagcacccagaaataataaatacaggttgagtatcccttatctggaatggttgagatcagaagtgttttggattttggattttttcaaattcagaatatttgcattatgctttaatggttaagcatcccaaatctgaaatccaaaatgctccattgagcatttccttcaagttcatgttggtgctcaaaaagtttcgagttttagagcattttgaatttcagattttcagatttggaacctgtattagcattttgatgcaatttcatctagtctgttttctgtgtgtgtatgtacagcatttatatcagttcatagctatgtaagtcatatgtatttaaaatccttttttccctcaattatagaaggactaaatgagtcctatctttgcaaatcatattagacatgattatcagttatgtgctacttaatatcataagcatttcctatatcatgaatcatttttgaaaaatttttaatggttgtataatttttgtttttactttttcttgttttaaacttctgacttctgtgaactaaagcacaatttctaagagtactagtatgttgattctgaaaggggtatatatattcaagatataatttctttttaatattgtcatcagaaagagaaataagaggctctcaaggctgtttgaggggcagggagagggtgatgggacaaaagaatattgaagaactaagcaaaagaatgtcagagttgccataaaacattaactgtgtacctgtgagtgttggagaagaaaagggaagtgcatatgtattccagttcaggtgagggaagacaccatgcatactcagaggaggggatggggagtcttgaggggagggggtttgcccagtgcaggtatagatgatagcaagggaaacattcacaggggaccaaggaatatcattgcagaaatcctggaggaacacagtctgggagaccaggaactgataagaagctggtgaggggcatggcccagtgttccaggagcagacagtggttctttcctcctagatttttctagaaggaccaggttaggtttccctttgggaccagtatgataggccttgggtgactctagggcaccctacacctcttatctccaaagaaactgctattttaaatttgaattattttaacttgataaaaacctatttctcaatgataagaggttcaaagtataaattcagaattaaggcctccctgtagtgctaattttatattgaagtataatccattcacttatggaaatagcttgttattaggccattctctctcttctctgtctcttttgtctgtctgtctgtctgtctctctctctctctctctctctctctctctctctctctctgtaacaggtaagagagctggaggcttaggacagaaggcaaattttaggcactaatattgattttctcttcttattctaaacagtggtgggtatattaaatgttgctcagcagccttaatgggtaattaagcaggttattttaattatctgtgtagttgacttttttgaataagacataataaaggattaattatattctacatatttcaaggatattgttttgttctttcagctcttatcttcattgtcagtgggcatctatagaagatctggaaaaagataagagaattcagcaaaaaattaaacgatttaaggcaaagcagggccagaacaagttcctttcagaggtacgacatacctgcttacttttccaaagtatttactttgttaaaatgttctaaatttaaaattttagttccatgaattaagaaaaactagttagtctcatttggtgctgtcaacttgcatattggtaactggttcttgctaacaaatttgtaaacaggaaatttctcattcttcctgttgcttaggctagaagatatgggtccttatgatattatgtggaaatagcggtgatggtatgataaaaatcgtgtaatgaaagtacagttagcagatgatgaaattaagtaagtggacagaagttctattgagatttagcaggttaagaaatctacaatgttaagtacaagttctaagatacaaaagcttgacttctgttggggaaagtatgtggcaaatttcttttgttgaagtcaatgcctaattacagagagttcactaaactcattttcgcaaatgctgtgctgtagtgtagaaactggtaataatatctttgcctgtgtccctttatcccaggtatcagtatagaagtacagcaatacctagggcagagaagaacatctgcatttactagaagtgccagttctgccctctgcctcctcagtatagtcaattacattttttaaaaagtgctttcacaagctgcttactagggtctctggacttaggatcgccaatttggtttcacttacagcctcaagtagataaaagaaaaaccctaacattgaaagataagacttgctgatttattagttcctcttttcctaaaagagttgacagaatgtagactttatgtaaaagaagcgtacaatttgatgcaaaatagtatctgtttaacaacctactttgtactgccacccctttttggagatgaaggaaagtgggacagaagagcacttagtacttttatgtcataaaattcttatactatcaggtagcaagtctgtgttcttctgggatctgatttccatggtcccaactggcctatggtaaagtccgcattcaatgggagatcatgtggttgttcttttactggacacatgtctgcatcactacccctggcactctgagtgtgcagcatttttggcagtgcagtgtttaggaccgagtggaatggagttactcgaatgtgactcaattcatagatcttggagaatattaagaagattcttcagaagaacttggaggaaaattcttttgaagaaagaatcttaatatttgattttgaggacaatgctgtgagattctatttttcatgcccttcttaatgaaaccagagttaaatttttatgacattggatgagctgaaatcattagcctccttttagaaagagacaccctgtgttctgctgaccttttctgtgggccagggggagggagacaggcaaaagcgcaatggtagctttccccccatccctaaatcctggtcctgtttattaagtttatttgtattctctctcctgtagtcacactgtctttaggaaattgtgcctagccctagctacacataccaaggttgaatgtacattatttacctggtaacttggcagctagaaatcttagtttctgtcctgagtgggagttagcagagaaggatagcaatccccttcctccctctcttttatacatgaaagtgcacacgcccccgtttgtttcatcccatacatgatcatggcttcaggtgttccatggctgtactgctttgagattttcagtttcagctgcttttacattctttgtttctccttaggctgccttacaagcctgctgcaactaaaaatgtctattcaaaaacatcatttagactggaaatttcgtcacatgtgtgatgccgcagattactcacttaaagggtagaaatgtgtaggaaaagttaaggattttaattcagcactgactgtgaaagcttatgtttaagaacaagttttcctaaagagagtttttgccatccaaacctagttttgggaaagtttaagtgtttctgctgtacatggataacacgtgtgtttacctacgtctagaagcttttgaaaagccagtgcattaatacactaatactttatattaattgaacatttcaatggatttttttttgccttactaatctacctctgtgtaaaagcctgagatacttgagacatatgtttgtgtttctgctttttgtttcataattcatggttcaaagcttcccaactgggtgttttaagagggccgaatagccagagaaagtttgttgttcttgagcagatgatgactgaactgcttatcttttccacctgcaattcaagggataagaatggtgtctaagtgacttctagtttaccttttgcaaaatattttaatgcagttatgttattgataagttaattgagaggtgcacataataaaatgtgtcttttgttttctaacatctgaaacttgtctgaccctaacttcttttgggtatggcttagtctataactctttttttgagacggagtgtcgccctctgtcacctgggctggagtgcagtggtgcgatctcggctcactgcaacctccgcctcccgggttcaggcgattctcctgcctcagcctaccgagtagctgagattacaggcacctgccatcatgcccagcttattttttgtatttttagtagagacggggtttcaccatgttggccaggctggtcttgaactcctgacctcgtgatccgcctgccttggcctcccaaagtgctgagattacaggcgtgagtcactgtgcccagcctataacttttttttgagtcatattctagtgttttatatgagatacctttgcaggcagcagtattactttacttttgtaaagattgtttaatatattggttaaatgagccaattatttaggcttcatttcgttatccttaatacttttgcctaaacacactatattcaatgtaaatcattagaaaacagattaatgatgagactgtgattctaaatgaggtactaatattggttgacaaatactaccaaacattataaactctgatcatgctaaaatatgaaattagctgcttgcagtgtatttggcttttgaataacattttgtagatatgctataaggcatcggacaactccaggagttacaatattccaagtaacactttgcatgactctgattcttcattgcaaactgtagtttcgagaatgctaaatgcatcgcatgccataagccttttggattgctcattagtgaattgtaatttcacacttcatttaaaatattcttaaacattctctcacagtaaaaggtttcacacggtaattaaaagacccagttaacgaagtctgagaagtctgatttcctcatggggagtgattttgctaaattgtagcatttcaattaatataatagaatttgccaaatgtaagttttatattgctgtgacccaaaatattattgcttggtgaaaagtggaatagtatttcatcttaggaaataagtaaacctttaacttttttttttccctttggtgtagattgaggatgagctttttaatccagattatgtggaggttgaccggataatggactttgcacgtagcacagatgaccggggagaggtaacaggagatcatttgtattacaaagtggtgattcaggcaacccatacatgtttatagagaagatggtagaatcctagacctggtcttggtcagagccttggactgtgacacacttggtctaaatttaactgaaacttaatgatttattattagttttatgacttaataatagtgctaaatatgttttatgtttagtctgagaacttttttaaaaaattgattttcaatatgaaagaaatacattgacattttgcacaattccacaatatgataaagaattcagtacattttggtataaatctgtcatgtagcacaaagtatccttatataattgagtgtctcttgtggcagaatggagtttaaggttatttagaattgggcatcattagtgaagttgatgaattcatttaatgtggtacacagaggctaatagacattatttctcttaaaagatcctagtctcaacactcttattttgctttgcaaaactctgtaagattataagggatatttgatagggaagtaagaatgaagacaagtgtagtgacttctgagtattgtgtcttgataatgatgtgcccacccaccatgaattgtgtccttcctggcttctccatgtaaattgaattttatatatacagtgtttggatcttgcttttctagggagggtctgcaaagaactctcattttcttccaaactctgtgtcatgacactctatgatgtttccaagaccatatctgtaacatgatctttacttttctaattttccttagttatacttcaaaaaattgtttcatagcatatttacattgtacaggaaatatttttcacatcacaactaggtcagtgttccttggtcctgaaatgaaggtcaacaaacccaagtgttttctagaggaaagacaaaggaaatcctgttgatctgcattacctgaaatattttgccctccacccttataaagctcaaatatgttattttaatgtgattggacacaaacagtatcactctttttaaggaaaaggtagagatcctaataaatttaagcgtatgtctcattttttaagaaaccagccaattatgtaaacattgaaatatgctaagatgatttaccatgtaagtctgaatcaaactcctgatgaaagatttgtacagataaaaaaaatctcaaattcagctttgctatttgctagctatttctttatactttttggctttcgaacatcacttaccaatgattttgataaaaggctaatttgttctgataatgcccaataatactgtttccagtttagacttgagactcttaactaggaacagctgtttatggccatagtttttaaatttctgtcaattcagacttactcatgctgggataatgtctattgataaatgaagtagagcatgcttttccttaatgtgtatgtaaatatacatgtatatgtatatatgtatatatataagcatgtatatacacctatgtgtatgtataagcatatatacacacatacatatgtataaacatatatatacatatgtatatgtataaacatatatatacacatacatatatatgtataaacatatatatacacacatacatatctatatgtataaacatatatatacacatatatatgtatatgtatgtatgtggtcaaatgaatccaattctgatttatttaaatctggtccagcctgtgactcactatctggtgaagtggtgttcacttccttatgaagacagcacgtgggagcggaggcaggacatagatcaagcaaagatcgaggagtttgagaaactaatgtccagggagccggaaacagagcgtgtggtaagaattggctgatggtagagaatttaatttgaaaatagcatagtggtgtggtctttgggaaaccactaatgggatttactatatttgaaacaggagcgacctcctgctgatgattggaagaaatcggagagttccagggagtataaaaacaataacaaactcagggaataccagttggagggagtaaactggctacttttcaattggtacaacatgtatgtaaaacaagtttttcttcacttttaaatatatctgtagttcctttcctttagttattgaaaataataaaaaagaacttaatgttttaactctaataagagctttttcaaaaaacaagcattgaaaatatatgtaatatttaataaatattaatacagagattgatataagtgtgtaaaaataatttttattctttgagaattttgtttgaaaatatattttgttgaatctaagagaacatctaaagcctttgggtatgcatttgtgggtacaatggtatatattttgtgaaatgacagcagtgtgtcatatccatactcattaaacttttgtacttcattttcctcctaaaggcgaaactgcattttagcagatgaaatgggtttgggaaaaactatccagtccattacatttctctatgagatatatttgaaaggaatccatggcccttttttagtaattgccccattgtccacaatccccaactgggaaagggaattccgaacctggacagagttgaacgtggttgtgtatcatgggagtcaagctagtcgtcggaccattcagttgtatgaaatgtacttcaaagatccccaggtaaaccttcacaggttgtattctttgtacttactctgtgcattttaaggtgttaaaaaaaaatcaaagtcttggtgacttgggaaggtctaaattttgccaaattgagaaatttgctttagatatctgactcaatttacatttgtattatctttctgtgtctatgaaaacagctcttcatttttatagctttggtttttctgattattagattagaaggaatgaaattttttgccttggatgatcactgaaatccatttaatgctttgatatgttaattagttttattttgcaagcctaagagaaaactaaacaaaaattggtaatattaaatgtgaatagaaagaatattttattatgctattgctagaagtgaaaaatagtaagcatgtaaaaagtccttgaaatatatgacacattgaatgaaacacatcccaagggaggaatttatgctttggctgttagtagcaattgctttaatttttttcttactctagttacctgtatgccattagtgtgtatcaacagtgaagtgttataaatgacatgataaggaagaataatatgtactaaaatagttttatgttatgggtagtaaatggaagtcctgtaaataggatctttgctatatatatgtttttgctatatatagatagatagatagatagatagatagatagatagatagatagatgtgtgtgtgcatgttctaagtataaaatctgacctacaattaaataactaaaggagaaaaaatattgaaatctgtgtttatctttagatttgggaaattattataaattctgtcctacgtgaatgtgtgactagaatgggtacgcttagtggtaattgatgcatgtgctctgttaggaaattagatccaaaatttactgacagttttctcatttgttttccaattctgttttaccatatcgtttaaaactgccaaaataacttgaaaacagaatgtatgtcacctaaaataaagagatctccaaagggataaatacgtatgttttatgctatttattcatccttaaagttatttatgtaaccattaatgcttaataataattcagagttgttcttatagggtcgagtgataaaggggtcctataagtttcatgccatcatcactacatttgagatgattttgactgattgtcctgagctgcggaatattccatggcgctgtgtagtcattgatgaagcccacaggctgaagaacaggaactgcaagctgttggagggactcaagatgatggacttggtcagtgaccatattggtgattgcactgaacctgaatagaattgttgctgacttgatagtcccgttgctcagaatttgatgcctgtaaacagtatttgaaaagcttgtcaaatattgtgatatattctctggcactttcagttattcaaaagttgttgccttttggattcttacattgttggctagtgtctgttaaacagttgtattatagcagagtgtaatcatgatagtttcactaaagtgagtttcaagtatttgttttaccctttgttcataaatacaggttgatcataccaaatacaaaaatcccagaatccaaaacgttttgagtacccacataatgctaaaaggaaatgctcattggagcattttggattttggattttctcatttgggatgttcaacccgtaagtataaatgcagatattccaaaatctaaaaatatctgaaatctgaaacactctggtcccaagaattttggataagggatacttaacctgtactgccatttcattaactgttgggccaagctttacttcagtgatgatagtccagttatttttcagtgctcataggttttgccatactgtggccagcaggacttgtagatgcaagttctcaatgagttgggtaggatatctggggttggtttagttcgcacagatgcttagaagtttggggcattacagtgcctcagatttgatctggagttttacaccacacttatcccatagtcttccagcttcccaagagatgatcaggtcttcctgattagattttctagatttttttttcagcaggagcatcatggaataacatatcgtaggagtagaaggatttgatttattttctgtctgatactgctgtgtgtgatttcctagtgggaattgcaacatgacctgtcatcctcaggcttcttttcactccatagtttatatagtggttatgatcacttatattttatttttaatgtacatttggaaagcaaagctcctgtcatttagcatgccttggatgatttgatgagtttcacggaagtacaaaaagggtttcaaagtatttttaatgctaatttctgcaggctaatttgatcttttgttaactgagagtttgagatgagaaggagtgttctgtatattcatggccatatgtttttagctgaagactggtattaccaaaaaacacctaaaagctttttgttgcagctgattctctgaaagagcagcttattttattcttaaagagattagaattgccagctatgcttttagtttaaaacaaacaaaatctagttttgcttaaaggaaaaagtctgactgaattatcctatttagggtgggatttcccatttttcttcctaatgaattattattaaagcgatcctaagatctgtctcaaagcagttgactattatttggtggccaatacacaaaacaagtgagagcgcttagaaacagtgaatagtctcagggaccttggtaagcatatggaaaagagaaactctgtgtttgtatttgttcactccaggtgatacttaagcattaaaatgaagtaaacttgtatttgcaggtaaacactaatgcttgtgatataacctaaatatatattctcagtagggatccaccttcatagttttctactaagagacagttatgtcaccatttcctgaaggcttaaacagtcatctgactgaacttatctgagttgtgttctattattagttcatgtgttcccagatagtaaattcttactgtaaaacattatttcattggtgagtacacattaatttaactccatcaagatcaaacaatctgattgtcattgggctatttttttttttaatttaagttctagggtacatatgcagaatgtgcaggtttgttacataggtatacatgtgccatgttggtttgctgcacccatcaacttatcatttacattaggtatttctcctaatgctatccctcccccagccccccacaatctttgggctatttcaaagagttttctattatttatactaacatttgataaatggattagaatctgttatccaaataattttcctattacatattgcagtgttcttaagctttttcacataatggcacgtatagaaaatgatagtagttgaatgccacactcaggtaaaaagagaaggctgcccactgccacgggacaccaccagtcctgggtgtcctgaccttccccaaggacttataacctgtactcatccttgactcaccaactgggaagctctgattagcacatgaacaaaatatttatttttctaatgatgaagaatttttatttgagaagaaatgttttcaagatggaacacattattgttcagaatataattatgtttgtccaattctgaacagctcgttgtctggtctttaaatccttacttaaaataagcatcttgagaacttagccactttctactttttattctttcctagaataagtcacagtcaaaatagtggttagtaactatatccaactacggcacaggccatagggaactgctgttacctgcactagactcagttgcgatgaaaatgcgcttgatggggattatctccaagtgcattcccagaaaggacgaccaatgagtgtcttcagctctgcagacaccaaggaaatgtttgtgaagatgatacattgaggggcagtcaccatcttcacagtcctccacaggagctctgggaaagcaaccatctcgttgtcccccatccacgaggaggggatgctgtggagatcatggtagttcttcattgattctagtatctctttcattgtcaggaaacctaacacaaaagagtctgcttaaaatgaaattaaatggacatcacttcatcagagctaaaaagaatggtaacgttgtcaaggcaaaagcacatctgctagcataggtggaggtgataagctccatcgcctgagtttcttacctgatgttttgtgagactgtgcatagtaatcgtgtattttttaattgttacccactttcaaattgatacctagttttattccactatttgtaggtaactgtatgaaaggattttgtgtataatcatttggtgtaactaattgaagggaagctgcataagaaaggagttcctaatgctagatgacgagttagtgggtgcagcgcaccagcatggcacatgtatacatatgtaactaacctgcacaatgtacacatgtaccctaaaacttaaagtataataaaaaaaaaaaaagaaaggagttctttccttttttcgaataagtttattttgaaattaataagttaaaaaggctttaacttttaaaatatttggttaagcagtcaagatttaatttaatgtcgtaataaaggatatgaaaaaactgggagacacgatatcaatacagctcaactactgcagtaactctttcctgaatatgtgatgggacttaaaaaaaaaagttcttgcatacagtaatccaggacttgggtatgtcagcgattgtggcccaggctatccacaagtgtggtgatactttagaaaaaaattgattgattgatccttactgtttatgaatttactgagtctgaagatgatggtcgtccatgaaacttcctcagagactttattcaaagggaagagaaggaggaatacaagcatattgaactccttcacctactttcaaagagcttcattaacagatatgacatggtagatattaagaaaattagcatgttcttacctcattcatctagtatttactgagcgtatactctgcttggcaaccgagacttgtcagattccaaattaagtcagaatattgctttctcaactactgggatgtataattactttctgaaatagttttgttagctgtgctgtgtaccaaatggccaaagtagaaaataatagggttcttaagattaatatctcactattgttaagactggccattgtaaaacagctcttctgtattgcatatatgaaaataggaagacagggtataactgcatgaggaaagctggggaaagagttcgtaaacaggaagaattaattaaagaaatacctaacttggttcaaagagacaaatttataaatagcatctgattaaaaaaaagtgattgtggtatttacaaccaagctgacctctttgctagttggaaatttttgcagaacaaaatagtttttcatatgctgttgcatgtagaacttcttttgtctctatgaagtgagtcatgcaggaagcagatggagagatgagagcactgttgatgtagagagcagaaagaagcatgcatgtttcatctgcgtctagggattctaggaaaaaaacttaactggtggggataaaagcattgagacttgggggacttaaaaagccgtgatactaaaatactgacctataaccccaggaagaaacaaaatggcaagacacatttaaggaccctgtagagttctggagaggactgtccatggatctgtctacctgacacagaaatcgtgttctaatacctctgttttcatgcctgattcctatactttgcatagggtagatgagtaggagtagaacaatgggtgtctagtgagaggctctggttttaagaaagtgtttttgttacaatttggttagtggctttccttgtgttacctcaggaacacaaagtgctgctgacgggaaccccactccagaacactgtggaagaactcttcagcttgcttcatttcttggaaccaagtcgcttcccttcagaaaccacatttatgcaagaatttggtgatctaaaaacagaagagcaggtatttatcagctccactttgtatttcagttataaaattgaagattagcccatgaaatggcaaagtattaagttattttaaagtgtgattatattacagtttttcccacctagtacacagaaccttagataccctttccttggactttccaggtcatcatcataaaggttttcttctttatttgtttgtctttttgctcttgtgaagggctgttgagatttatagagaggttacatacctgttgatgtaattttcagagatagctgtgctgtgcaggttggtagttttgctaggtatgtgtaattttggggatgatgtcagacgccactgacgttggtaggcctgtttgcctgctgcagttttgagtctctgttctttgtgaagcatctgtactcagccacaccgcttacttcttcaagcctacgtattttcactttagaaacttagggcataaccactgcacagtatttctgtgagaagtaaatgaagcattgtgtataaaaagtgcttgggccaggcgcggtggcttacgcctgtaatcccagcactttgagaggctgaggcaggcggatcacgaggtcaggagtttgagaccagcctggccaatatggtgaaaacccatctctactaaaaaaaatacaaaaattagccgggcgtggtggaacacgcctgtagccccagctactctggacgctgaggcaggagaatcacttgaacccgggaggcagaggttgcagtgagccaagattgcaccactgcactccagcctgggtgacacagtgagacttcatctcaaaaaaaaggaaaagaaaagaaaagtgcttggctattttatatgctgtaagagttatgtgggcattagttataatttgtgtgctgtatttgaaataaataacggagatagacttgaaatcttggtttttacgtgccccctccactgacttactgtctaaaacctgttagctcagttcagagtaaggtctgttttgtttttcttttctaaaataaaaactgtatggattactcagttctattgccaatcaatagaaaagagaaccagggagagacgtctctgctggctccttagtgcagggactagattgctcctggctcacttcctctcattctttagctctccctagaaaggaagagaatagaaacagagcattgccatgacattgtcttgtccctcttctctatcttccctatggcttaggacaaacagaagggaaagctacatgaatcagttggatttctcctgctgggtacttttcaagccttctggctgttcagggctcctggatgggtgaaatagttcatttgacataaaattatgcaaccttcatgcactgctcttatgaaagctgagagatgagctccttcatactctcactgggctttgaaaaatgaaaatggatgtttaatgaatgagataatcctgatgtttcatgttaaaatatgttttaacttgcaagcaaatcatgacactagtatttacttaaggtccttttttaggtgcaaaaacttcaagctattctaaagccaatgatgttgagacgtctcaaagaggatgtagaaaagaacttggcccccaaagaagaaactattattgaagttgagctaacaaacattcagaagaaatattaccgagccatccttgagaagaatttcacatttctttccaaaggcggtggtcaagctaacgtacctaacctattaaacactatgatggaattgcggaagtgctgcaatcatccgtaccttatcaatggtaaggctgccctgctcgcgaacttgcttaagtgacgattgaagcaccagaaatccctttctgcccccagactggggatttcatggtgtatagtcattcctgtctcctgtccactcagcatgggtttcaccagcttcccactttctgtgatgcctccttctgtggttgctgaaggtgagtgaccattgccccagcaatccctgaagtggaatctcaccttgcctttctcctgacctccctgtgcttgaaaagaggcgttagtgttccagggctagaagtcatctgaagtgctaacagccaaagagaaatgagcccctaatggaggttttcttggggtgtgtgtatttaaatcagagatgttaaagaggaacttaggtgtgagcagacagctatcagctgtctcaagcctttgatagcaaatgtcctcatcttcctctcagtccagagtcatctagcacctctatcctctgagaacaaaaaaattaacttaaagctttgataatttatggccctcctcttttcttaactaaattcatagtgttatgtaactcatggcttaaaacctttattatgtatttttggaaatcattaaggtagtaaatatttcatgcttatgttgtataagatactctggagaatgcaaaggtaaataagaagggagcattcgccacaagcagtcttcagttagctgagggattgagattgggggagtctttagaaggagatggtctttttaggcaagtctgcaggggtagaaaggattttgcgaggcagagttagaaaaagaaaagatgtttaggctgaagtaacgatacaagcaaagagagggggtcaggaaaacaatgaggaactttcccaaagtaaaaggcacacataagaaatgcaccttagacatgcttggatcctgctgcagaattccttaaaggctagtgcatggaacctccactctactctgcaggcagtgaagaaccatgactagtgtttgagctgagcattgattagaaatatgattcagggtgatgcgtcaggcaacactgcataaaaaggatgggaggaggaaagacagacaagcagaagaaccagctcagaggctattgtattctgggtagaagttaatgtgggttaaagaaaggtggtggcaggctaatttgggagacttgtacacgatgatagttggccagcagtgcaattagattcctttccaaggaaaagggagcacaacctggtctgtctttatcacagtttatgttcaaggacagctaatttaaagaatttctaatctttccccttttaataacgtgtaactcatcggccaccctagattcagaagtctccgttactaatggacagagtagtccactcctggaagatagtcttagagtgttgcacctgggatcattggtgtgatgcgacgaatcagtgaatttcttttttatatatatatacacagtttttttttcttgagataggttctcactctggcgcccaggctgtagtgcggtggcacgatctcggctcactgcagcctcgacctcccaggctcaagcatccctcccacctcagcctcctgagtagctgggactacaggcatgcgccacaacgcccagctaattttttttgtattttttgtagagacggggtttctccatgttgcccaggctggtatcgaactcctgagctcaagtgatctgcctacctcagcctcccaaagtgctgggattacaggtgtgagccactgcacctggccagtgaatttctttttgtgcttttagttttgtcttctaaagagagtatcatgtgtgatgattatgtatctgatactgccaatctgctaatcacagtatgtttagaagcttgtgcagccgttacggtgagtgttaactagccaggtcttgagttggcgagacagagcttagggcaactgatggagcgagatgaggacacgtgtgtgcatgcactgtgcacatacatgtgtttgcatttaatagctggtacaaaagaaaataaataatagcctccaaggggaaagaaaagaaaaggagatacaaaagggtttgaatgctaccagcaggatgtgtgtgaaaggggagatctcagcaatggtagttagattgacacccccagttccatcaagtttaccctgtttggtcatatgttaattatatgcattgaacattgtgggttgttttcccccaaaacacagctggtgtgtctcttcctttgatgattgctttccagggtcatcctgtatagcatatttgttcgcgaggagcctcttaggactccctaaggcttggcagatgtggcagttgtcctaattggtcacaccttgaggtcagcttttctgtcctgacaagaagtgtctgttaagcaggtgtctttgtccctaaatttggggaagttatagtgaaaaagtgtagataacatacaaactaagcgcacgcagctgcccagataacttacgcagacattgtattgtgtagaggttgctccagggcccgtactgttcattctcatccacagtctggagtaaaaacatatatccagcatttaaaaggaaattctttaatttgggagattacattgaaatttgaattggttgtggcagagtaaagaagcctcaatcaacattcaacaaaacacatttccaggattatgaaaaatagaagcaattttatatgtatgagttgaaagcttatgtatgagttattagctcaagctttatttcaatggaatttccaatttttaggttttgcaatgtgaagttaagaataatgttgaaaacatgtccaaggtaccctgctggttagagctgacttaagagttgttgctggttattgtttgaggcaggaggcgtgtagaggaagagtgggcaaaaagaaaacacgaatgaggcttacgtgatggagtgaatttcagagagaaaatagtaactttttttttctggtaatcgtcaagaacaaaatattttcttgtttgttcgtggcttttatatagctagaggacattgcagttactgtcccgacagtgaccatctgttgaagtgaaaagacttcaagctgtaagtgaatgcacacttgtttcaagttgtctttgatatacacactttccagtgtagtgccagccatacattaatttaggacggaaccaacaaagtgttttgggttggcatgacctatttccagttaatttttggattgatgtttacaaattgggtatcaaacattaatttgtaatcttgaaaatttagctgtgatatcacaagggagcagttgctttcctccccaacactcttcccaccctctttccttcaatgttgccacaataaaatgtcaagacaatcatataggaaaggtgtttgctgatactgtttttaaatgaaatattattagtacaaactggctgccagttgtaagaacctgaattcataacagagagctgaattaattaattcagaagtagcttttgtcaggtaagaaagaatgcattttttttctgactattctttttgatagtataaaaaaggcaaaaattatttttttaatctctgaataaatttaaaattaaaattctctgcaaatttgactgaattatttgttaaaaaaatttaactgaaacccaaatatctgatgtttattttgtcgaaatgattatttgctttttgaaaaatattcgttggccattaatttgttttaaatggctaaaatactatattttatattgtggattttaacttagtatggacaaaaaataattaaccaaatgtcataagagtaaaacttattctgaatttcagagcttatgatgtattgtacaacaagaatacacttgaaagatacctaatgtaacgtgcacttaaatctgtttcccctgtctcttgaggggcttgtcctgaatctagaagctgggtttctaaatttcatgttttaaaaaatatttaactttattcaagaacattcttgctagtgcccttaaacagcattttgctctttactcttgcatttattttccatacttaaagaaacattctgaatattagcttttcattcacttggaaaaaggagtgagggccagtctgccttcataagaagtcagtgtattttgtggaaggccttagtgcttgggaagacattaactgactttaatctgttctcagtaaattatttgttgattaataattaataggctgtatttctgcatttgaccatgtcataaggtaatttctacatgcagccttaaagtacagataggattgcacttttgttacatctgtgcttgttgcagcagtaccatgtgagaggctgtggttgtctgtcccactgacccaacctttaaagcctctttgaggtttatgtatccccatcttgtgtatagttagttcacatgttaaaaaccagtggtaggaaggtagttttaagtttctggcacagttaaagtctaggaaacaatcccattaagatgaatgtgtgtgtttgtattttctgaagaatagttgagcacatcctccaccttcagggaaaagagctaaacacaacagctatgtcctgattaaccccagaggcaggaggaggtcagaccaatgctgcgtaattctagttaagccacctaagcagttgaaggaagcttagcctgctgcttcctaaataagcgtgtgtcaggcagggatgtcatgggccatctttccttaggaagatgtcatcttcttgaggcctctttccaatgtacccaagtctttggaccagcaaaaatccatgtgggggaaaagaagggtttaagcatagaagtcttatgtcaaacacttaaaggtttgtttgtttttaattttaaaagatttggatagttcaagatagaatttttgtatcttaggaaaaattaccagatgggaatgaatgtggagggagatttagagattacaatagttgtatgcttaggtcccccacaaatattccaggaaattgtcctggaaataaattcctctttttgtagttcctttgcctatattaatatgcaattatagacccaaactactattgctcttacgctgtaattgttaggactctattcctttgttttttcatttcggaacagattttgttgtttgtgtttatgttcagctagtaaacatttcttcatttctttagcaatttaggttccaaattttctgtaggtatctggcccttggcttgtttctgccacttctggcttgacagtctgttgttgaaattccgtttttacagacagcaaacatttgtttgttgaaaaatgtggttttccccctgaatgcctcaatgtgttgtgcttaaaacttttaccccttttgtacatccacagttttgtatagacccaactatgagtaagtggatggattcttgttcataagcaggagtttggtgttctggttcctacagtttgcaatgggttttgaaagcaagtgcattgtttttagtaataaaaaccttttacagtattcacgttatgctgtccaatctctgcaggtgctgaagagaaaattttggaagagtttaaagaaacacacaatgcagagtctccagattttcagctccaggcaatgatccaggctgctggcaagctagtgctgattgacaagctgctgccaaaactgaaggctggtggccacagggtgcttatcttttcccagatggtgcgctgcttggacatactggaagactacctcattcaaagacggtgaggaccaccatatcagaataataaaaaggaaatctaaaattaccttcccaggggtccaagcagtccacctaaaagtggaatctatgataaaggggctagaatgggggaagtgcatcacatgtcatttttaaaactatagatgtacatgatgattattttatatgatgactacaggaggacactgcatacttttttaggcaattttatttccccattgcctttatttgagtaggggagaatagttcttacttaaaattgaaattatttgttatcttactgttataggtgtcagctgtttttagaatttaactatttccctggagaggaagtaaaataaaatttaatctttggtcattcaatcaattatataaaaaacgccaataaaccctatttgctctgagattagttctgttaagtcatattagtctttttaatatatattccatattgtaataattaaaaattaaaaaaaggagcaagtatgttgtcgctatgcgtcaggcctccttgttcacactgatgttttctaggtacccatatgaaaggatcgacggccgagtaagaggcaacctccgccaggcagctatcgacagattctccaaacctgattctgataggtttgttttcctcctgtgtacaagggcaggaggtttaggcattaacctcactgctgctgatacctgcatcatctttgattcagactggaatccccaaaatgacctccaggtaaatgcacaagaaagtcctgatgcctttaaaaaggaagtcattctgcttactatgacagagagtaccagtcagacccataaattaatgttgcgtcgtcactcaggctgtgtcctatgattcagagcaaataaccaactagtaatctgttgattaataatgtgagaagaaattttttagttttaaccttcttctaaactgcacctctatttattggcacatagatagggtcttagaactggcagatgagtcttgtcattctttggtagccgtcttagctcaggtctccttaacaaaataccataaattgggtggcttaaacaacagacatttatttctcacagttctggaggttggaagtccaaaatcagagtgccagcagagtcaggttcttggtgagggccctcttcctggtttatggacagttatcatcttgctgtgtcctcacccagcttaaagagagccagctctctcgcctctttatatgagcagtaatcctgttcgtgaggactccaccttcatgacctaattacttccctaaggcgccacctccaaataccatcacattggaatgagggtttcagcatatgaatttggtggggagacagaaacattaggttcattgcagtaactattaatttcatttttcttccaggctcaggctagatgtcatagaataggacagagcaaatctgtgaaaatctacaggctgattacaagaaattcctatgaaagggaaatgttcgacaaggctagtttgaaactgggcctggataaagctgtgctacagtctatgagtggaagagaaaatgctaccaatggggtaaaaccacccttgcccaaaccatttatttattctggcactttcctttatttaactaatagtaagaaattactcagcctttgattatttttcgacctcaatattttaagtgtattttgtaacactttcctttgttataatttaggtttactctctttgagaaaaatgcagcatttgtttagtctgcaaacctcttaattttaaattattttgagtattttaaatatttctctaaaacaggtacaacagctttccaagaaagaaatagaggatcttctacgaaaaggggcctatggtgcactcatggatgaggaggatgaagggtctaaattctgtgaagaagatattgatcagatcctcctacgtcgaacccacaccattaccattgagtcagaagggaaaggttccacatttgctaaggtgtgaatcgatctaaagaggccaggttttccatagaagcatgacagagttcatgtgaaaagtaccttgtaaaagtgcttacaagatgcattgggaattaatcaaattaatcattaactccctgtggaacccctggcacatgaagctttctttatgctttggtttatcttctgtgtacctgccactggtatttgccctcaccttgtcatccttgtatctgcttcccagctcctgaggctaatcgctcacttgtgttcttgactctattgtctccacttctgagatcctgctccgttggcatcttccttctctccccagatcctggtttttgaaacagcctataagaatgatcaagtcactcctttaaaaacacctcttctctattttcttctttagctaaatctccatacataaactcttcagagctaaaatccacacaaacgtaatctactgcagcctctactgtctccctttctacttatttttcagctttttcagcttccagcttgcacctgttccctgcctctctatcagagctgctctggccagggtcaccactgagtacaccagatggttccacctgagagccccttctgaggtttcacctgcattttgttctagccatctcagtgaggcccactctgtacttttatttttaatgactttattgaaatgtaattaactgaccatacaattaacctgtctttcgtgtacaattcaatgcctttaccatattacagacttgagcaaatattgccacaatctaagtttgtaacatttccatataccccagaaaggtcctcatgctcattagcaatcattccccattcctatccataccagtctgccatatctggaaagcatgaatctactttctttttctacagatttgccttctctggacagtggacagttcatataaatggaatcatatgatgtatgatcttttgtgtctgacttcattcacttagtataatgtttttgaggttcatccatgttgtagcatggatcagtagttcactcctttttattgctgaacaatattccattgtatgggtataccacctttacttgttgataatggacatctgggttgtttttactattggctattatgaagaatgttgttatggatatttgtgtacaaggttttgtatggacttgttttcatttctcttgggtatataccaggagtggaattgctgggtcctatgttaacttcatgtttgactctttgaggaactgccagactgttttgtaaagtgactgtactagtttccttccaagtcagatagtaagaagtatagatgaggatatggaggaaatggaactccatatcctccccaatactttttattatctgagtttttagttttagccatcctaatgggtgtgaggtcatatcccactctggtttttatttgcatttctctgatgatattgagcatcttttcatgtgcttattggccagatgtagatcatctttggaaaaaattctattcaagttctttgttcattttttgagtttctttttattaatgtttcagacttaaaatatgttctgtatgaaggttctgtattaatatgattgcagatattttctcctactctcttcttaatagcatataattttaatgaagcccagtttaccaaatttattttatcgcttgtgtttttagtgcattgtcaaacccaagctcacaaagatttatgttttctacagatttgcctactctggacggtgggcagttcatataaatggaatcatatgttatatgatcttttgtgtctggcttcattcagttagcataatgttattcactagtgtaacttagattccaagatttatagtttttaactcttacattttggtctgtgatcccatttggatagagttttgtgtatggtgtgaggtaggggtccaacgttcgttttgcatgtggctatccagttgtcctagccgctccaatctggaaaggctcttctcctgtgggttttgagacccacatcttctcctttacatctttcagccttgtgtcagattattttctcagagctcacaggcactgtgtattcaatatgtgcacagccaaacttatcacccctgtctctcctcctgcccctatctctgtttgtccacctgactgacatcattcagatgcctgagatggatgctgaggtttttctggcttccgcttctttcatatttcacttgtacccagattctgactccattgattttgccttttgttttattttatttttgggatgatatctcactatgttgcccaggccagacttgaacacatggctcaagtgaccttccaccttcagcttcccaataattttaccttttaaagaatatgtttcttttttttttttgacagagtcttgctctgttgcccaggttggagtgtagtggcgcaatctcggctcactgcaacctccacctcctgggttcaagcaattctcttgcctcagcttcccgagtagctgggattacaggtgtgcaccaccatgcctggctaatttttgcattttttgtagagacagggtttcaccatgttagccaggctggtctcaaactcctgacctcaagccatctacccacctcggcctcccaaagtgctgggattacaggtgtgagccaccatgcctggcctaaagaatatgtttctaaaccaccttcttttctccattttgttatttcttctgtaaattattacagtggcttcttctgctgtgttctgacctccatgctccaagcattggtatgacctttccaacttgtgactctggttatgattgtgtccataatgagattattcctattttcaaatagttcctggttccttcgggatagagttcaaactctgttaactctgttaacatatacagacactgcttgacctggcttctctctccctcaccagctcgacctctggctcttcttccctgactacccttatcccctttactctctgtgccttggcacatgctctgctgtgaacatttccacatgctttcctgttttataaatgttttagaatggttcaggcatcattttatggaagagacttttcttttcggtttccagcaacaccctgcctgaaccaggttaggggcccctcctctgtatatcacttgcactggtctatacacttgctccctatcatttatcactctgcagtgtaattcttggtttggtctcaggccctggtcagtgagctgcctgagggccagtctgtcattctagtcccatctactgtagtgtctggcataagtggaggaatgcacaatatcggagcaaatacataaacaaaagctgctttacattctgcttctgagaaaggcctctcaaagtaatgcgtttcttttttctctttaggccagttttgttgcatctggaaataggacagatatttccttggatgatccaaatttctggcaaaagtgggctaagaaggctgaattggatattgatgccttaaatgggagggtgagtaagaagtcccattcgaacacctatctgatctaaaccaagagccactctttgagaaatgtcaaatgtatctcctcttttattattagaacaacctggttattgatactccaagagtgagaaagcagaccaggctctacagtgcagtgaaggaagatgagctgatggagttctcagacttggaaagtgattctgaagaaaagccctgtgcaaagccacggcgtccccaggataagtcacagggctatgcaaggagtgaatgtttcagggtggagaagaatctgcttgtctatgggtaagtaggactcactacgtaagatagaattttattgtaacagtagttagaattcccaactggtagagaaaaactatatttgtgtttgaatttgtgtgacacccctttgcacagtcaaatgaatgcttctgcagtaactttacagggctttgaagccatttggttaacataatctaagttgttcagatgcttctggttcagaggtcacctgaagttaaggtgcttgtgtataccttaaggaattatgccagatctagagttacatgttgattattaataattaagaacaaagtgtcaaaattatgtaatcttttctcactttacaagctttgcataaaatttatgactgtcgtaagcttttaatatttctcttataaaaaattgtcaaaggcagtaatctcacttgttaaattcttccttgcaactcatatgaaacatgaatggtcatttgaactttgtgaaagtgttgtatttttcctgctggactataagtttctgaaagggaggatccatgtccaatttatctctgaatcactgtgatgcccaaagtggtactttgaatggcagggtgctcagtaaatatctgaattggtcaataagagttctctagcagattgtgggactacaggcaactcctgttaaaaaaaaaactgcagctagagtaacctttctacagatctgatgacgtcctgtcttggatgatttcttccaatgaattaccattagtttcagagtaaacacaaacatatgctgacatggcatccagagctcttctgggaccttgtcttctgttggttctttcccatgggtagtccaagcttctgttaggacagacggcttcatctccttcagtgcgccacgctccatctcatctgtgtctttgcacaagctcttcccactgcctagaggaccccccacttgcacctccgctgggaggtgacctacctcccttctgctctccgtgggtgtccgacgcaggcatcagcttgtgctctgcaactgagtctggcctgcacttcccatcacactcatcatgttgtttacaatttttgagtcgcctccctctttcagtttgcagctccttgaggatggaagctccttcattgtgccctcagtgtgtagtgcagtgtgagcagacacacagtgctgataaatgcttgttcaacagaagtccatcattatctgtgaagctggacatcctctcttgtctcttcttacatggggcagagactcaccccctgcgtcccaaaagccctgccccgcaaaagccctttgctacccatgcctgctgccatgtttcagcacaatcatcagatttgagagttctgtgggtaactttaggaatggaacacataaataactcctacagctaagaagtgtgcttagcgcagattgtctttcagtcgagcccttccctcttcccatagttgtcactatgtactgaacacctatgtgctaggcactgtctaggatcctctcagtcactaggggtggagctctgagcaagacagtcatggctcaggcaggcaggtgagcaagtagaagtggtgcagactgtgacaatactgtgacagggaagcactctgctgtggagcatagagcctgtcagctcactgttaagacacagctccagtgttgtctccccacttctggggttaggaggaatgaaaggaggaattccacaaaaggtggcatgtacagcttgtgacttggtggatatcacaaatcagccagggtaagagggagtgctggggtttgggtagggaagggaagtgaggtaccggcagatagagcagtgtgttccaaggcctagcagtgagagctagccctgtggttggagaaacttgaagaagttcacaggagccagagaggaccagggagtgacaagagaccaagtgagaggcagggcctgagggaggatgtgcgctgctctctgctccaaacacaactctcagtctgcagcagaggggctgttcataccatgagcactgccttggtggctcagtctgctgtcgcctgggagaagacatggctcacatagcacctgctgctgcctgcccccgtacctatttgttgtgtggtcttactccatagctcccagatgagacagcacagcactgtttagcctgggattataacacaaaacaggcagtcagtccccatggtgtgttgtctgtttgcttctgtcttctgtccatagtcgtttctcccactcatttctcatgaggacctgagggttggcagaatatcttgcctgtgatggttcttatgcttggggttattactccgtttcaaaaggaacctcagagctttccagaacctttcaccagtgactgtggcatccccttagaggtgggttgatgcggccatactgctcagcatcgcatccttgattttggggtagtcacaccttttatcttgagttgccttttgtctcagatggttggtcaacatcaaaatgtactaatcatgacagtgtgaagcaaagtccatgatttccaggccctcggatgcactcatgtcctgaaaattgctgctacagccttcatgtacctggaaaggccagggttagctttgtgggtgttattcttgtggcagttcaactcatgcgcttagaagcagtgaactgaggggcagcttactgtataaaggagtgtttttaactcttgcaccctggatttctttcctatcacccagtgtgaattgttgctagttttgacccaggatttcccaacgctggtacctgacttaaagtaaagccataaatcaaaactcacaggcacctctgcatgctggatatttgctttgcagttggggacggtggacagacattctttcccacggacgctataaacgccaactcactgagcaagatgtagaaaccatctgcagaaccatcctggtgtactgtcttaatcattacaaaggggatgagaatatcaaaagcttcatctgggatctgatcacacccacagcggatggccagactcgagccttggtcaaccattccggtaggtctccaccatgctgtttgtgctacagggtcacaaagccaccaggaacttttgtgacacactgttgataaagagatgtgacataaaccccatatttccctgcctcgtgcattaagctctctgccattgacactataattggaatgtaaaaggcttctattattattatgatggtgattctaggtttgtcagctcctgtgccaaggggaaggaagggaaagaaggtgaaagcccagagcacacagccggtggtgcaggatgccgactggctggccagctgcaacccagatgccctgttccaggaggacagctacaagaaacacctgaagcatcactgtaacaagtatgttattagagggtggacctggagagcttaattccctttttattctttaaaaaatacatgcagccggcccttcacgtctgcagatgcagaactcgcagatttggagggtcaactgagggacctgagcatctgcggatcttggtgtctgaggggggtcctggaaccatactcccgcggatatggagggacagctctgttattaagacttttaaatggtatagttattgcctttgcacagccttatcatttttcttgaaatgtggtgtcaagttgcaggagagcgtacctttaggtgactgattattttttaacatggtaagatacacaacacaacgtttaccatttttaccatttataagtgaacaattcattggcattaattacactcacaatgctgtatactcactatctgtacctgaaatgtttccatcttcccaaatataaacactgtatcaattaaacagtaacttgcctggcccctggcaatcaccattctactttctgtttctattagtttgtctattctgtgtatctcctaggggaatcacagattatttgtccttctgtgcctggcttacttctcttaatattttcaaggttcatttgtgttacggtgtcagaatttcattcctgtttatggctgaatagtattccattgtgtgtatatgccacgttttgtttgtcccagtcatctgttgacggacacttgggctagttatcatggctgttgtgaataatggtgctatgaacattgtagaggactggtttttaaccagtatcggttagagaatagtagtcagcattatatgatcccactttcaactaactgcgtacagtggagggaagactggggagttcatgtattattttttgcttaatattacctcagttgctgggtccattttttctgcctgtgagcttggaatcatatttcttacctttatttccaaaaactgattatagataattgaagaatattgaaactaaatttatttcattgcttggggttctgttaacagttcctattaaactaacatctgcatatgttgtttccttattctgaatatgcatttttccgtatcactagttcaggcaacaatgctactgatcagctctatgtcctagcttcgtgtgaccttgagcaagttattcagcctcttgaggactcactttcctggtgagtccagtagacctcggcagcaagatctcaactggataaggcaggatgtaaataagtatgcatttctctttgtaaaagtagcagcaacaaagtctgagcacataatactggcagcatgccaagcgctttgtatggattatctgtttgaattgtctaagattagtatgatttttatccccatttaactgacaagaaaactgagactaaagttgagtaacctcctcaaggaccctcagccagttagggggcagaaccaggtttgaacccgagtagatgagggcagcctcagcttggaagtcttccctgctccttggggctgtggtgaggctctgaggtgtcttcagaaccattacctccaacccttttggtatctcagaaacttggtggttactgctgtggcataagagtgctccctaaaatccgaccccacttacactcttagaaaatatctggtcagtatggtacagtcaatgtttaatctcatgagttaacaagagaaaaaaatctaaagaaatagaaatgagttatccaaagtgagtctcttcagggatttataagctcacacttggcctatccagaacccatgctggccgtgagtaggctcgtggttgggggagggcctgttgaggagcatctgttgatgtgtgattgggagttgtctgttctggtgaatcctagttgttattttgaagttttagggacagtttccataccctgagaacagcatggtgtagtagagcctgaagacctagttccagttgtgccatgtgcaaggtaactctggccttagatttgtcacttatcttctgctaccatcagttttcccatttgaaaacggaaattataacttgccctgcttcatcatagggttatcgtgaagatcaaaagggctagtataagtgtgagacattgattgtaaagtgctgtacaagtacatgatgggattattcagctggggaaatagcatttgtattaccatgtactcatggccaagaaggctgcgattcacgtatcagtcctgaatgcacaccagggctgtccagcaggggatgctagctttggtagacactggcttttgggacttaccaggtggactttattgaaagaattatgttttcgccattgagaaactccatgcaggactgaaaatctagttcctagaattccaagggttttaaaaaatcgatttcttgagaatgattaagaatgtcagtgaattggacacattttaattttctaatgtttaatttttttttcaagctactacagcttaggttcccaggtacagtaaactagaaggaataaaaatgtctaacatagtatttcatacaggagaagagcaaggacacaccttctaccccaccctgtcaccatcttcctttctcggaagcaaagttgtataatctgaaaaacctgacattccatattgagggtttattgtaaggtagtaaaaccagattttatatctcatttattcctacaacttctgatgtgcttccaaaaatggtattaaggcagcagctgaggaaattttatgagataatgaagcagaacagttactgaaagccatctgctcagttgtttacaaacttgcttcaatacttcagaggcaatggtagggtacgtgtctaaacttcacaagctgcactaggtagaactaaatgaagtgcgcctgggctgggctgagctcgggccctctctgtgcagtgtgagcggttgccaggcaggcctgttggaagccagcagaaagcaccacacagaggtgattatgtgccaccatctgtcacgcttcaagcctaccatacagcatggctaatcagccttggcaggatgatggatgaacagcagcagctgccaaaagccactgttggcaaacagtcctgaagttaagaactttttcccccctctgtcttcctctccagggtcctgctgcgtgtccgcatgctgtactacctaagacaagaagtgataggagaccaggcggataagatcttagagggtgctgactcaaggttagtgcgagctcacatttgttctcaacctcagtgagataatctgggtagccggaaaacatcatggattgtgtttcagaaccttcataaaccactagtaacccatctccttttttgcatcttgaatgcagtatttgtccttcgtgcttggggatgtgatgagaatcaggaaaaggctgtttgcatttatgtttgtagtgtaaagagatgtgaactaaagcactggtgttctgagatgacccttaaaatgggataccatgtgataaagttcatttctggtcatggcagagggctactgactcatgccctttcttttaaccttgctgatacctccccaccatgctcagatgtttatcgtgggagagagggcatgtgagctatgtatcacattcattacttggaattcttttttaatactaatatttcttataaatgttgtctttcagtgaagccgatgtgtggatccctgaacctttccatgctgaagttcctgcagattggtgggataaggaagcagacaaatccctcttaattggagtgttcaaacatggtaagtgacgtttctgtttgaatacatctcaactgtatggcttggtctttatttagaactctttacatactcttttccaaagtcataatattaatgaggatagttccaaaggactcttggcgtctaccatttttctgtactaaaaatctaatatgaactgtaaatatcagatgctgtttttgaatgtttgttgagcatttgagaagaaaacatttctttcttggctgtaaataaaacccaaaccatatttgttttaataatagccaagttgtactatagctctccctaaactttgcttccagcgcggcttcccttgctaactctgccaaccagtgtcaaagtggacggtgggcttaacctctgctattaatctgtacaagtgcctcctgggctttgttccaagcaatatttcacaaatgtcagtgctgagaactcgcggctcccctgagtgggatgcagccttgttaactttgaaaggctggggatgcagaactggcatgatatatacagtgagcgattcctgattataatcccaattctctggaggtcgcggaggtattctcagcagcccagcctgactaaaggggagaatgatggcttataaaacctttcatgattacagtttggcttgcggctctacagcagttaggagcggtgtgttgtagtacacatcctaattgaattgtgctgttctgcctatgtactgcagccacattttgtgagctcagcctcaaaatcattttcccgcagtgcactgttgggatctgccattttccatctagtcaacttgggcagtcaaaaagcaaattgcagtttgaaaaccatagagggaaccgtgtcatcttactgacatgcatcatcctaaacctaataagacaggttcgctggccttatgtatatggggatttttcagccagccatgcgagttcctgcaggactgatgctattcacagagtggatgggggtggactcagtgcacccctgcagaggtcataaaggaacattgcgaatccttctaaatgtcaagcaaaattagatctggggaaaaatagggtcagaaatcctcccaggcatcttgcagttattctgaacctgtttttctattagtgtttgtggtaattctgataatatccctgaagtgtaacttggctcccagtagcttccctagaaggagcgttccatagaatgatctactaaaacaaggtccacttggattcaacagagatgctaaccttgactgaaaaacaaacttgtgttgtggcagtgctgtgattttgccagtgatggggcctttctttgtttctgtgtgttttctgtgcacggatgggcacggcacaggctatgagaagtacaactccatgcgagctgaccccgcgctgtgctttctggaacgagtcggtatgcctgatgccaaggccatagctgccgagcaaagaggaacagacatgctagcagatggtggtgacgggtaagaaggacattttaaaatttgaataaactttatgtcagtttcacatctattggcagggttcagttcttaccctgcagtacacactgtattgtgtctgatttgaagttcaggagatgtttaccagtctactctatttgtatgtcgtaatgactgtttaaacaatatacattatcttgataatctgaaacttgtttttcttttccaaatgtcatttcccgcaatctccccagaccccctccaccacactgccatggctgcatgttttaaatactgatagagttgcttttgatgtcaaacccataattaaaagtagcactgggcagattattactctttcctacccaccccccttccttcttttgcttatcagtatgattcaaataatttttgtgtttgttttacataggggagaatttgatagagaagatgaagacccagaatataaaccaaccagaacaccgttcaaagatgaaatagatgtatgaacttgagtatattggcttttatagctccattaaaatattatatgcccacataagacttgttaaactttatagataatgaccttttctttaaaagacaaagaaaaatgagaccccaaattaaagtaattctgtttcttgctttgctttcaaggaatttgcaaattctccttcagaggataaggaagaatccatggaaatacatgccacaggtaaggtcccagaaaagcttgtgtagccgagcagacgtgcactgagcagtcattgttcacgtggtagggactgtcctgcttcatgacagcagtgtcttaacaccttatttcttctacactgacctgttttgtgaatcattttaattcttgttaatggctgtgttttcatgacattgaatttcttagataggataactatttctttgatgataattagctgatttatattttacactaattagtgaaaaattttaagcatctaaactatagctcttgggaatagagcatagagcatttgctaagtattcacctaaaatattttcagtttatttagaatattgaccttttaccgaatataaaatcattacacaacaattatgcagttattttttatactcaagatgattattgcacatacattagaggagagtaccttataagaagtttatgctgtaaagtgtgtttctttatgtaggactaataaataatgttttcatcccctctaaggaggtaaaaaagaaataagtgtatatattccaagtgaatgttattacttatttatattttaaaaatgagggcactgagatgccctttcccacactgtcatttgaatcttaatgagtcatcctgttttgttggaatactctgtattgcaagattgcagctacacatttcaaaaatgtttttccacttccccaggcaagcacagtgagagtaatgctgagttaggccaactttactggcctaacacttcaaccctgactacacgtctgcgccggctcattactgcctatcagcgcagctataaaaggcaacagatgaggcaagaggccctaatgaagactgaccggcgcagacggcggcctcgagaggaagtgagagctctggaagcggaaagggaagctattatatctgagaagcggcaaaagtgagtttcttcaaggtttccactcagctcccggtacatgcccctctgccctgctcctgtagacccacaagagacaggactcatatcaaaggtagtgaccaccaaagaaaggctcgctccaacaaagcagtctgtttccccacccccaaataactaccatgtataaagtctggggggaagaagaaaagaaacagtaaatattaagtcttttcctgaagtatgatgcaagctaatataatctttctaacaggtggacaagaagagaagaggctgatttttaccgtgtggtatccacctttggggttatttttgaccctgtgaaacagcaatttgactggaaccaatttagagcctttgccaggcttgacaaaaaatctgatgagagtttggagaaatacttcagttgttttgtggccatgtgtaggcgagtatgtcgaatgcccgtcaagccagatgatggtaggtacatttagcaacaaagttctatacaaaaagacgagtaaagtgaaaaataagaaagtgtacaatgtagaatgcccttgaattctccccaagtaaatatgagcccttctgtgttacagaaccgcccgacctctcctccataattgagccgatcacagaggagcgagcctctcgaactctgtaccgcattgagctgctacggaagatccgcgagcaggttctccatcacccccagctgggagagaggcttaagctctgccagccaagcttggatctgccagagtggtgggagtgtggacggcatgaccgagacttgctggttggtgctgctaaacacggggtcagtcggacggattatcacatcctcaatgaccctgagttatccttcttggatgcacataaaaactttgctcaaaacagaggggcaggtaatacatcttccttgaacccactggcagttggatttgtccagactcctccagtcatctcatctgctcatattcaagatgagagggtactggaacaagccgaaggcaaagtggaggagcctgaaaacccagctgccaaggagaaatgtgagggcaaagaagaggaagaagaaaccgatggcagcgggaaggagagcaagcaggaatgtgaggcagaggccagctctgtgaaaaatgaactgaaaggtgttgaggtcggcgcagacactgggtccaaatctatttcagagaaaggttccgaagaggatgaagaggaaaagctggaggatgacgataagtcggaagagtcttcccagcccgaaggtaaggccttaccactggcccctctcctgaccctgcagcagctggttgtgagatgcgttgctttctggcagcacggcacctgctctttttcacgagtacttagtgtacattttcttctgtgaagggataatttcaagttatgcttatatctgtgttttgctctcgcaccttatagcacctaaccatggtattttgaagaacataaactctaagaagggttgcatggacacattagcaatttctggtttaaggatggaagttaacttgtagtgagtgacagtgtattaagaattctatgtgattttaattttgacaaatgtgagggaaggtggtcattcactgagtaaatattgttaatcattttgaaacaactggtgcttgttatgttttgattcagaagtaaagagtgggaatagaatctaaaaataaccaattttttaagtcacagtacggttgctgaaactggcccagaataaaaatagagcacgtactgtgctgtagctggaaccttcaacttttgacagaaggtcagcccttttttctgtgtggaagaacatagactcttgagtcaatgacttggttggctatcagcctcttgtaaggtttacttgcacggtgctaggtggctagtgactaacctctctaagcctctgtgtcatcatctgcaagatggaaataacaccatctatgttaaagggctgttgtaagctttagacaacagtgcccaataccattctagccatgtagtaggtactcaataaaatggagctgattagtattcacatttttaatcatgtcctttctaaacttcagtttccctgatactgtggttgtgagtaatgcacattaactcatttctcagcaggagctgtctctagagggaagaattttgatgaagaaagcaatgcttccatgagcactgctagagatgaaacccgagatggattctacatggaggacggagatccttcagtagctcagctccttcatgaaagaacatttgccttctcgttttggcctaaggttggcaggtttttgttgctgttgttttgctgaccaaaaaggattagggtagaggaaatctttctagcttgatttttcaagtaattttaaggtaaacttttgacacagtatatgaagactatagatttttcttatacttttaaagaatgatctgaaaaagcccaaagaaaaaaattgtagaacacttttctaataggatgggaaatgtgatgtgaaagaaagataataagaaatagaagtgtgtatatggattgatctttggctccatgtggcttttaggttacttacccccgttgtctagcataatgtatggattatcactgtgttttaaaatttttttgtgaaataaagccttcagatttaagacaactttatagttttggaaacctaccagcttcttgacttggaagagggtgtactgttgacccatttgcttttgacgcattatgagataattccaaatgtagttatctgtaaccaaaagcaaaatggaaattacttttttggctaaatagtataattttataataattccctgtgtaatttaggtctgtttttcagggtgaggaaataatcatcctaatcaccataacagggctgtctggtttaaaacaacacaaaaaatgagcttcagtcagcctaccccccaggctcgtctttcccagtattattgtgtaagaaacaaggtgaaaattttgaccaaagaatgtactgtcaaagacattttgtttcctctctctatccctttagttcccctgttatgctaacctcctttattgagtgtaggagggagtttcccagatcagtcaaaggttatagtagcaggcacttttaatctatggaaactcagtctaaagctgtaattagaaatttttaatgtacacgcttcaatgaaatttgaagtgataataggtagggaatgcaaattgacattcattaggtgttcctaggttggtgcccacttcataatgctgaactttattaatagtgacgctaatgatgtcctacttcctgggactgcaatccagcctgtagatctgaagggccagggcggcaagaagctaatgcagggtttccattgtcatctactgacatccaccagcagagctctatggagcttgtacaagagttactttttaaatatgaagatattttgaaggtggtgattatgtagtacatttttctgttttatgtagttcagtgttcgtaattaaaaatagcatgttttctgtgttgaagccacctaggaccttctgccagagcaatgccattataggagattttgtttatttactttcttgtttgatttcttgccttgttttcttttactttttgtcctccagttgacttttaaacattttatgctcttttgcatcttgatggatgtatttatctagtaattttaaccagggctttgttaaaatttcttgtgacttttcttctccctccaggatagagtaatgataaaccgcttagacaacatctgtgaagcagtgttgaaaggcaaatggccagtaaataggcgccagatgtttgatttccaaggcctcatcccaggttacacacccaccacagtggacagccccttgcagaagaggagctttgctgagctctccatggtcggccaagccagcattagtgggagtgaggacatcactacgtctcctcagttgtcaaaggtgaattagaatggcttgtttctgcagcttaaaagggagctctctaagccttaactgagtttgcgagcttatatttcactggccttgcttagaaataagatagctgctgtttcctcagctctgtgcaccagtcatgaatgcttaattccttaagcttcttgttccttatttctaaaagccagcccatatagcagtactgttttggctcactgcaactctgttctgttggaatttttcaataggaagatgccctcaacctctctgtccctcgccagcggaggaggaggaggagaaaaatcgaaattgaggccgaaagagctgccaagaggcgaaatctcatggagatggttgcccagcttcgagagtctcaggtggtctcagaaaatggacaagaaaaagttgtagatttatcaaaggcctcaagagaggcaacaagctctacctcaaatttttcatctctttcttcaaagtttatcttgcctaatgtctcaacaccagtgtctgatgcctttaagactcaaatggaactgctccaagcaggcctttcgcgcacacccacaaggcatctccttaatggctccctagtggatggagagcctcccatgaagaggaggcggggaaggaggaaaaatgtggagggacttgatctgcttttcatgagccacaaacggacgtcattgagtgcagtaagttggggagcttgcctgcatggcgattgcacgtgttgacagctgagggtcctgtgatgctcacgatgctgggctgtgtttctctcagcagcattgtatgaaagccagcttcctccactaaagaaatagttttacaataaacagtcatgattctgatcattgatacagatcacttggcctgaacgaagtgtagcttgaggatgtattcttcccaagttctgatgtgttgattgctctcagaagaacagccaaacctagaaacatgttcttctgaatctagaattgttatctctgaattcttgaggtggaacaagtttcattgatatgttttaggcctggcatttattaaaattagtataaatgtttcattttggacctaagatttgggttaacataaaaagctagtgactgcaaattctcctgtctccttaagtagatattttaaaaatttgagctgtgcttttgctagaataggtttgaatagaatgtgtgaaccaatggattttgacttttcctttctcagttcagaggaaataaattaatgcagtataatcaaaatgattttctttcttaatctgcttcaactacatctcacccaaaaatgtggtgcctgactcactgatgaccagaattttatcccaaagagcacaattacatgtgcttttttaaaaaatggtttagcactatatatcttgaacctattgaccagaagccccagtcaccatagtggctggaactccttgtctgtgttgtgaggagtgggtgctccaggaagccttccaggtactgggccatcctggacccttcttcaagcagtgggacacagtttgggaaactgaaatttgagattgagggaagacagttgtctgtttcaacatgtttttacttacaccatccctattattatttgcccattttctatttcttgaactcagagaaagcttaataagatggcaggaaaagacatggttgagttaaagttcagaaatgaaaaataacatccactgaaatttctttgccctctggtggggtctaattaaaacagaagcattcaggtggctaagagtaaattttcaaaattgggccgggcatggtggctcacgcctgtaatcccagcactctgggaggccaaggcaggtggatcacttgaggtcagcagttcaagaccagcctggccaacatggcaaaaccttttctctactacaattataaaaattagcctggtctggtagcacgtgtctgtgatcccagctactcaggatgctgaggcaggagaattgcttgaacccaggaggcggaggttgcagtgaatcgagattgcatcactgcactccagcctgggtgacagagtgagactctgtctcaaaaaaataaagaaaatttttttcaaaattgattaccaatgcagtgatcatcataatggtcatatttgttgatggtatgattgttttcagaatcctgtaaaagtacactttgtaatggactagctgtgacttacatgttttctgtaagttaaaatgccatttctaggggtatggccctcagacagagttgtagcactagtaaatagccttcctgtttgaaactacttctttgatagattttgttgactgataaattctttctccataaactttaacaaattgggaagtttctgcagctgacacttctttttgtttgttatcatgttcaatatttgtaggtttttttgtttttgaaacagggtttgtttttgagacagggtctcactctttcgcccaggctggagcacaatggcgcagtctcggctcagtgcagcctccaacttctgggctcaattgattctcccacctcagcctccctagtagatgggactacaggcgcgcaccaccatacctggctaattgttttgtatttttggtggggacggggtttcaccatgttgcccaggctggtctcaaacttctgggctcaagtaatccacccacctcagcctcctgaagtactgggattacaggcaatcatgttcagtatttggatcacgacacagctttgtctctggatcaggtgttaggaattaataatgcaacacacgtgcttttttcctattgcaagtacacattctattttaaatctgagactgattttattcatttcactattttaagccgttgttaagaatttgttgatatttttctttttctaaagtcccatttagaaagcctgagagaattcctaattgaagttagagaatgtatttttaaaactttttttttttaactgtcacattttgaaatgtagggattcctcatttggtgttgtcgggggtgatgtgcatgcacataaaatacaaggaaagcactgctcgatctgtaaataaaccaagtaggaaaagatgtaaaggccagcagtgttacctggatgaaagaggacagatcctagaatttagtattttgtcagcactctaactgtgctgccatgaaaaagtaagagtgcattcagcaacagtggacaagctggcactattccctgtgccagcactgagagtcaaaaaatacagtcctgacaagtgcttgcactggagaatgcagtgtttaggatggggtagcacataaatcataatgtgtcctggttgttcatgtgtgccacgaccaagggatgtctagggtactttgtgagcccaaaggaagcctgggagtggagggaagaggatatggggagaaacagatgaagaagtttccctatggatggctgtacttcaattaagttttgaagatcatgtagtagttggtcattttaaaagggttggcagagaacatgtgtaagaggagagagcctcttgggtttgaagaactgaggaatttgctgaggaagtgagcttcagcagagatgagcttgcagagaaggcaggatgcaaatcatggagggccttgatgccattcggaagaacttggattttgtcctggaggtaatagggatgcaattattgaaaaaaataggagagtgatgtgacataattttttgaactgggaagggctgcattttagaaaactgactccagcgtagtggtgtggaggttggattgaagataggtgggattagaatcagggagaccatttaggaatattgcaataacctgggtgggaagtgacaaaagcctgggccatggtagagctgtggggaaggagaaatgggtgtctggaggttgaaataactgtagacttcagttagtggtggtctttccaatgttgccacacatgtctgagacaaagtgtcccactaccaacaaaattatattgtgcacagagtgcccataagttacatatagactggcttttagaaattcctttagtataaattatctttaatatcattatccggggatctccaagagagactgagaggccgcctttcatgcatatcagctcagactataccccccatgttgtattcccagtggctggcttaggatttcagagcatggaaccttagtggactataaattttttacctaattactagttctacagtgtgaagaatgatataaaagtttcgtcttcttctttttatttttatttttttgagacgaagtctcactctgttgcctaggctggagtgcagtggcacagtctctgctcactgcaacctctacctcctgatttcaagtgattctcctgccccagcctcccaggtagctgggattacaggcaagtgccaccatgcctggctaatttttgtattttttgtaaagatggggtttcaccatgttggccaggctggtcttgaactcctgacctcaggtgatccgcccacctcggcctcccagagtgctgggattacaggcgtgagccaccgcgcccagcctcattttctgacttttaatagctgttcccaaacaactagacattgtttctagtaactattttctctttttgataaaagatccattctaggatagcgttttcttgaaataggacattgtcagaggctctctcttcgtgtgagaattcataccattgtgaactttctgcaggaggatgctgaggtgaccaaagcttttgaagaagatatagagaccccaccaacaagaaacattccttctcccggacagctggacccagacacacggatccctgttatcaatcttgaagatgggactaggctggtgggggaagatgctcctaaaaataaggatttagttgaatggctgaagctgcaccctacttacactgttgatatgccaagttatgtaccagtgagtattgcagagtttagagttggaaggaatcttgcaggccggtccacttcattcccttacaacatagaaatccctgacagctggtccctctgccttttccttgaatgtttcctggtctcaaacatttcccaggtctttgttgttgaatcttcttcattacagatactagcttcaggtctgtcttactgaaggcagccttacagttatttgaagatgcgcgttatgcatttccttactgtttgcttctcccatcaaactcatgtgacttcttcagttattctttccatggcatcgtttccaggcagtcttagtattggggtaacactgttgaatgcactttctccagtctccagacgaggccccgccatcccagagtgctatgaagccaattacttccagagatttgaccagttagtgcagcccaagattgtattagctgcttttatggcaactaatcctggtgccttatattaaacgttagacagttcatatctccaaatggtttgtcacacgaactgtttgctagctagcaatgcaagtcttttgctttctgtatttatgtgattgattttttaaaacttaaatgtagagttttacattttattttgttgggttcagcctagagttcttgccactcagaaagtacccccaccccctacaagatctgtctgtttgttggttagttctcattacagacagtctcatgttgttgatggggtatcatctctgtgttcattggagccactaactagaaattagtaaaagtactacagaaagcctcctttaaaagtatcatgacttggttaaacatttaaagaaaaactttaagtgaggttattgatagataaaaggaaaagccaattctcacttatgtattccttaatggacgggtaaaataggagttttttctttcaaagagaaaaatatggtttctaatattaataattaaaatgattcttgaaacttccataataattgaagatgatctgacagttctctttggcatttatatagagaagaataagtactaaataccaattttactaaatatgttttttcttttgcagaagaatgcagatgtgctgttttcctcatttcagaaaccgaaacagaaacgacatagatgtcgaaaccctaataaattggatataaacactttgacaggagaagaaagggtgcctgttgtcaataaacgaaatgggaagaaggtaaacgctgggaaagggaattgatcactatgcgatttcttagcccagaaggaagtgttttatcctgccttcttctataggggaaaagaatcctgtctgcccgaatgcgtgtgtgcgtgtatgtgtgtattatagaagggggagggagtagattaacagaaaggggagggaagactgtgtttttaatcatttgtcaaatgcctctacccagatgggtggagctatggcgcctccaatgaaggatctacccaggtggctggaagaaaatcctgaatttgcagttgctccagactggactgatatagttaagcagtctgtaagtacaaactgcatttctatcaagaaaggtagctatacaaaactgttttccttagtctttcttattttctgttggccattaattattcagttgtaacttagcttaaaagaattgacataatacatcattttcatacatcatttcatacatcattaatacatcattaatccaaagtgaattcatttatcagctccaatttaaaaggtttgtatggaaacatacattcacaatcttagaggtagacttctccaggggggattgccccagctaagcctacttaacagctcacctgtggaataggatgtatggtggttgagatcattaagattaactgtgatttctgatttaaaaacaaaacaaaacaaaacaaaacaaaaatacaacagttctgcctaaaagatttgttaccattagctttttaaaaattcgttcatgacatgctggttctttgttttaattatacattaaaaatgtctttcggtgtaacattctgttgatcttaacacacgtgtgagtttgtgaactgacaccgtagtcagaatagggttccatcccccacccccaccaccccgagttccctcacaccgtcctttccccgaccccagcccctggctgccgctgacctgttgtccatccctgtctttttgagaatgtcctgaaatggaagcatgaaggacataagtcttgaagcagtttctttcgctcatcatatggaaggtcatcgatggtcacatgtgtcacagttatctcctttctgttgccaagtagctgtctccattgcatagatgtgacactggacggcttagccctcacacactgaaggacatctgggttatttcctgatttttgaaactatgattagagctgctataagcaattgtgtacaggttttggtgtgaacataagttttcatttttctagggtagatactaaaatataattacattttccatatttcaaaaatacttttacatatatttgaaatatccaaaataacacattatagagggcataaaacatcctgggtttatattatgttatactattttataatttttctcccatacaatatctttttttttcttttttttttttttttttgagacaaggtgtttgtcacccaggctggagtgcagtggtgaaatcacagctcactacagcctcattctcctaggctcaagcaatcctcccacctcagcctcccaagcagctggcactacaggcacacatcaccaagcttggctagtttttgtattttttgtagagaaggcattttgccacgttgcccaggctggtctcaaactcacctcaagcaatctgcctgccctgacctcccaaagtgctgagattacaggtgtgagccactgtgcccagccaaaatttttttttaattgacagatatttaattgacaaaaattaattgatgaatcaaatatatatgcaaggtgtacagcacagtgtttttttcttttaagagacagggtcttgctgtgtcacccaggctggagtgcaatggtgcaatcatagctcactgcagcctcaaactcctgggctcaagcagtcctcccacctcagcctcctgattagccaagtagctgggatgacaagcatatgccaccacacctggatattttttttttattttgtagagatagggtcttgctatgtgccccaggctggtctcagactcctgggctcaagaaatcctctagtcttggcctcccaaagtgttgggattacaagcatgaaccacggcacctggcttcaaagtgatgatttgatataattatacattatgtactttcctttttaaaaatttgttatgggtacatagtaggtgtatatatagggtacatgagatattttgtacaagcacacagtgcataatgatcatgttgggtagatgaggtatgcatcacctcaagcatttaccctttgtattacaaacaatgtgattatactcttttagttattttaaaatatacagtaaattattgttgactgtgtagtcaccctgttgtgttatcaaaaactagatcttactcatcctgtctaactctatttttgtaccccataatgtactttctgatgtatgatttcttgagttagttatggatgcagctaacttgacatttacctcactgatgagtagccttgagcaatttttctgcagttcagcaagctaacataataataaaaacaagttttgctgtcattaagttttatcattgagctgttaggagggaagaactacttaggtatttccatttggaatggcaggttcaccacagaggctcacattgagatcaagttgtcttcgacagcctttatagccactgtttgcctcccctgtactccagggttttgttcctgagtcgatgtttgaccgccttctcactgggcctgtagtgcggggagagggagcgagcagaagaggaagaaggcccaaaagtgagatcgccagagcagccgcggccgccgctgctgtggcctccacgtcagggatcaaccctttgctggtgaacagcctgtttgctggaatggacctgacgagccttcagaatctccagaatctccagtcgctccagctggcaggcctcatgggcttccctccaggactggcaacagctgccaccgccggaggcgatgcgaagaaccctgctgctgtgctgcccctgatgctgccaggaatggcgggcctgcccaacgtgtttggcttgggcgggctgttgaataaccctctgtcagctgctactggaaacaccactactgcttctagtcaaggagaaccggaagacagcacttcaaaaggagaggagaaaggaaatgagaatgaagacgagaacaaagactctgagaaaagcacagatgctgtttcggctgctgactctgcgaatggatctgttggtgctgctactgccccggctggattgccctcaaacccgctagccttcaaccctttcctcctgtccacaatggccccgggcctcttctacccatccatgtttctacctccaggactggggggattgacgctgcctgggttcccagcattggcaggacttcagaatgccgtgggctccagcgaagaaaaggctgctgacaaggctgagggaggaccctttaaagatggagagacccttgaaggcagcgatgccgaggagagcctggataagactgcagagtcctccctcttagaagacgaaatagcacagggtgaagagctagactcacttgatgggggggatgaaatagaaaacaatgaaaatgatgaataaccagtaccagttccagttcaagtgtttaaaacttttgacaagtggtagtcctactgtttacactcacagttaatgttcatacctagttttataagctgttctgtaacatagtgtagcaaaaaaaaaagttcaagtcatgttatacaggtgtgtcaaaaggtatcttggtcattaagtattgtgcagtgcattatttattatccctaggagagatgaaatttgagaggtgatcatgtctttttaaggaaacttacataatgctctgctttttttttttctcttggtaccattggtattataataaagagcaatttgtaactgagtggcactaatggaagaaagtgctgctcaaaggaagtatgaagttatatatttaattttttaattttaatttttaatttttttgctgtgaaggtcaagctgaaatttaccatacatatcatacttgctcatttgtttccctttttgactgtatgggggttcccacactcgtgcatacacacacatccatacactctgacaatctccacgctagtgtgaacgcctctgtcccgaggcgcagcaataataaggcagctgttgaatgtgaagggtccctttggaaaattaacctactgggagggttcttgccagacagaactacagttccattgtctcgtggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttatttttttctttgaaaactgctatcatgtaagataaaatgtaaattgctgccaactgtagtaatgatgcttttaataaaagtgacccatgatatgcagagatgtaattatagaatgtagtatatagggaaactggtgttcactctattttttttgtattcgcaatagatgcaaatacagcattctggcttttgtacagtttcttgatatatcctcttatactagattagcttttggtaagacactaaactgtctcgaagactagacaggaaggaaaaccttgaattactctcacataattccactccagatatctcaacagaaatgcatacaaaaagctcctattactccctcaaaagggcatctgagaccgagaatacttagaaatgtgtgcagcgtgtgataatgtggtacactgaagaacaaaagggcaaaagaaaaatgaggctttaacaggcacaatatctaggtcatttatccttggttaatgggtagaaaaacacaatgcggtagtgtcagcaagggacacaaaggcactctggtgtcctgcagaccagcgctcgatgccagaaaccagtgtgtggaaaaacccatgtggaattgaaacagacccacttaagcacgcacgcgcgcacgcacggtctcaggagctactgatttgtggacccctttttgacctttggtatttaaagtaaaatataatttgagatctactgttttcacctttttatgtcacctgaaccaacacaaagccatatttccatccagttaaaaagcaggggaagggatgtggacgagagtgtttcgtgtgtgttgccttcctccacacccttcccccaggacgtccgcacacagtccacctccagccagtgtgctgccagacaggtggtctaaattcctcccagactgtgagattcagttcgtttatgccccaagatgaaaatatgccccttaatgattctgggaaagaaacaacctgaaccctccaccttacagatcctgtgattgcttttatttatcatcgtcgttgtctgctgaaagtgaatgggccgtgcacactggaggaaagtgccttgaagagaatattttttgaaagggaattatttgaacacgggaaagtgaaactaggtctgcatgaagtataggaaatttaagtatttaagtaacaaagatgttagcagggagaatttgcttaataaaatgagtcattaaagggtgttttttttaa

SEQ ID NO: 1626 - DNA, 51120 bp, Homo sapiens
  source 1..51120: mol_type = genomic DNA
cttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaagataacagttcaaattttgatggaaaaatcaacctatgcttgtgtgtgtgtgtgtgtgtgtgtgtgtgtgtaatgtgtacagtgtgtgtggttgttgagataagcataattatataaaaatatgtgtgtgtgtgtttaatgtgtacagtgtgtgtggttgttgagataagcataattatataaaaatacataaaatatgtacacttcaatgtgcagttgtaaagttaacattcacttaaccacaactcaattgtagaaagatcatttacagacccttaagaacttcctatatgcagtctcccaatcacaacccacttctttcccccagaaataatcacaaaatagactttggtgataatcttttccttcgtgtgttttagagtgttctcagctatttatgcaaataatatcatttagtttatgtatttttaattaatatggtttttattaacgaactttatatacattttgctgtatttttcatgtgttgattttttatagccatgcttttgtgcatattgaattcattaattttaatttttatataggatgtatttatgaacatcccactaactattctgctgctaattgatatttggattgtgtacagttcgatgctattataaaattcttctaaggacattcttgtacatgttcatttgttttgctaggtcctagagtctaaggtatatatccagaagaggaatagctggatattaggatagaataatgacaaactgttttctaaagtgattgtacagattagtgtttccataggagaaaagtgtacagttactggaaaaacagtttggaatgatctaaagcataagaatgttcatagcaacagaatgtatttctagtattccaaattttcacctacagttggtgtggtcagtataagttgttgtttttgtttttgttaatgtttttttttcctttgagacagggcctcactttgctgcccaggctggagagcagtggtacaaacatgactcactgcagccttagccttgcaggctcaagcaatcctcctgcctcagcctcccaagtaactgggaccacaggcacatgccaccacacctggctaacttttgtattttttgtagagacagggtctcaccatgttgcccagtctggtctagtctgttttaacaagttgttgctgtgtaatgatatatgtgtggtgttaatttgcttgttcctaagtttaaatgaggtagagcattttatgacatgcctgttctagtcttttgcttatttttctaattgccttttctttttcttaataatttcagttcttcatatgttcagcatactagtcctttgtcaatttacatgtattgaatatatatactctcccattctgcggcttattgttccattcttcatgaacatttgtaattttaatgtcctatttagacctttcctctgtctattgttttatattttgtattaaaggagtcattcattactccaagatcatgaagattttcttgtatgtaatcatgtaatcttcttaaaagcttcatggcttttgcttttttttttttttttttttttttttaagagtcttgttgtgtctccaaagctggagtgcagtggcacaatcacagctcactgcagcctcagcctccctggcccaagtgatccttccacctcagccttctgagctgggactatagccatgcaccaccatgcccagcaaattttttattttttgaagagaccagatttcactgtgttgccgaggctggtttcgaatgcctgggctcaagtgatcatcctgccttggcctcccagagtgctgggattacaggtgtgagccaccatgtctgcctggcctgttttttggctgatttaggtctataattcatctgaaattggcttttgtgtagaatgtgaggtagagattaggtttcatttttttccttcatatggctatccagtttagcactggttattgaaaagatcattattttttttcactagtcttcattgatatccaatcaagtactcaaatgttttaattattttttatactttgtattgaatcagatccaaataaagtttaaacataataatcgattgatgtcttttaagttgcttttagtctgtaagttccctctttattcccttttttttctcttgcagtttattggttgaagaatccagctggtttactctatgattttcttaagtctagatttgtgggtttgattgctatgatagtttcagatctttcttctattttctgcatatcctataaatacattcgagatactagtcctgtgtcaattatatgttgcatataggcattttataaatttcctaagtaccatttttcttcatgccacaaatttttatgtgtactatttttgttatccagctcaaatttttttctaatattgttatgacttttttctatatttttacattgtagttctcagatctttatatgatttattttttgatccataaattattttgaattatgtttctgaatttccaggcctttgggaattgtttttatttaaaaaatgtttttattgagatattcacatagcttaaaattcactttttaaagtgttgtactccctttaaagtgcacttctgtggtttttagtatgttcataaagttatgcaaccatcaccactctcaaattctaaaacaatttcatcctttcagaaagaacctccctgctcattagcagtcactccccactttttcttcctccagtctctggaaaatactaacctacattttgtctctgtggatttgcttattccagacatttcatataaatagaattggataatacatgtgtggcttctttcacttaatggtttcaagattctccatgttgtagcatgtatcaggactccttatggctgaataattttcgtgtgcgtgtgtgtgtgtattgtacattctgttcattatgtggacattttagttctttttacttcttggttattatgaataaggctgctgtgcacattcttttacagcttggtgtgtgtccacacattttcagttttcttgggtatgtacctagaagtagaattttttgatagtgatagtttttacaattgttgggtacaggcttctgtatatctccatgtaattaactgagttaatcatattcagatcttacatatctttactgcttatacagtgaattactagagaagcatgttaaaatttactatgatttggatttgtgtatttttacttgtggttctcatttttttctttttttaagagacagggtctcattatattgcctaggctacactcaagctcctaggctcaagcgatcttcctgcctcagtctcccaactagctgggactacaggtatatgccaccatgcctggctaggttctgttaattttgctttatacattttgggactatttccttaggttatatactgatacatacttgtcatatcttcttagtgaattaaaccatttatttatttagaagtaacttctttatagatataatacttttgccttaaatattctttatctgatattaatctagccccacttgctttcttttggctaatatttatatgattttcataaaggatttattaacaaaaaaaaaaaagaaaaagtttgcatggcataacttttttgagacggagtttcactcttgttgcccaggctggagtgaaatggcgcgatcttggctcactgcaacctccgcctcctgggttcaagcgattctcctgcctcagcctcccgagtagctgggattacaggcatgcgccactacgcctggctaatttttgtatttttagtagagatggggtttctccatgttggtcaggctggtctcaaactcctgacctcaggtgatcagcccaccttgtcctccccaagtgctgggattacaagcgtgagccactgcgcctggcctggcataactttttatctttttacttttacttttctaaatcatataaaatgtccctcttttaattatcttaaaaatccaatctgacagtatttgtttttcaatggaccattgattccatttgctttcactgtaattactgatatatttggatttatttctatcatcttactttggttccactggatttgcattcttttctaccattttttttttgccttaaaaaattttttttcttgcttagtattttatttttgagacagggtctcactctgtcacccaggctagagtgcagtggtaccatctcagctcactgccacctctgcctcctgggtgcaagtgattcttgtgcctcagcctccccagtagctgggattataggcgtgtgccatcatgtctggctaatttttgtatttttagtagagacagggtttcatcgtgttgtccaggctggtctcaaactcttggcctcaagttatctgcccgccttggcctcctaaagtactgacattacaggcgtgagccaccgcgcccaaccttgcttagtattttttaaaaatcactgtatttatcctcctctcctaatttggaatctatatgctttttttttttgagggttactctagctattacaatatgcatacttgttatagtctgaagtcagtctcttgtcctctttctgacaatcaaagatctttacacttttataatttatatacaattgtctattttgataatatatatgtgtttctatgtgaatatatgtacatacatatctttgaagagatagtagatttgcatgtagttgtaagagttaatactgagacatcctgtgcacctttcactcagttttccccactggtatccaataaaataatataacgaggatattggcattgataaggtcaagataggacatttccatcagcaccagaattcctcatgatacccttttatagcaacattcactttcctcccacttctggcaactattaatcttttctctgttcctgtaattttgtcattataagaatggtatcttagcctgtttaggcttctagaacaaaaacactgtaaactgtgtggcttataaacaacaaacatctatttctaacaattctggagtctgggaagtccgagttcaaggtgccagcagattcagtgtctggtgagggcctcttccccatagatgtcacctttttactgtgtccccacatagtggaaggggcaaagcagctctttagggcctcttttttaagggcactaattccattcaggaaggtcctgccccataacctaatcacttcccaaagtccccatttcccaatactatcacattgggaattgggtttcagtatattaatttgtctggaggggaatacgagcattcagactacagcggttacataaataaaatcacatagtattgtaccttttggaactggcttttttcactcaacataattctctggagattcatccaggttgttagcctgtatcaagttcattcctttttattgctatgtggtatccacggtattgtttaaccattcacctgttgaaggacatctttgttatatctactcttttgctattgtgactaaagctgctataaatatctacaggcttttgtgtgaatatagtctttatttctctgggataaatgtactggagtggcactactcaattatatggtagtcatatgtttagttttcgagaaaactgccactcatttccagaatggctgtaccattttatattctcaccaccaatatatgagtaatgcagtttcttcacatcctcatcaatgttgtcactattttttgttttagccattctgataggtatgtagtaatatctcattgtgagttgaatttgcatttccctagtgggtaatgatgttgaacatcttttcatgtactcatttgtcatctatgtatctttggtgaaatatctcttcatgtcttttgttcgtgttccaattagatttgtttacattgagtttttaaagctacttatgtagtcgagatactagtcctttgtcaaatatgtcatttgtgaaaaaaaaaaaacaaatatgtctcccattctgttgcttatcttttcatcctgttaacagagtgctttatagggcagaagtttttaatttcaatgaaatccagtttaccaattttttcttatatggatcatgtttctgttgtctatcctagaataagcctagattctgaagattttttccagtgttttttcttaaattttgacagtttaagactgaagcatttcaaattaattttcgtataggtgtgaaccttaggttgaatttcatttttttgcctctgaatcttaagttgttccaccatttgttgaaaaggctatccttcctccactgaattgctttttaaaatttaatattagagagcagtttttatttttatttgtttatttttatgtatttttccttttaagttccttgtagattctggatattagaccttcgttgaattatgtggtttgcaaatattttcttcctttccatagattgtctctttactctgttgatagtttcttttgccatgcagaagctctttagtttaattagatatcatttgttaatttttgtttttgttgcagttgcttttgatgtcttcatcataaaatcttttccagggcctatgtcaaaatggtgtttcctgggttatcttccagggtttttatagttttagttttacatttaagtctttaatccatcttgactttatttttgtttgtggtacaggaaaggagtccagtttcagtcttctgcatatgggtagtcagttatcacagcatcatttattgagtcctttttccattgcttgtttgaatccactttccatttgagtgcttttccccttgcttgtttttgtcaacttggtcgaagatcagatggttgtaggtgtgcagcattacttctgtgctctctattctgttccacaagtctatgtgtctgcttttgtacttagtgctatgctgttttggttactgtagccttgcagtatagtttgaagtgaggtagtatgatgcctccaggataatagccattttaacaggagagatatctcaatgtggtatctcaatgtggtaatatgcatttccctgctgattagccatgttgaactattttttttttttttttttggagacagagtctcactctgtcgcccaggctagagtacaatggtgcgatctcagctcactgcaacctccacctcctgggttcaagcaattctcctacctcagcctcccaagtagctgggattacaggcacccgccactacgcctggctaattttttgtatttttagtagagacagggttttaccacgttgaccaggctggtctcgaactcctgacctcaagtgatccacccatctcagcctccccaagtactgggattacaggtgtgagccaccatgcctggccgaacattttttcatatacctattggccatttgtatgtcttttgagaaatgtctgttcagttcttttgcccattttaaaatcagatttcttttgttttatttgctattgagctgtctgagtttcatatgaattctggttattaatcccttgtcagatggatactttgcaaatattttctcccattctgtaggttgtctcttcattccgatttttttttgctgtgcagaaatgttttaacttgatgtaatactatgtctgtttttgcttttgtttcctgtacttgtgatgtcttccacagaaaaacctttgcccagacccgtgtgtcctcttagtgttttccaaatgttttcttctagtagttttatagttgcaggtcctacatttagaactttaattcattttcagttgatttttgtgtgtgtgtatggtgaaagatacggctctagtttcattcttttgcctatggatatccagtttttctagaatcatttattgaagagactgtccccagtgtaggttcttggcatctttgttgaaaatgagttggctataaaaatgtagatttatttctgggttctctattctgtttcattggtctacgtgtgtatctgtattccagtatcggtctgttttggttactatagctttgtagtataatttgaagtcaggtggtatgatgtctccagctttgttttttttttttttttggtttctgtccttgattctattgatgttgatatgtcatgtttattgatttgcatatgttgaactacccttacatccctaggatgaattctacctgatcatggggaagatctttttaatgtgttttttggattctgttttgtagtattttgttgacggtttttgcatctatatttatcagggatattggtctggaattttctttttatgttacatctttgcctgattttggtattatggtaatgctggcctggtaaaatcagtttgataggattccctcctcttcacttttttgagtagtttgggtagaattgatattagttgttctttaaacgtttgatagaattcaacagtgaatcatcaggtcctgagcttttctttgatggaagactttttattactgctttgatcttgctactcattattgatatgttcaggttttctatttctttatggttcaatcttgataggttgtttgtatccaggaatttatccatgtcttctagcttttccaattttttggcatatagtgttcatgatagtctctaatgatcttttgtgtttctgtggtaccagttgtcatttttcctttttcatctctgattttatttatttgggtcttcattcccctttttttttttttttttttttttttgtagtctaggtaaagatttcttgaatcttgttgatcttttccaaaaaacaactttttgtttcatttatcttatgcacttttgtctaaatttatttatttctacattgatctttatttctttgcttctattaactttggatttgatttttttaaaaaaatttggttctttgttttagttccttgaggtgcatttttaggttgtttattttttttctgtttttttatgtaagcatttattgctacagatttcctttttagcactatttttgctggatcccatagattttgatgtatgtcatgtttccattttcatttgttttaagaaatttttaattttacttctaattttttttttctttttacttattggtctttcagaagcacattgtttaattttcatgtatttgtacaacttccaaagttcctcttattattgatttctagttttattccagtgtggttgggcaatatacttgatatgattttgacttttttgaatttcttgagacttgttttgtggcctctcatatggtctgacttgaaaagtgttccatatgtgatgacaagaacatgtattctgcagtagttggatgaaatgttctataaatgtctgttagatctgtttggtctaaagtatagtttacctctgatgtttctttgatgatctggatgatccgttcactgccaaagtgggttgttgaagacccctaatattactgtattgcagtcggtctcttcctttagatctagtaatatttgctttatatatttaggtgctatggtgctgggtacatgtatatttactatttttatttctctcgctatattgacttctttaacaatctataaggatgttctttatttccttttacagtttttgcttaaagtctatttgatataaatacaggtaatcctggtcttttttgctttctgtttacttggcatatatttttccaacccttcactttcagtttatatgtatcttcgtaaagtgagtttcttgtgggcaggatatagttgaatcttgattttttttttcaatccattcagacaacttttgttgttgttgttgttgttttgtgtttttcggtgtttttttttttaaagaaaaatttacctttgttatagattaaagggtacacatgccggtttattacatgggataatttcacgatgctgaggcttggggtcccagtgatcctgttaccaaggcagtaagcatagtacccaacagatggttcttcagtccattcccccatctctctctctccctgctattgatccccactgtctattgttctcatctttacattcatgtatactccatgtttagcttccacttataaatgagaacatgttgtatttggttttctcttctcgcattaggtcacttagtataaaggcctcctgctctatccatgttgctgcaaaggtcattatttcattctttttcatggctgcatattattccttgtaaatgattcctctctattgtaaatgagattgtgctcttgaattggttctcagctggaacactattggtttataaaaatgctagtgattgtcgtacattgattttgtcaattccaggagccttgtgtcagattctttagggtttttcatgtatggactcatatcatcagtaaagagagagagtttgacttttcctatttgaatctctttcatttctttttcttgcctcattgctctggctaggacttccagtactaagttttttgtttttgagacagagtcttgctctgtcacccaggctggagggcagtggcacgatctcagttcactgcaacctctgcctcctgggttcaagcaattcttgtgtctcagcctcccaagtagctggaattacaggtgcatgccaccacgcccggctaatttttgtatttttggtagagatggggtttcaccatgttggccaggctggtctcgatctcctgacctcaaatgatccacccacatcagcctcccaaaaagtgctgggattacaggcatgagccaccacacctggctgatttttaaaagagtttccagtaagttttagttactatgttcattgtaaggattagtctaaataatgtatcccatcattaagtctcagttgctagtatttttcctctaattaattcagtatgtatttccttagaataaagaccttctcacagacaacctggtttagttaacagaaatgagggtatttaacattgatataacactattgtctagttcaaggtccgcattcaaattttatcagtcctaacaatgtcttttgtaaaaaaaagtttttccccttgcctgtgttcaaacccagatcatgcatggttttcatgtccccttagtctcctttcatttggaatagttcctcgatgtttatatttcttgaccttgatactttagaaaaatacagaccagctattttgtataatttccctaaattttgttttatctcatgttctcacattattgggttcaagttatgcattttcacaagaccactgtagtgatgatgtatactcaattgttgatatttggatttttgccattttttttgtttaacatttttatttgacccacctaattgttgggggttttttaaaatttcattttaatttctcatttttaattaattatttatttatttttgagacaagatctgttgtctcaaaaacagaccttgtctgttgtccagggtatagtgcagtagcacaatcatagctcactgcagcctcaaatccctgggctcaaggaattctcctgccttagtctctgggtaactgggactataggcgcatgtcaccatgaccagatacttttttaaaaaatagtttttagagagggggtcttgctgtgttgcccaggctggtcttgaacttcagggcttaagcaatcctcccatgtcagcctcctaaagttctgagattacaggtataagccaccgtccccagccttcattttatttattagctttttaactgtacctttctgtattttttaaattcttttttccaaggattatcatatcttatcacagtttaaagttaatattgtactacttcacttaaaaataagaacctttcaaaagtataggtccacttatctcctcatcctttgtgctattattgtcatatatatctacttacattaaaaaaaagtctgtgcaggcatggcttttaaaattcagaaaaatagtatgtatgtcttaaatttacccacatctttactatatctggaactgttcatttctccctgtaggtcagggtttccacgtggtattgtttctctttagcctgaagttcttttagcttgtgtgcatctactggttgtgaattctcttagctttggtttatatggaaatgtgttaccttcgcttttgaagggttattatcttggagataacattctgctgacagtattttcccttcattacttcgaagtatctcctcttgttttctgctctccattgtttctgatgagaaatcagtcaacatttgtatcagtgttccactatatgtaatgtatcttttctttagaccagttttgaatttttctctttgaatttcagtaatttgcttattatgtgcctaggtatatttctttttcttttcttttttcctttttttttttttttttttgtgatgaagtctcgctctgtcgcccaggctggagtacagtggtgcgatctcggctcactgcaacctccgcctcccgggtttaagtgattctcctgcctcagccttccaaatagctgggattacaggcgcccaccaccacgcctggctaatttttgtatttttttagtagagacgggatttcaccatgttggccaggctagtcttgaactgctgacctcgtgatccacccgcctcggcctcccaaagtgctgggattacaggcatgagccactgtgcccgaccatgcctaggcatatttctttgtatttatcctcccttgagtttattgagcttcctagattttataagtttatgtttttcacccaatttggcaaaatttagttattatttatttaaatgtctttttctgtctcatctctttcctattctcaactgcaatatcttacatattatttgttatgttccacagttcactgaagctttattttaattcttttcctgtgttcttccgatttgataattactattgatctgtcttcaaatttggtgactaaacatggtctccaatatgctattaaaccatgtagggatttttctcaattattgcacttcttagtacagtaaatacaataatttccattggttcatttttatagtttcagtatctgtgtaagattcattgtctgtttattcgtatggcactattttcctttacattcttgaatgtatctttaatagctgtttattgcctttgttcactttgttccagtatctgtgattcatatgggggtcaaggtctatagactgcttttttttcttggctatgggtcacaattccctgctttttctatgtgtaataattttttattacatagtagacatagtaaatgaggaattgtagagattctgtactcttctgttcctctgaagagtattgacttttgttctattaggtctgtctccttcaatgtggacagaagctaaaatcactgccctattttttcagctttcagatgttattgtttttgagcctcctggagtcagtgaccagacaataatttggtcagaggttatcctcaaatttaggggcttctctgtggctgtcttattttcaggagtaccccctaattttgcagctgctctgctagtcccaacctatgttctctgaaacttcaaaccagtgagcctgtggctttttgccagcctgtgatgcatggattgagaagtaccctccagcataagctcacaaatctctctttttagtggtgacttctcttcagttcctttggaggagctttcaaatcttttttttatgttttgtccagaacatataattgttacctgtgagagggttacttcaaattattccactataaatggaagccagaattttcctacccttaaattttttttttaagatgagtctcactatgttgcccaggctgtctttgaactcctgggctcaagtgattatcccacctcagcctcccaagtaggtaggcctattgacatgagccatcatacccagttaattttttaactttttgtagagacggggtcttgctgtgttgcccaagctggtctcaaattattttcctgcctcagcttcccaaagcactgggattacaagtgtgagccatcatgcctggctccttaaattttaacaacatatttgaacttacatttttccctcaacacctatacctagtagactattatttatcttctcccttcaaaaaaaaaagttattagtgttgacaatgttggcaggctttcatttcccttctggccaagttgaaaattcatttaggattttagttcctgctttggggattttatttttgtatactattttatctaggggtatgagtataagttcaaaataattttccttcagaagtttgaagatgttccattttcttccagcttaccattattgccagtgaagagcttgttagcaatatattttggggaaggggtcatgatgtgtatatatgttgaaattttaaattttatatacagtaaaattgacttcttgttgtactgttctaagagttcttagaaccattctggctactttcattgtggtggaaacagctcagatttagatcttgcagatttggttgtggaatctgcctatagctctctgtagctctgtaaccttggtaaatttggaacaacatggagtatgaataaagaaaacatctctgtgtcacatttccttatttgcaaaaaaggatgatgccatctttcctgtctaccactctgggatctttcctgaggatcagatgagaccgtgtatgtgaaaacatcttgaagaacataacacttatatgagggaccgtttagtatttccatttgccctcctatcctgtatagatgattcagtaacattgtgtgtgaaaaaaatgatttaagcattatgaactgctgcaatatatagcaaataaggaatcattatactattatcattatgttagtagtggactactgaagactagaaactctcaagagccaaagaagagttgagtttttgtatgccataataaatggaagagtgtgtagggatggaaaagggggggtgtcagaagtacctgcacgtttacaccctgtaaaagattaatacctactttgcattcctctttgttgtctctgcccttggagactcctttactttcataaatatggaatgcttaaacaatgcacccagtttagtgtcggtgtggaaggaagctcatgttgaccctgcaactagattaatgggggaaaaaaaggtctgtcttgagcctgtgtgctttaaccatgtgaaatttattgaaaaaaaaatcaggaatattgagagaaagagttggagcagggaagacaggacagagaagaatggataaaagcatgaatagaagaagaaagataggatgtttgagcatcctaatgctcaggcagaggcagatgtggtcagttgttgactggggaaggaactaaatataaaatgagccaaatagagtgatggaggctttttactgcctgagtcaaaacaagcaagggcccaggcttctagatcttattgcagaaagattgatttcgacagcatataatttgcatcctcgttccatgggagaagaggttcatagatgggcacatgttctcacacccttgaaccatgaattggagttttccacctgaaaggagcagagacagactagtgagcagaaagcttcgtcctccaaccttagcctttatctgtgatgctcagtgtctccatgcaggatggtcaagacctccacttgtccattatcccttctctttctcttctatttgcttcctctgggaacttgccccccatcagttgcccactcctttcttatattgtcagtccgtttctatggactccttttttggtttacaaggatgctcaggttaccccaaatttaaaatactttctcttaatcgtgctactcccctagcactatccttcctttccttacagccttcccagagtctgcctatcctcctcaccttggcccctcacagtttgaatcatgaccctactatgccgaaacctctctcaaaagtcatagagatctactcatcaaattctgcatccttttctcaggacttttttaacctctttgcttgcacatcatactgtggactacaccctttcttttcttttcttttttttttttgagacaatctcgctctgttgcccaggctggagtgcagtggtgcaacctcagctcaccgcagcctccacctcccaggttcaagcgattgtcctccctcagcctcctgagtagctgggattacaggcgcaccaccacacctggctaatttttgtaattttattagagacggggtttcaccatgttggtcaggctggtctcgatctcctgaccttgtgatccgcccacctcagcctcccaaagcgctgggattacaggcgtgagccactgcacctggcctgaaactacaccctttcttgatactctctgcttctgacaaggtcttccccactgctcatctactcctctggatccaattatttctgctctcccaagttgaactgtcacattaccaactaaccgatgatcacctccatgccaatatgctaagggcatctaaaacttactatgcccaaaatgaaactcattactttcctccccaaacctgcttgtttttgtgagtttcctttatatacttcctgtaccacaccttcaaaacctctgtcatctctgattcttccctttgctttttccatccaatttgttgtgaaggtctgtcagttctacttgcaatctagtttgtttctgtcactcggtttccatttatcaaacatttggccgggcacagtggctcatgcctgtaatcctagcactttgggaggccgaggcaggtggatcacttgaggccaggagttcaagaccagcctggccaaaatggtgaaacactgtccctgctaaaaatacagaaattagccaggcaggcgcttgtgatcccagctactcaggagggtgaggcaggagaatcgctggggggcagaggttgcagtgagctgagatcgcgccactgcactcagcctgggtgacagcaagactccatctcaaaaaaaaaattaacggacctagtaaggaactatgctagactctggagaatgcaaagattaataacatcatttgatgtcaagagctgagagagataaaaatagccaattattacatgcaatggaaaaaccatgttatatgctatgctggcaaataaatgattaattttggtattttgattaaggggggcatagtatcaaggaaattcttaggaaggaagtgagactgaactaagctatgaagaattgttagcatttcgattagaaaggaaagaggataatttcaggctgaagcataactggagaaaacatgaaaacatgaaactgttcaggaagtggtgacttgcgtagctggagtaagtgtagagtgtaaacagggatgcagaatgagtgaaaagacatgggagagatgttaataagtctttccatcagtcactcctattaccttttactgaaatattacaatagccctttaacaggttctcttgtgtccactgtaacttgcttctaaggtaatcttcctgaagaagcgctttgaccaacctggatgggctactggctctgccttttcctagtaacaggtctttaggcaagctcctactttgtgaggattaaatgataaagggtattttaaaatgcatatcatactgtctggaagcaataaataaaggagaactattaaattcaaactctttttaactgacactgaagctcttgtatcagctggctccagtcaacctttccaagtttatcttctatgtctctgctcaccatcctcaaaaaactctttgctctttttcctatttacatcctgcacttttctgacttttgctttcattccctgtctctggaatacccatcaaccattgctgtatgactaaatcagtatctctttaatcttgactgcacatcggaattgtctaggagcctttaaaaaaatactgatgcctggattctattcccagagatcctggtttaattgctttggtgcaacctgaacattaggattttttaaagttgctcaggtgattgtaatgtacaaacaagattgagaactcctggcccaaatcgtaaatgttccctcaaagcattttctgaataccaccttctccccatacttctctgcacctctaatctttcctttccctgaactctctgcactttatatgtgcctttcttaagacacaattttctcccttgtgatattgtttcttatttcttacattataacataatctctttgtacacagtttatatttgagtcatctttctgtagttcatggtatgtgtcattaatgttttccgagtgatggtggatgaatgtctgcatgtagaaataggaaaatgacatttctagtgaggaagaagaaaaactacaagaggagtcaggcagtgtggttcctgggatggaaataaccagtatcccttattttagggatgaggaactgagagtaagggtaaagaggtgtgggaatatactcagactggtctggtaacctgtgaacacagacttgtagacagttgtttattagtttatccattcaatatttactaaatgcctaccatatgcttgacattgtgctaggtcccaggaatatatagctatagcttacagtcaatgtcccaatggctcatggggcaatcaacacattgctttaatgggaagagacagctagtctctctgccttctcttaggcctaatgggaagggcatctatctcttcatcagtacctggtggtagaataaagaattctattctttattttctttctttctttattttttttagatggagtttcactcttgtctcccaggctggagtacaatggcatgatctcagcttactgcaacctccgtctcctgggttcaagcgattctcctgcctcagccttccaagtagctgggattacaggtgcccaccaccacacctggctaggttttgtatttttagtagagatggggttttttcatgttggccaggctgatctggaactcctgacctcaagtgatccacctgccttggcctcccaaagtgctgggattttaggtgtgagccacctcgcctggcaagggattctgttcttagtccttgaaaaaataaagttctgaatcttcaa

SEQ ID NO: 1627 - DNA, 32012 bp, Homo sapiens
  source 1..32012: mol_type = genomic DNA
cttttaaatttgcgttgtaagatttattttggctctccccgcctgttctttgcacattaaaaatgaaaaagtttgtagaactaagctaagcagatggtcttcctgcaaaaagaccgggctgaagtaaagcattgttttggagctggttcacagaaaaaaggcaaaactggttatcctgacttcaagctccaacataaactgctcgctttctccgggaaacttgccccgccacacacacttgactgcgtggccagttctttcgaagcctctcgctcccaacacggagttcctcccatttcttcacagtcggctctcagcagctgctgctggtttctcggctccagcaccacgagtaccgcactctgaggtttacaaagcactctgcttcaccgactgtgatcctcacagtcctgtccggtggcctcacgcaggtggcggtgcagcctttcaggcccagagcggccaggagcgaagcccgcagccccgcctggaagcgcagcgcggtcggtcgcgcgcccctgaggcttggaggcctgggcttcccccagcagcgctcgagcaccgcccagtcgagcctcacaccggatgccacttcatatttgggcccagagctcaattcgcgccgatgcggtccgccgtccttaaatctcttcagccaggatctctccccgactgcaaagcagccctgggcgggagcggcaacatctccacgtcacccttttggagccgccgacattcagaggggcaggacacgggaacgcgcgctgtcttgctttacggcgcgggtgcgcgagtttgcggcagcgtgacgccctcaagttttggcgggaaaagcgctgcatttggattcctgcagtggtgggcaaaggacagtccggtgaggaagggcggccggtagagtagggaaggtttctaaagaaggagttcggggtctagattagtgagggagggcatggtgggagaaagttagcattgactagcgcaggggattggagagactcctgcggaggggcggtttcggagggtggaggaatggtaccaggaggttcccgttgtgggggcgggggcaggagggactaacccgctgctagctaagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 1628 - DNA, 32012 bp, Homo sapiens; identical to SEQ ID NO: 1627
  source 1..32012: mol_type = genomic DNA

SEQ ID NO: 1629 - DNA, 32012 bp, Homo sapiens; identical to SEQ ID NO: 1627
  source 1..32012: mol_type = genomic DNA

SEQ ID NO: 1630 - DNA, 30919 bp, Homo sapiens
  source 1..30919: mol_type = genomic DNA
aagaaccccaaggaagagtcccagcccttcctttcgcctctgggggcagtttggccccgccccggcctttgggacgggtggggctgtggatggggatgggaattggaattgagcaattgggaggaggcgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 1631 - DNA, 30792 bp, Homo sapiens
  source 1..30792: mol_type = genomic DNA
cgctgccgcaggcgttttctgccccataccgctccctatatcctcttcctctcttccccagacccccacctctccctcctccttccccagtcgttcgccggaaagcatttgtctcccacctcttcataacaacaattaatttcctctggggcctgaggagggcagaatttcaaccttcggtgtgcttgggagtggcgattgtgatttacacgacaaaatggtcaggtttagaatagttgttcgtggttgaaagacttggataaatgtggatgagatagaaggggaaggcaagagctgttaattttcgtgggcaatcctggggagaggcggggctcagtggcttcactggtgatcttacactctacatcttttctggattcctgccttttacagccgaggtgctcggtggagtcatggcagtgccctttgtggaagactgggacttggtgcaaaccctgggagaaggtgcctatggagagtgagttcttttaagcttgccttcgttttctgagtgcatattcattgttttggagtctcacactctggtgatttagaaagtagatgtttgagatccaagggttttggcaactgaagttacacagccttttgctaggattaaaaattttttccttccctttaaaaaaaaaagttttctttgtagagagctggaagggacacgaagttattgtttccatgcccacaaatggcttctcagggtttaagcattgcggttaatgagcaaatgagcagactctggagattgcctgcctggtttcagatccttgctctatcacatactggtcattgttttgtgatcttaggcaagcttcttaatgtcattgtgtacctctccttcactacctttagggtggcaataatcgcatctaccccataggagcttaggacagtcagttacacaagcacatatagtatgggattaatgctcttaaaagtatatgagtagaacatgtatatatgtgatgtggcttagaattatctcaatctattttatgaagcgtttattaaatgacttgtgtgacagcataatgacgtctttggagggttagctattgtatttcacattttagaaaagagtagtgtgtgttgagaacatagcagaaaccacttccttggtttctcctttgtggaaaaagtaatagaggtaaaatcgttttggatgagtcatgtttaatctttggaagttttagaagaaatggaattctgtaatgttaaaactcttttcctttttagagttcaacttgctgtgaatagagtaactgaagaagcagtcgcagtgaagattgtagatatgaagcgtgccgtagactgtccagaaaatattaagaaagagatctgtatcaataaaatgctaaatcatgaaaatgtagtaaaattctatggtcacaggagagaaggcaatatccaatatttatttctggagtactgtagtggaggagagctttttgacagaataggtatggaagaaatttaagataattattttaaacaagtttttaaatttgttttttaaatcttgggcatgctatttggtcgttgtcctttcaaaattgctcatgcaactgtgaaattggaatacattatctttaaaaaatttttccacctggtgttaataacataaaagcatatatagagtcaatgaaagaaaacttctttcccaagttatataagtgattttgatttaagattggtgtcttacagaatttaagagtgacaaacaagttttatggtacatcataaatgcagtgtatcctaaatgcaatgtattgcctacacaattttttctttgtagacattctagttacatgaaatcattgtatacattttatacatttacagatctaaaatagcatgctgtttcctcttggtttacatgaaataattgagaattttctaggattgctttttgtatattaagtaaattctatgtttgctattaatacttaaatattcgatgtagaatcaaaggattgatatttcagaacactgagaagtacataaaatctggatctaaatttataatttaaatttataatttaaagctattgtattaaataagtttatcagttaaaaactgataaagaggtattaggatctccagtgtgactcaggagagagttgagggtaaaagaaatggagttaatgagagagatcaaaatataaaaagataactgataaaagaactttcataataaaactgtttcacgaaggacctcacaggcatttgtggttttgtactgtgagactatatgaagtttaaatctgagccaggtgtggtggtacatgcctgcaatcctagctacttaggaggcaggaggattgcttgagctcaagagttccaggttacagtaagttatgatctcacgccagggcactccagcctgggtgaaagaacaagaccgtatctctaaaaaaagttaaattataaaagaagtataatctgtaaaatatttagtgaaattggcttagatttgcccagacttcccctttggcattatatttcaggaatgagaaaaataattagcatagcatttagaagaaatggggggaatttcaaggttactaaataaatcagggttagtataagaggaagcagaggctttgaagtcatggcttgcattcttgatttggatattggttttctctttataatttttctgtgatgacgccttttgccacctaacacaggtaaatgtgagttaagccccatatgtgttagtggactcctgaatcttttgttggcatttgcttctgtttgcctaagcacatttgtaaatgtctaagcttcaaattaagaagctatgtggttgctacctgattatatttagtcaataaacttactttcatatttgttttagagccagacataggcatgcctgaaccagatgctcagagattcttccatcaactcatggcaggggtggtaggtatagttgtctatttcccttttacttaaaattagagtgaatacattacattaccaaattctagtgtgtttctctctgcatccctcttaggtttatctgcatggtattggaataactcacagggatattaaaccagaaaatcttctgttggatgaaaggggtaagtttagcattttatcactacctaaaataaaataaaataattacctaaattattttaattacctaattattttaatatagccatacaaggcaaaatcaagtctttttgcattactggaatttcaagacaagatctgaaaaatcaaggaaattttggagacttcgtatatttggaaatcacaagtctcattttgcaatacaagtgcggatcaggtagagaaatctgacctaggtgcaagcctagctcactatatgtataagaataatttttttttttttgatacaggctcactgtgttgtccagtctggggtgcactgtattatcacagttcactgcagccttgacctcctaggctcaagcaatcctaccatctcagcttcccgagtagctaggaccaaccacaggcaggtgccaccatgcctggctaatttttgattttttgaagaggtggagtcttcctgtgttgctcaggctagtcttgaactcctggactcaagcagtttaccagccttagcctcccagagtgttgggattatagacgtgagccaccatgcctggccaagaatagtttaaaataatcctttaatggattaataaagggaagttcctgtggaataccctggaccttagtcttgtcctgttcactctttttttatgtatgacgtggataaaaatgtaagaaatttagttatattttctgaatgtcatcaaattgagaaggatggatagcgaaagctttaagcttacagggtcagaatcaaaaaagaaatgtcagctgtatgaggcagtagtttttgtctggtttaatgctttattcttagtattagaatagtgcttaacaaatggtcagcttttttttttttttgaaacagagtcttgctgtgttgcccaggctggagtgtagtgacatgatctcggctcactgtaacctctacctctctggttcaggtgattcttgtgccttaggcccctgagtagctgggattacaagcctgagtcaccacacctggctcatttttatatttttagtagagatggggttttgtcatattggccaggctggtctcgagctcctggcctcaagtgatctgcctcccttggcctcccagagtgctgggattataggtgtgagccgctgtacccagcctatacatgcttttttcttatgtgcatatggattttactttttacccctttaaactgagtttatatgacataaaaatctttatttttatttaaaactttaaaaattcaggtacacaaaaattcttatgtattataatgaaatgtaaatatatgtatatcaacccacctggtttaaaaatacaacattattcgtatataagaatgctcacagtggtgatgtttttaatatagcaggaaactaacccaaatgtctgtcaacaataaattatgaaatgcatggcttttcaagccatgtcacaagcagtgacacaagcatgtcacaagcagtgacatggatgaatttcaggtatataatgatgtagagcaaaaagagacagttgcaaaagaattcatatggtctgattctgtttatacaaagttcaaaaatatgtaaaacctagtatattgttcaagtatgtaaacatggagaaaaaaacatgcagaaaagcaagggtataataaaaccaaattcagaatggtctaagaaagtaggggagggaatgtatttaaggaagtatttaaagatttcaaaggaaatagagcattgtttttctaaagtgagtgggtgtttattacattgttattctttatatcttgtattaatatacaagatataattctttgtttctatttaatatttaggagtcttttaaaaaaagaaataaaatgttaccagtatttaatgtcctcctgtttatttcatcacaaatatattcttcctttgtttttctaagagctaaacacattcctacatttaaattttattatgtgcagttctctaacatagctgagtattatgttgcagacataacaaagtccaaggaatactatagttatccattagtattttaagtgattactactcataagtaatttgaaactcaatctcagtggtttgtccaatagtgtcatatttaactactgaaaagataatcaactgggtgcagtagctcatgcctgtaatcccagaggctgaggtgggacgattgagtgattctaggagtttgagaccagcctagacaacatagaccctgtctttatgaaaaattaaaaaaaaaaattagctagacatggtggtgcacacctggagtcccagctacttggaaggctgaagcaggaggattgatcacttcagcctaggaggtcaaggctgcagtaagctgtgatcacatcactacactctagtctgggcagcagagtgagacactttctcaaaaaaaaaaaaaaaaaaaaaaaaaaagggtaatcacagtagctacctcctaagtcagatagaggtaaacatttcattggtttacatattgtgtgaatgtacttgatttttaaagaaatcagtcccctattttgagacatttaagttgtttctaacttataaaataggacagtgatggcttctatcaatttgtgtaaaaggccaatataaaaattgcgtcatgctataatattttttatgctataatattttttatgccattagcctttttgtcccacttacacactatttcatgttagtatgtatagatataccttgttgattgttttcaaaacctacctccacattttccattgtacaaatttggacatttatttacaaataatattgctatgaatattcttatgtttatgaatttgtgggattatttctatggatatagaagtgggaattgctagttcaaagagtgaatgtttcacagtttagtatgttttgccaaattgccctctgataatagagggccttttctaactcttaagactgggttacattcctttgctctaagatcctatagtgctctatatttttataaccttcataacagttttctattgtcagtcttcactaatttatctattacctgcattggctggcatagtgtctgtcactaagttacagtagatattcactaaacataagttaagtcctgcctgcagtttttgtgtgttgaagatgggaagttagggtggaagttgggtcttctgatattttttttttgtacagagtttgtcctctttttctcagactctctactttgaagaaaaaaattactgtggtttgttgaattttggtgtgtcttcacatattttcttctgccaactgggtttgtttgctgctgagaaagttgtgcctaacatactactgatgtttccttcctgccctccaccctacctgatgaggggccttgctttactttcatctcaggtttagagtgctcttttccagaagggcagccccttctgactccagcctctttctttaatctggtccagactgttctgtgtgttgataatacttcttttaagttaatagaagaggtgaggcctttttctacttttagcatagatgatgatttattttatttttttaaatttctttttgtctattttgcttattttaagagaagttctacaaaccttaagtaacaccagtgattttttttcagtaaaacttaattcctgtaagtatatctatttgcaaaacatttttattcagtgtcatctttttttcttttggtttagataacctcaaaatctcagactttggcttggcaacagtatttcggtataataatcgtgagcgtttgttgaacaagatgtgtggtactttaccatatgttgctccagaacttctgaagagaagagaatttcatgcagaaccagttgatgtttggtcctgtggaatagtacttactgcaatgctcgctggaggtaagagctatttaatcatggtaaaactcctataaaaagtcagattagttatactgaaataaatgaaataaaccaaggaattcatgtttatataatagtttttgttttcttttttaagagacagggtctcactcttggccagactggagtacagtgagctgttatagctcactgcagcctcaaacttctaggctcaagcaatcctctggcctcactcttccaagtagctaggaccagtggtgcctgccacaagacatctggctaagttttaaaaattcattgtagagatgggatcttgctgtgttgtccaggctggtcttaaacacctggtctcaagcaagccttctgtcttggtctccaaactgttaggattaaagtaaagacatgagccatggtacccagcttttatagtagtattttaatagtgtcttgatcggtttggtaactgctgtaacaaagtatcatagactgcatagcttataaacagcaaatttatttctcacagttctggaggctgaaaatatgagattaggggtgccaacctggtcatgttttagtgagggccctcttcctgatttgcagatggctgtcttgctgtgctctctcatggtggacagccaagagagcagaagcaagctctattgtggtttttttttttttttttagaccagagtcttgctctgtcacccacgctggagtacagtgatgtgatctcagctcactgcaacctctgcctcccaggttctagcaattctgtcccaggctcccaagtagctgggattacaggcatgcatcatcacacccggctaatttttgtattttgagtagagacagggtttcaccatgttggccagactggtctcaaactcctgacctcaagtgatcccccaacctcagcctcccaaagtgctgttttttgggttttttgttaaatgaccagatgttgtgagatattgtgtctgttttttgtttttttgtggttttttttgagacagggtctcactctattgcccaggctggagtgcagtggcacaattcaaggctcactgcagccttgagctcccaggctcaagcgatcctcctgcctcagtctcctcagtatctgggtctacaggcgtgcaccaccacacctggctaatttgttgtgggttttttttcacagacggtctctccatgttacgtaggctggtcttaaactcctgggctcaagtaatctgcctacctaagcctcccaaagtgctgggattatataattagtgccctataaagatacaatattgtccgggcacacaagcccttattagacattaataagctcttaataagagcactaataccattttttgagtggtcccatcaccaggacctaattacgtctcaaaggccccacctccgaatgccattgcattatgagttaggatatcaacatgacttttgagggggatacaaatatttagcacattgcaaatagtaacttatttataatcccaaagattttttaagctaaggcatgcatagttattaaatatcacaacacttatctctcctgtgtatcatgtaaacatttgtgaaaacaagactagggcaagaaatgattcatctgttttttggtttttttttttttgagacaaagtcttgctctgtcgcccaggctgcagtgcagcagtgtgatcttggctcactgcagtcttgacctcttgggttcaagtgatcctctcactttagcctcctgaggagccaggactacagatgcacaccatcacgcccagctaattttatttattttttgtagagatggggtctcactatgttgcccaggctggtcttgaactcctgggctcaagcagtccttctgcctcagcctcccaaagtgctgtgattacaggcctgagctgccatgcctatcctgattcatctatctttgaagtgcctctaaagtttccaagttgggattcttagtgtgaaaaccatattgaattaattcaaaggaaacttttcatggatttatattattatttttccttgaaatctttataataagaacatttaaaaaaactgggacttgctttgtttttagaattgccatgggaccaacccagtgacagctgtcaggagtattctgactggaaagaaaaaaaaacatacctcaacccttggaaaaaaatcgattctgctcctctaggtaactgaattatcttgagtgaaagagtaccgatttcttggatatgaagtcttgtgctatttgaattttttcttacttttttttttgttttaaacttacaaataattcatgttcgttgtagataaaatagtaactataagtaaaaaattaaggaaaaaataactctttagtcccagaactctgcaatagatttttaaaaatattttggggagtgtatattcagagcaacttgaatctgctcttagatggctttttacttaaagttttcatatgtgctatactttgttgcaaatacactcgtttgttgcttaattatagggatgcactctaacaaatgtttcattaggtggtttcatcattgtgtgaacatcatagagtatatttacataaatctagatagtatagcttactataaatctaggctatttggtataccctattgatctcaggctgcaaacctgtacagcatgttactatactgagcactgtaaggaattgtaacataatggtatttgtgtatctaagtatagaaaaagtatagtaaaaatacagtattataatctaatgggactgtctgttatacgtgtggtccattcctgactgaaacatcattaatgtggcccataagtatgtaaaatgaatatatgtatattatttatatgtgtttttatacaaaatgagatcacactaataatattttgtaactgtttttggttttagtgcgcagcgaacattcttccatgactataattgtaggtctacatcgttggtttaaaggctgtgataatattctgccatgtggatatgccttactttactcttttaatcactttgttggagatttttctaaattttcacagatacaaaagagatataagtatctgtgtaacttaatcatgacacatacccttaaattgttcattgaaatccccagaagcaaaattgcaggatcaaggatgtagtttttattattatggcttattttgtcaaattgcttcccgaaagttcgaaccatttcatcacagtctcatcaatttacattaaggaaaaaaactttaaataatagtttttcatttttattttaaatttaatactaatgaagttgtataccctttatgtatgtattagttttttgtctattttgctcatttttgtcaaggatattgtttttcttaccactttgaagcttttttttttccttgataacacattgacctttgcacttgttacaaatacttttcacaatttatcatttattttcattttgttttgctatattgacattcaaatctattatcttgtcctttgtggtccctgactataatttctttggaaaggtcttctacctctactatttaaaagttccctatgttttcatttagtgtttttatggcttcatttttccatttaaatctttggtccattaggaaataatcttcacataggaagatacgtgaattttttctcaagaaaattaagataccttaggatggttagttagattactgtctcttaaaaagttattggtaagtaaatgttcattataaaactgtgtgaataaggaggtcacgtgagaacatgacattgaagtaatgaaattcggtattgaaaatggataagaggggtttctgtatctttttgttaatctcgtcacatgaggagaaacatttccatctggctcttgttctcagttgcaaacaattgagaatcagatcagggaagactactccaagatacagcagcagagaaaaactgcatgaaattaaagcagtaatttagtagctttaattctttctcttccccaggaataatatttagacataagtaggctaacagaaaatgtgtttcttacctcaagccataggcttctctaacatgattctttcgtgaatgttgtcgtaatgtttgtttttagctctgctgcataaaatcttagttgagaatccatcagcaagaattaccattccagacatcaaaaaagatagatggtacaacaaacccctcaagaaaggtaatatccttaaactacaagtttgtttgtttttctgtggaagaaaaggtaattgcaaagttattatcacaagtcaacaacacatgatagctatgatctctgtcctcatggagattataatgtccagtagaaaaaaatacagaaataattttgtttattaataattataaaggggaaagtcagggtactatagctaagtgtttgaccaagtctaagggacagggaagacttttcttcctgaagaaattacattaaatctaagatttgaagattaaagggaagctaggcaggcaaagtaagtggcagatttgattctgaacaggggaagcagtatttgaaaaatcttagattttagaaagtctgatgcttttgagaaacttgaaagatcagtatggcacaagccgtgtctgttgtgttcatcattgtatcatcagtgctttagcacagtatatggtgcaccataggcactcattaaatatttgttgagtgagtgaacagggaagtgggagaggaagacaggtttgagatgaggccagagaggtcgctagtggccaatttgtggaagaagaccttgtaagccatgttaaggattttgggctttaacttaagaccactggggagacctctgagagattttaagcaagactatgacatagtcatatcttcggtttaaaaatatttctctgacttccttattttttttccattgttttttatgaatagggaaagattcagggtgctgtaggtttttctgctagttgtctagaagtgggaggctggtggcttggaataggttagggcaatggtattggagaaatgagatgattccaaagaaatttaagaactagtattgataggactgttaggctgtgaatggaaggagagaggacaatgactagagatgatgaatgaaaaacattcagagagttattaatgtttaactctgtcctcatggatagaaaagagttaatgtttaaacattcactcttctttaatacctctctgcatgtttcttcctccttgtcctaacttaaagtccaattctcccctgaggacactgcttcctctgaagcggtaggtgttttctttcccataccctcatgtcctttgatctggacatggtacaggtgtcctccttattcttcattgtcactttctcccatcttcctttatgtctctcccctctaacttttgaaccccaaattaaaatttctgccgtactatcacagtctgcaaaatgactcttgatgttattttcgtcatgattcttggtgatttaaatatttatttggatcatcctcctgatatcctgacttcactgtttcttgaccctctctcctatagtgatgttgtctttgaacacgctgcactgatcaccagtataattttttctgacttcctcccttaatattctaacttaaacagtcctttgtatctggacttgcaattaattaattctatctcttcagtctcttacctgctccctctctaggtccttgatttcatctttacctatcttaaatctttaggttagtcattataaatgactgctttgcgttcatcatcttcaatttccttgtccccttctctcttcatcatacttagtgggtaaaacccagtaagtagtttctgggtttaatctagtagttttctacgtactgcacacttgtacctgcacaacagattgcagcaggagaaaaatacccaaaaatgttcactttaaattcaggattactaatctcaagtgggcccttaatgcttcctggcatttggccttcgtttccccacatctttctctgtcctgttctcctaaatcacgtttttataatacttttctcttttttttttttttttttttgagacagggtctaggctggagtgcagtggcgccatctccactcacttcaacctctgcctctcaggttcaagcgattcgattctcgtgccttagccacccgagtagctgggattacaggtgtgaaccaccacacctggctaatttttatatttttagtagaggttttgccatgctggccaggctggtctcaaactcctagcctcaagtgatccccctgcctcagcctcccaaagtgctgggtttataggtgtgagctactgtgtctggtcccttaacttttattatcttctctccatcctcactctcagttgttcactttgcttcctgtgtcactgggaaatgaaagccacaagagaacttaggcaagctcccaccaccatctcctccatactaactgcctctatgctcatgtattctctttcatcctgtattgctgtagataaattgctctggatgtaagccaggtctttctcttacccactcaatgactttgtctagcaatttttctccctctcctacattattaatttttccttctctaccggatctttctcatcagcatatctacatgctttttctcccattttaaaatcaaatcataatggtaataaaatttctcttaactccacttttccctaccattccatcttcttcacaattgaatattcctaaaattgcttctcatctctaacacctcaaaactagttttcaatttcatctattttgttgccaagagtcacagtgatttttggaacgtgttgccaagttcaatgtaatagtccactgtggtcaaccgaggtctgaaaagattaaatggaaagtaccagaagtaaacaattcatcaattcatgggttttggccgggcgcggtggctcacgcctgtaatcccagcactttgggaggccaaggcgggcggatcacgaggtcaggagatcgagaccatcctggctaacacggtgtcaccccgtctctactaaaaatacaaaaaattagccgggcgaggtggcggtcgcctgtagtcccagctactcgggaggctgaggcaagagaatggcgtgaaccccggggggcggagcttgcagtgagccgagatcgcaccactgcactccagcctgggcaacagcgagactccgtctcaaaaaaaaaaaaaaagaaattcatgggttttatttatttatttaattcgagacgggatctcgctctgtcgcccagactggagtgcagtggcgtggtctccacttactgaaacctctacctcctgagcttaaatgatcctcccatctcagcttcccgagtagctgggactacaggtgtgagccactatgcccggctaatttttgtatttttggtagagatgaggtttcgccatgttgcctatgcttttctaccaaaaatacaaaaattagccaggtgtggtggttcacgcctgtaatcccagctgttctcaaactgctgggcttaagcaatccacccaccccggcctcccaaagtactgggattataggcatgagccacaatgccctgccataggttttaaattgtgtgctgttctgagtagcataataaaatcttgtgctgtcctacttcatctcacttgggatgtgaatcactcctttttccagtgtattcacgttccatgtgctacctgcttgtaactcccttagtagctgttttggttattagatcgaaagaacatatatagggtttggtaccatttgtactttcaggcatccacttgaacatatccctctgtggataaggggggtactactgtagtcagttctcagacctcttgttttatctcatcaatattttatacagttgatcatgccctcctcctttaaacactttcttcatttggcttccaggcgttacactcttctgattttcgtccttctcactggtcgctcttttcagtctcttgatggttttttttcatctgctcagcctcctactattggagttctccagggctgaatctatggatctcctttgttttcttctccacactcactccattagtgatattacttggtttcatggctctaaataaaactatatgttgatagtcacatttatatcaacctagacctttcctctgaattccaaacttacatgtcttaactgccttctgaaatttcacttgaatgttaagaggcatctcacacttgatgaattccaaactgagttactgatcttttcctttcaaacccattccttttcaaagtctttcccatgttggttaatggcaactgcattattcttattatgcagatcagaaactttggaatcatccttcatttttctcattctcttttacttcacatccagtacaccagctaattctgttaacctctatctttaaaaaaatcttagaatctgattaccttttttttttttacctctactgttaccctatcattccaaattaccatgatatctttccaaaatgttctgatttaaaagtgaattagaatatatcactattctacccaaatcctccaatgctttagttctcacgtgtagtgtaagctaaaatcagttcatgacctgtgagttcttacacaattttgttccttacattacctctccaacctcagttctgctttgctcccccttggtcatattgttgttcttcttattgttctccaagtgctctaggcacacttctacctcactgtttttgtagtgactgttcctatgtctgaaaatgctttttcccatgggacttatttgcatgtcttattctcttactttctttggatattgacttcagtgtcatctttccaataagcctttcctggccatgctatttaaaatggtatcctcttccctctaacacatttcttaaatttttaaaatttttactctcttgtggacatacgcaatccaacacgtttcttcattttattttccttcagtgtacttaccaccatttagcttactgatttttaactgtatttgtatttattttatgttattttgtctctcctcagtagaatgtaggatttaaaaggtcaagagttttttttctattttgctcactgctgaatacctgatacctagaataatgcctggcacagagtagacctaataaaatatctgaatgaatggattaataaataaaaagcaggtttaaaaaaaaacttgagcatgtttaaaaagaaacaaacttaagcatgtttaagtggtttgggtacggatcctgtagagaggaagaggctgacagtctaagagaaaggaaataaataacagaggatcaagatccctaaggaggtagaagggtatgggctccagagcacaagtagagagatgaacatttgatgggagaatggaagggatgaaaagatgtataataatacaaataacttagctttggtagggataagttgatgtagtttctgtctaatggctttattttttctctgaaatgggaggtggtagtataggtactggatggtagtcttgggaattacagaaaagtgtagttttgaaatgatccttgtggagaaaaggaaaggaaactagagaaacaaatattatctggcaatattgaggtttagctagggattgtaaccataaatttacagtggcgtcattttccatataatattcttctttataaagcttttccaaggaatcaaagaatgttggctatagcagattcataatgtttattgctattatcataaattattttttattttaaaaagttctagtcctttagccaggtctgttgtcttcatagaacattgttctgttacccataaaagatgccattaagactgtggcctgggccgggcgcagtggctcacgcctgtaatcccagcactttgggaggccgaggcgggtggatcacgaggtcaggagatcaacaccatcctggctaacatggtgaaaccccatctctcctaaaaatacaaaaaaaaaaaaaaaaaaaattagctgggcgtggtggcgggtgcctgtagtcccagctactcagggggctgaggcaggagaatggcgtgaaccctggagacagagcttgtagtgagccaagatcgcgccactgcactccagcctgggtgacagagcgagactccgtctcaaaaaaagaaaaaaaaaaagattgtggtctgagcatactccacactttgaacatgtctacagatcatacttaggtattgtaaaatacctaatttgacaaatgagttttagtaattttataacttggccatattttttataaaatcatataggaagactttgttttatatcttacaaaaattttgtgttaaataaatagatttagacatagttttacttcttcaagttgccagttgggttaatttaaaaacatacttgcatagaagacttgaaagcatttgtatttgttttcttttttaggggcaaaaaggccccgagtcacttcaggtggtgtgtcagagtctcccagtggattttctaagcacattcaatccaatttggacttctctccagtaaacagtgcttctaggtaagactgataaagattgagtagtttttgattgtagtattccccatgaagaataatacatgtatgtgttttttcataataatcgacattaacataatactgtaagcatgagaacttgtgtgtgatataagaaaggcctgatagattttattttattaaatgtatgtttctttctgtcttaatgcctcagtgaagaaaatgtgaagtactccagttctcagccagaaccccgcacaggtctttccttatgggataccagcccctcatacattgataaattggtacaagggatcagcttttcccagcccacatgtcctgatcatatgcttttgaatagtcagttacttggcaccccaggatcctcacaggtgagggaatttaattttttaaaagtaatggcagctctttattttttattgtcttaaagtccttttttaatgtgtaaatcttagatatataacttttaaatcacatgtattcttttttggtcaaggaagaaagagaggagggaggccttcatgcaaaataattttaagtcagactaaatagctatgatattactgtctttagtcctaatggatttattcatttgtcttctgtttgacatgtagaacccctggcagcggttggtcaaaagaatgacacgattctttaccaaattggatgcagacaaatcttatcaatgcctgaaagagacttgtgagaagttgggctatcaatggaagaaaagttgtatgaatcaggtgtgtttcattgattttcattataccttttcctgaagaagaatttaaatatttgagtaaaagctatcattagtatattttttaaatataggctgtggctcacacctgtaatcccagctttttgggaggctggggtgggcggatcacctgaggtcaggggttcgagaccagcctggccaacatggtaagaccctgtctctactaaaagcacaaaaattagccggcctggtggtgcatggctgtaatcccagcttctcgggaggctgaggcacgagaattgcttgaacctggaagacggaagttgcagtgagccgagatcctgccagtgcactcctgcgtggccaacagagtgagactgtctcaaagaaaaccaaacaaacataaaaatacaaagtaattagttaatttgaaaaagaaactatttaagtaaaatgttctttactttaagaaataatacttttttttattttgttttattttttaatttttaatttttagccactgtgcctggcctaagaaataatatttcttaaaagacctttttattgttattaaaaatagtagggagctggaatcattatctttgtaaaaactatgtatacttaaactgtagacaataacagttgactgcctactatgaaagacgaatacattagcaatcccacactttctcccatctcccttgattgcacccgtcaatttttattgtttatattattagagcatagttataacattggtattctaaactgtctttaaggcttttcaaaaaaaatgttaatgtcaatgaaagacaaatagggtagctgttttttactcaaggagactaaagaggcctgataactaagtgcaagtgcaatgcatgatctttcactagatcatgtatttgaaaaaaactataacggacattattggaacaattggggaaatttgaatatggactgtatattaattaggtaatgtttttgtatcagcgtcagatttcttgggtgtgataatactgtggtttgtaggagaatgcccttgttcaaaggagaacaagtgtcaaagcaaagttgaagtgaagtgatattttcattcagcttaaaatttaaaaaaataaagggcaaacaactacataaaggccaataaacacacacatatctggtagataaggccaatgaagagtatatggttatttattatactcttttttcagtttttctgtagattcgagttttcaaaattaaaaattgggggaactgttactgtgtagaaatctgaggtcagcctgatagtcttctcactcacataggtgattcactttctttcaggtagactcagagataaaatttgcataacataagaatcatcactttaaccattttaaaatgtaaaatgcagtgctttttagtatattcacaaggttgtgcaaccatcgcccctaattccagaacattgcatcaccacggggaaaaaaaaacaaaacacctctgtaccacctagaatcactctttattcctttcttgctccattcccagacaacctcgaatctactttctgtctttagggattgcctttttggacattttatataaatggaatcatataacatgtagtcctttgggtctgtctgctttcatttagcacgttttcaaggttcatagcatctatcagtactttattcctttttatggctgaataatattctgttgtgtgtatgtattacatttcgtttatccattcatccactcatggacatttgggttgtttctactttttcatcattatgaataatactgctgtgaacaatcttgtaccagtttttgtgtgaccatatgttttcaatttcttagatatatatggaggaatagaattgttggagcatatggtaactcttcatttaactttttgagaaactgtgaaatgatttttccaaagcacctgtaccattttacgttcccatcagtaatgtaagagggttccaatttctctacaaccttgccaacacttactgcctcccctttttgctatggccatcctagtgtgtatgaagtcttatctcattttgcttttgattttcatctctctaaagactaatgatcttgagcatattcttatatgcttattggccatttctttataacagtatccggatattttgtccatgctttaactggcttgtttttattgttgagttgttagagttcttttacattctggacactagaaccttgtcaggtacctgatttgcaaatattttatcccattctgtgggagaaaattcccccattcttttgttttcttgttagtgtcgtttgatgtactcaagttttagattttgatgaattccagtggatctataatttctcttttgttgcctatgcttttagtgtcaaatttaagaaactgttgcctgatgtaagattgtaaagatttatactttatgctttcttttaggagtcccagcctcctaagtagcggggactacagtcttaaagtttagctcttatatttaggtctttgtccattttgagttaatatttgtatatagtatgatgtagggtgcaaattcaaatgtttgtatgtgaatattcagattccagcaccatttgttgaagatatgttttactattagatggtcttggcacctttgttgaaaataaataggtcatagatgtatgggtttatttctggaatctcaattctttttttttccttttttttttcttcccctgtggactcaattcttttatttcatggatctatatgtctgtgctatgccgttaccacactatgttgattactgtagctttatagtgaattttgacattagaaaatatgagttgtccaagtttgttctttttttcaaggtattttggttatttgtggccccttgtttttctgtcttttaggattatcttatttctgcaagaaaaaaatttggaattttaaaagagattacattggggagtatttccattttagtatatattgagtattctttattcaaggtgcttgggaccaaaagttttgtggattttacatttgtttggattttggaatatttgcatatgcatattgagataacttacagatgggactcaagttgaaacatgaataattttatttatgcttcatatatacctgatacagatagcctgaaggtaattttatacaatgttttaaataattttgtgcatgaaacaaagtttgtacattgaactatcagaaagcaaacctgtcaggtatgaaattttcagtttgtcacatgatgtcagcacctgaaaagttttggagtttggaacattttggatttcagatttgagattaaggatgctaaacctctaatagtaactcttctaatccaataacatggggccttttttttcccatttttttagggtctttaatttctttcaagaatattttgtagttttcagtgttcaagtcttgcacttcctaggttaaatgtaatcctgtttattctttttttttttatcctgatgctgatgtaaatggaattttttaaaattttattttcaaattgttcattgctatatgcaaatgaattttgtatattgatcttgtatcctgaaaatttgctgaattcattaactccagtagtttttttgacaaattctttaggttttttaatatattaagattacattatttggcagggcgtggtggctcacgcctgtaatcccagcactttgggaggccgttgcgggtggatcatgaggtcaagcgtttgagacctgcctggcccacatagtgaaaccccgtctctactaaaaatacaaaaaattagctgggcgtggttgcgggcaccggtaatcccagctactcgggaggctgaggccggagaatcacttgaacctgggaggcggaggttgcagtgagccgagatgacgccactgcactccagcctgggcgacagatcaagactccgtctcaaaaaaaaaaaaattacattgtttatcaatagagatacaggaaattgttttacttttttttttttttttaacccagatgccttttaattctttttgtttagttgtcctggctaggacttccaacattatgttgaacagaaatagagtctttgtcttgttcttgatcttagggttaagtttcgagtctttcagcattaagtatgatgttagctgtggggtttttgtttttatggtgaaagagtattggattttgtcaaatgttttctccgtctattgagataatcatgtggattttttttccctttattaatatagcttgacctcctgtgcccaagtgatcctctcatctcagcctcctaagtagctgggactacaggtgtacactatcatacccagctaactttttaaaaatgtttttgtagagatgcagtctctgtgtttaccaggctggccttgaccttctgggctcaagtgatcctcctgagtagtgggtactacaggtgtgcaccaccatgcccagctaaattgacagttttcatcagtctgtttattttgtctaatgttagtatatccacatcagctcaccagctatcttgtgtattttcctttttttagatggagtctcactatgttgcctaggctagactgtagtggctacttaaaggcacgatcatagtgcaatgcagcctcaaattcctgggctcaagtgaccctcctgccttggcctcccaagtaggtgggactgcaggcatgtaccaccatacccagctaccagctctcttttggttattgtttccatggtctattttttttttccttttccttttaacctatttgtgtctttgaatctaaagtgccttagccaggtgtcatggctgacacctgtaattccagcactttaggaggctgaggtgggtagatcacttgaggccaggagtttgagaccagcctggccaacatggtgaaaccccatctctactaaaaatattttaaaaattagttgggcgttgtggtgtgcacctgtaatgccagctattggggaggctttaggtgggaggatagtctgagccattggagatcaaggctgcagtgagtcgtgatctgattgcatgactgctctccagcctgggtgacagagcaagactgtctcaaaaaaaaaaaaaaatcgcttcttagccttttggctaagatcaagtgtagtatctattcctatcagtttaagtgccttaatttctcttccactttttggacaggtagttttgctggatatagaattcttattagcttttgtctttcagcactttgattatgccactactgccttctagcctttgtggtttctgatgagaaatcagctgttaatcttactgaggatctcttttatgtgagacgttgctgctctcttgctgcttttatgtttctctgttgaccacagtttgactatggtgtatcttggtgtggatttcttttttcattctgttcggagttcgttgagcttcttggatatgtaaattaatgtttttaatcacacttgggaagtttttggccacaatttcttcagatttttttttttatatctaactctcctctccctcttggactcattatgtttattgttggtatacttgatgtgccacagttcttagactctgttcatttttctttattcttctttctttatgtttctcagggacagttttggttgctgtttttcctttataagggccatactttgtttccttacatgctttgtaattttttgttgaaaactggacatattgtggcaatatgtggcaactctagaaagtcagattttcccctcttgccagtgtttgttaccgcttgatgtagttgtttgttttttttagtggtgtttgtttttttttttttttgagacggagctttgctcttgttgcccaggctggagtgcagtggcgtgatcttggctcactgcagcctccacctcctggcttcaagtgagtctcctgcctcagccttccaagtatctgggactacaggcacctgccactgtgcctggctttttgtatttttattagagatggggtttcatcatgttggccaggctggtctcgaactcctgacctcaggtggctgggattacaggtgtgaggcaccatgcccggccctagtgatttttcttatataattttttaaagttggtattgtttgtcatgcatggctgtacaatttctgtcccattagttttagtggtcagctaatgattggacagagatttccttaaattctgtataccaaaaacaaaaaatctgcagagtgttctgtatttgtgttggggcacacctgcaatactcaaccaagaagtttacaacgttgcttcagccttcgctatctgcttgtgcaaaatgcaaagttagggcacatgtagagcttaggggccttctcagctctttcctaagcatatgtactgccctggtcatgggtgtgtctttttagattcccaggtatatgttggaccttttcagagtcctattccccagaaacatctcactccctaacctcttcttccaaacttcttgggtagtctgtttgcaccagttgctttcattgcttcaggcaacagagactaaagcattttcctgtaagtgttttcagcaaacgctactcaggagtagctttagcacaaggtgagttagagttacaaaggtgaaataaagacaagcctctttttttttttttttttttgagatggagtctcgcactgttgcccagtctggagtgcaatggtgtgatctcagcccactgcaacctctgcatcccgggttcaagcgattctcctgcctcagcctcccaagtagctgggattacaggcgcctgccaccacaccctactaatttttgtatttttagtacagacagggtttcaccatgttggtcaggctggtcttgaactcctgacctcaggtgatccacccacctcggcctccccaagtgttgggattacaggcatgagccactgtgcctggccaggacaagccttttgatcaggtcattttagagggtcagatcggcttaagatagtttgtaaatgaggtttattctgctcccacctggacctatgccttaaatatgaactgttattttcaaggctgctactgagtgaggagcaggggataaacagggtaagttaaaatgccagaaagctcactgttcttactgcgtttcacttgttttgaataagttgctgcaagcttttagctagtttacaatgttctgaaaaagttgattctgacaggctttggcaggtttttaaaattgcttttgtggagtaatggacttctggagttcttttctctgccattttcactgacatcactccttgattcactctctctcagttcttgaagtattttctttgtctttgaagtttaagagcttaattcagatgtgttgagttgaatatcttgtattaattttcccagaacatagtgggttatttcagtgctgcacagtcgtggtatggttgtgtgttttcatagtttcttgaagtaagaattattacaaaaacttttgtaatttgggctgtgttttttgggcaaatctgctgatctcgctcgggcttaactcatccagctgtagtcatttgatgtctttactgtggctggtggtctaaaacatccttactcccatatttggagtcttggcactgtctgttagctgagtcttttctttctgcatcattcagctaggctgagcgtctttccatgccataggaacgttctaaaagactgaaagtggaagttgaaggcctctcaagacctttgccatcttctaattgccgctctagcttttcagccacaagtcaggcctttttctttctcacattttaataatcttgtttttcctcccattatgttttcatctttgattgtttcttctttcagtggtattttggtaaaagacagtaagttttgttgctatgagttcatatacactcaatccctaggagctgcacccctgttgatagattgggttggggacacacatacccactgggagaagagagactctggaatgagtgagattatcagcatacttaatattactcctgttatggaggtagccagcaaattttttttaattgatacaataattgtaatgtattcatggggtatgtagtgatgttttgattcatataatgtataatgatcagatcaggataattagcatattcataatttcaaacattgtgggaatgggaatgttcagtgatgggaatgttcagtatccttctagcaatttgaaactctattattgttaagtatagtcatcctacagtggtctagaacttactcctatctagctgtaattttgtattctttcatgaatctctatctttcccttccctctccccttcctggactctagtatcctctgttctgccttctacttctatgaaattaacagtttttttgtttccacatatgagtgagaacatgtgatgtttaattttctgttcctggcttatttcactttacataatgtcctccagttccacccatgttgctgcaaatgacaggatttcattcctttatatggctgagtagtatttcattgtgtatatatatcatattatcctcatctgtttgcttggctttttgttttgtttttttgagacagggtctcgctctgtcgcccatgctagagtgcagtggcgcaatcatagctcactgcagcttcaacctcctgggctcaagtgacccttctgcctcagccccctgagtagctgggcctgtaggcatgcaccaccatgcccgctaattttttgggaattttagtagagatgaggtatcgatatgttgcccagcctggtctgaagcgatccttctgctttggcctcccaaagtgctggattacaggcgtgagccacagtgcctggcctacactcatctgttgttggatacctaggttgattccatatcttggctattgtgaataatgctgtagggttgcaaatttctcttccatataatttcctttcctttggatcagtagtgggattgctggaacatataggtagttttatttgtagttttttgagaaacttctattctgttcttcatagtgggtttactagtttattatctactcacccatgtggcttaaccttatttttgttgccttaggttactatatcaacaactgataggagaaacaataaactcattttcaaagtgaatttgttagaaatggatgataaaatattggttgacttccggctttctaaggtatttttatgttttattgtattctttctatggaaatatttctatatgaatttttttaatggcattatgtttgtatatatgtggcatttgtaaataggttacttgcttttttcgtttaatattatgagcatgtgttttcgttatctatttttcccgaacattgtttttttcaaatgacattttccttattataaaagtttttgccaggcgtggtggctcatgcctgtaatcccagcactttgggagtccgagacgggtggatctcgaggtcaggagtttgagaccagcctggccaacatagtgaaaccccatctttactaaaaatacaaaaaattagccaggcgtggtggcgggtgcctgtaatcccagctacttgggaggctgaagcaggagaatcatttgaacctgggaggcggaggttgcagtgagccgagatgacgccactgcactccagtctgggtgacaatacaagagactctgtctcaaaaaaaagaaatttctgcttttgtgaaaaatgtagataagcaaaaaatgagaaaataaaaataattctaaattttcagtgatcacattaatatttcgaagcattttaatatttttcttaatttatgtcttttaataaaaattatgatttgttacaaatatttcattataatttaatgaacctttaccagttataataattctgtgattgctattttatgcatagatttttttgttcatatttctgatgatttctttagaaatcattgattctaagatgatagtattacagcccttgatatataaaaccaaaataacatttttctctattttctgagagattgtatgtggctctaaagagggttggaggggtagctgctgtgttagagcatttgccgcagtactctttgtattagagatttgctgcaatactgtttttcagatgcttgctacagaattaaattaagatcgtagtataatgaaattcttctcataactaaatctattgattttggtcagtagtgttatgacaacaagacttcagtttagttgtatagtttattgttagtttccaaaccctcactgcctatggaatgtaatgacttaggtccagatataccaacacctgaaacagataggatgccatgtttatctgctctctgagctcagtgcagtaggaacagtgatgggcatgaaaccacatcagaattatttgtgtaacaattttctcttccaggatatttggtcttcataaacagaccgaaaagaaaatggtagctagacatacctaaagatgtttgtctcttgttaccactacaaagagattgattttaggacagaattttgtttttgtttttgttttgacataattttttaatactatttctaatatagggtgatggattggagttcaagagacacttcctgaagattaaagggaagctgattgatattgtgagcagccagaagatttggcttcctgccacatgatcggaccatcggctctggggaatcctggtgaatatagtgctgctatgttgacattattcttcctagagaagattatcctgtcctgcaaactgcaaatagtagttcctgaagtgttcacttccctgtttatccaaacatcttccaatttattttgtttgttcggcatacaaataatacctatatcttaattgtaagcaaaactttggggaaaggatgaatagaattcatttgattatttcttcatgtgtgtttagtatctgaatttgaaactcatctggtggaaaccaagtttcaggggacatgagttttccagcttttatacacacgtatctcatttttatcaaaacattttgtttaattcaaaaagtacatattccatgttgatttaattctaagatgaaccaataaagacataattcttgtgacttttggacagtagatttatcagtctgtgaagcgaagccagcttcaaaacatatccccaagatttgtacttatattttcaaaagggcctggccagttatataaacctgtttttgaattataatgattaattaaaattgcaagtaggtgttttttccagtgtagttagtaaaatacttgtattttacagtgttgcataaactctagtgcttaactaactttactctaaaaattactgttgaacatcttaaatatttttctatattttctactttcatagccatattttaaccttttcaacttactggtgaccaagcttttaggtgataaagaataaaagagggaagggaagagtaaggaagctataagaaaaatagatctgattctttgttcctttacctgttagacttacaaaaagtttgtttttctaataaaatttgtatcaactttggggcatattaggttgaggccttggctcctgcctgtagtcccagctacttaggaggctgagagaggaggatcgcgtgaacctggaagtttgaggctgtagtgagctatgattgcaccagtgcactccagcttggatgacagagtaagaccctacctctaataaaaatttttaaaattgtaaaacattataaaattaatcagttattttaatctgaagccaagaacatgtagaatgttatgattagagtttatcacatattaatgtatactggcaaattgtgttactggagtatacccataggaggaataaattcaaacctgttttatttatttgaacctatttacggtatgcttaagaattgaatcagtataaattctcaaatatgggagaaattttgttcttgagaattatctgagtcattaatatttttcaaaaacagctctcactgacttgaacctcttctgtaagctctaaccttttacctgctttacatttccacttgaatgtctagtaggcatctcttgaccaaaaacagcttttgattcctgttctccaacctgttcctctcctagttttctccatctcagaaatgttacttcctctgcaaagtctttccctgacttatctaaaataataacctcctctgtttgctgtgggaatttgtatagaatggtgggaaaatttcaagtttcatatttggattagctctgacatttatttatctgaacactggtaattgcctcagtaaagacactgataataagtaccttttagagttattttaatctttaatgctttaatgtgtaggaagagtatagtgtcctgttttgcacagaaaggcattctgtaaataataagttgccttaattttcctgtaatgttcattatattgttgtgggaaggtatttactcctattattaaaaataaaaatgtgtaaaatttactacctgaa

SEQ ID NO: 1632 - DNA, 47786 bp, Homo sapiens
  source 1..47786: mol_type = genomic DNA
ggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggtaaaaaggccgggaaagcatcttaatttagcgtgcagtctcagctggtcctgccattccagataaacagagaaaccattctgaattggggatgggggtgaggatgggaacaggagtctgtgtcctgctggggcaggccattggaagatgtgaaagagttgtctatttccttccaccggagggagacttcaggtcagccaggtgtctggagtatgaaccatgtatcagcaccgaaaggttctagaagtcagactttcgggcagtgtgtcactaactctcagcatgctggcctggctcggcccacagcaaggtcttctcgcctccctttgggtaaatactgaggggtgcctctgcaggacgggacctctgccagactccactccatacccagagaagcagggaaaccaaaattggagtcagccttgaggtgtagctgttgagccctcagcagctggggagagctggcggatgctgccctccccccagtttcctaatggtgttgtttaaaaagggtcaggggacgggggaacagatggtgggaagagcacagtgcagacacctggcaccggctctgaaggcagcatggcagctacaccgttggctgggaagggtgtgcccctgaagaagtcgtttacattctcgagtcaattttcctggagtgtacaatggacctgtgggaaagcctgtatgaaagggtaatgatgagggacctagcacagtgtccaatattttataggaactggaattgagctcataggagctcaattttattggcattgctgttgttggatggttaaaggggtggtatcccttttctcagactcccctgaaatgtatggtttgctttgaacccagagactgatgacaggtctgccggtgtggttgggtgcagccttaagttgctacgggaaagtgttggagggggagaagtcagaggtaaccttgccccctccctcaattccagatgaggaaattcaggcctgaaaagggaaagtgaccacctcaaagtctcatgccttggaggacccagcaggaatccaagacctctgaaaaggaccggcagggctcttgccacggctgggggtgtggtcatggtaacacaggttttccatccatggaaggtacctgagggattttctcttcctccctagggccagcatcagaggagtgaatagctcagttagctcatctcaggggccatgtgccctcggaggtggtttgccactttcacggttggactgagttggagagaaacagagacccacccaggggtggggacaagctccctgcaactcaggacttgcagatcacttgcccaagtggctccctagctcctggctcctggcccggggcctgggactctccccgaagtggggctggccactgtgaggaaccgactggaggcagggacctcttggatgccccaggcagttgggatgccacttctgataaagcacgtggtggccacagtaggtgcttggttgctccacagcctggcccgagctcagcgctgcagaaagaaagtgaaagggaaaaagaactgcggggaggcggggaggtaggatgaccagcggacgagctgccacagacttgccgcggccccagagctggcgggagggagaggccaccagcagcgcgcgcgggagcccggggaacagcggtaggtgaccaaagtctcctctgtaacccctaaggtcgggctgagaatcgaggctccgagactgtcagctacttgctcaaggtcacacagcaagtctgggaggatggggggatggaatatgcaaaatgtagggccgggaaacacctcgtttccagcatccccgcaacgactctgcgcgggaaccaggagccgggaacccggagcttggcttgctgtgcccagagctccggggccgtgggcgggtggcaggaaagcctggcggcagcttctgcagagaagccggagcgcagactgggagcgcggagcagacacactcccccggccacccttggccgactccgcgcgcccgggatcctgcagaggtgcgcgcccttcttgtacgccagactttggaccagggccgccgttccctgagcttcactttccctgttgggtcatattccatctctaactctggaatcttgggtattgggctctccaggcggggggccctgctcagggaggcagtagggagccaaacctttaaccagaggatgggataagtcctcaactctcgttgaacatcttggcgaaggtgtgtgttgttgggaggggtgggggagggatccccccggactgaaccgatctcttgatctctcacttctctacctcgctttggggccctgagtcacaccctctaaggagagaggctaaagcgccccggaaagccagcgtgcgaatgccggggtgggagtgggagattggatctccctggggtccaggaaagccggaatcggagccaccatgcttagcttagtctggaactcttaaaagccgcggtcctcctgagtcccacagcccctctccaccctaggtggcacaggagaggtggcaaaagcctagaagttcaaggcatggctccctccccagccgcagcctggagtgtctaactttggcaggaagtcttccgtttctgctccccactccagagaaaaaataaataaatacttctccggagtgagattaaggaaacaggtacttcttcctcttggagaaagaggagccaaaggaacttgactccaacaaatgatcaccttgcaaacccccggctcccttaggggatgacctggtctccaacaatctcagagcgtttggaggcagggtctttggagatgactgagtggggaatcccaggctccccacacatgaacatcacctgggatgatcaacctgttcaggatgtaggttcccgggctcacccccaggcccggttggctaggcctggggtgaggctgagatcctgcaggttaaaccatctatcccaggtgactccaatgttcgtttgtggggcaaaagtccctcaagtcagagacactgggaggcgctgatgtggtctcatctctttactctctccctgttacaaaacctctatcagaaaaggagtaccaggaggtgttttgttttgttttgcttaacgccacatagcaagcagtttgcagacgcaggatttgaaccctggtctactgagagcccagcccagtgcagcaagcagatgtgaacctccacaaatgcagggcaggtcccaggcagtcagagagaaacctgttgatacccagtctgtctgatggctggggcttggtttcatgtcctaagacccagcctcagataccttgagaagagcagaatcagaaattaacccaaggaaactctggattagttccaggcaatcagggaagtggctggagggaggtaggaaacttctggacttagcctcagatttgccttgagtcacactgacaagtgacttcccctctctgaggttcatctgtaaaatggataaaacatgagagcttgcttgatgatgtctgatgtgtacagaaaaagcactttagaaaaccaccaaagaatattcatgcattgggaataattattatagatcctaaagggattgtttagaaagatcagagaggggccgggagcagtggttcacacctgtaatcctagcactttgggaggccgaggcgggtggattgcttgaggccaggagttcaagaccagcctgggcaacctggagaaaccccaactctactaaaacacttttttgtgttttagccgggcatggtggtgcacacctgtaatctcaactacttgggaggctgaggcacgagaatcacttgaacccaagaggcggagtttacccgagaggtggaggttacccgagagctgagattgcaccactgcacgccagcctgggcaacagagcaagactgtctcaggaaaaaaaaaagagagagaaaaaagtcagagaggaaagcataggcagatgggaggtttccaaagaccaagacacacacagtcaaaagacagttcagaaaggggcattagttaccaccgattctcataggaaggacatagatagttttcagattccttcaatccttctgacatcaaggacaaagtctctgattttccctgatgtttgacagtgccctaatgcttgctaagatttctttttaacaaagtggtaaagaagctgagattattttagtaacattgtttctttttcaaccacaagtgatactgttggtttggttttgcttttccgtttatacatggaaaaaaaagttttctttttgtaaaatcatggtaaaatacatataacataaaatttaccattttaaccactttcaaatgtacatttcagtggcattaaatatttcaaactgttgtgcaacctccgctaccatccatctccagaactttttcatcctcccaaactgaaactctacccaataagcaataactccccactgccccttccacccagctcgtggtaactccaacttcctgtctctatgttttgggctactctagacaccgcctataaatagaattacgtgatatttgtctttttgtgcctggcttctttcacttagcataatgtcttccaggttcatccatgtcgtgccatgtgtaattcctttctatggcggaatagtattctaatatgtggatatcccatattttgttcatccattcatttgttgatagacacttgggttgttcctacctcttgactattgtgaataatcttgctaggtacatgggtggacaaatatctgtctgactccccgctttcaactctagaaagctttcttttaaaatcggtctatttaagtttctttaaaaagttaatttaagaaaaatactaaggtaaattgtagaacaggtgatatgtcaatatgaccccaaaaattgtaaagatggaagacgaatgcctgcagtttgggaaaccggatgagaggaaagacctggaagctattgtaaaatctatgctgagggtctggtgactactagaccaagggcatggcagcagagggcagctgaaagacttcaggaaggaaagatataagaattaagaaaggggcctggtgcagtggctcatgcctgtaattccatcaccttgggaggtcaaggcaggatgatggcttgagaccaggagttcaagaccagcctgggcaacagagcaagacctttttttaggaaaaaaatatataaattaataaaaataaatttttgaaaatacagattccaggccgggcatggtggctcacacctgtaaccccagcactttgggaggctgaggccggtggatcacctgggatcaggagttcgagaccagcctgggcaacatggtgaaacaccgtctctcctaaaaatacaaaattagccgggtgtagtggtgcatgcctgtaatcccagctactcggtaggctggtggaggagaatcgcctgaacccaggaggcggagattgcggtgagccgagatcacaccattgcactccagcctgggcaacaagagtgaaactccgtctcaaaaaaaatgaaagaaaatacagattcctgggcccggctgcagactccctgaatagaatcactgggggtgaggcccaggacgctgtgtttttaacacccttcccaggtaattctcactcacagccaagcctgccgatggctggactccgtagtcagatctcagcaagcaggactggctcgtggttcatcttggggtctccagcacccagcagagtgctggcggggggactgtgttaagtagagccggatgggtcaggactggagtgtggggcctggctttgctaactgcagtcacaagatcctcatcactccaccccctaccccagcaccagggtcaggttcccttccaggaaaaacttgttggactcctttccaggtcattgactgcagttaggagtggcatgcagaagggaggctatctggagctgggacagaccaggcaagcggggaagggaactcttatcccaaccctgcattctggacagggaccgaaggtctcctggctgcagctcatacagctcatcttcattctcatcctgggaccaccaggcccctcacccacaataactttaccctttactggcaaatgcacaagctggagatgatggcccattcgagttttaagattttccaagttgttatgaggtcagtgtcctcaatcgggacccagagaagataggtggcttgcctgaactttcagagggggcatctgtggtgtcttttgtggggtcctgtaggatttccacgtccctcttggaggaaaaatagaagtaagttgtctcaggtcagattgtctgggaagccaagtaggagatggagatttgcatataggaggtttactggggacattcacaggagggaacacccgaaggaaaagggaagaaagcagggttgggaagcagcaggagttgaggtgcaatgcagtcacaacagaggtcttagccaatcccatagggagcactcaagctgggacagcaaggaagctagaccttcacatccctcatctacctccgtcctcccatacaggcatagcctcccccatgatgaacactcagcaccagactgatacatttgttataatcaatgaacctacattgatgcatcattattacccaaggtccatggtttgtttacatgagggtttactcttggtgttgtacattctgtgggtttggacagatacatgatgtaatgtatatgacattatagtatcacacagactcatttcacttgtgactgagcttgtccttctttctttaacctgcctccaactgctgagaagccctttggctagggattgcagccaattttaatttgttttccactttcctgctctgaagttactttgtttgccagaggctggttggttcaaacccaaagggcagggagctgcaatggaaatccattcaacggtgctggaattgggatggcaaaaaggagcagcaggcaggtgtcagcagggagcagctctttgcatcccacagttcccagggagcttaccattctttcattcattcattcatcctttcatttatgagacaaagtctcactctgttgcccaggttggagtgcagtggcacagtcattgctcactgcagcctcaagctcctgagctcaagccatcctcctgcctcagcctcccaagtagccgagactacaagggcactccaccacacccagctaatttttgtatcttttatttctgaagagatggggtttcactatgttgcccaggctggtctcaaactcctggcctcaagtcatcctccctcctcagcctcccaaagtgctgggattacaggtgtgatctcagacagcttacctcttaatcacctttccatctgagctggcagcagagctgggaaagtgcacccaacaccccagatgctgcaactttagtgcttcctgctccttctctgtgtggaactggcctgtttgggtacccagggccagtcccctccaagaccctctgtagaaaaagaccctactgtacacctcaattccattgcaggacaggacataattgaatcctgcctctccctgccccagtcacccatccctcccaagccattatcttgggacctgcaagggcctccaagccaagggtggcaaatccaaataccaaaggggccataatgatgtaaaatgtgtccaggcagaaggcaatagggagtagtggggcctctggtaacaattgtgtgtactctatatagagacattgtgatggtgatttagacacacacacacttatattggcttgggaaacaaaacaaataggcctatcgactggattcaacttttgattttgcagccaagcccctgtggcacagctgaggagcttgcaggtcagaaaggggatttagagccaaccaatagcaatatctccagacctctcctgacacgaagctcatctgacctcctgcccccattacacacatacacatgcacacacatgcatgcaggcacatgcacgcacgtcttctagtctccctgccttgaggacaaatgatcagatcctgcaactgtttccaggcccataagcccctgagcattgcagtgttgctacatgccttagtttcctctccgtctcctgtgacctcctcgtgccactccaggaagtgaaagtcttgagtgagaccagtagtttctcttaagtcctctctctgtctcgttctcctgggatatctacacttggtttgcaaacagcaggctggagagtgaggggcttcttcctctacatccagctcctcccccatcctgctccaagtccagcatgttcctatctcttccccaggaccctgggctcttgggcacaaatcaagccatcaccagacagcctgtggggtggcaagagcagaggtttgtttctttgtgaacatctataggtaccaggctctgtgcaggccctattgttggtgagccatagaggtaccaacctcaccccatgaatcctcctttgtttcttttcttttcaacccctgggcctttaaaccttcgattaactgcccagtgcagcccaggtcatggtacactatgatctttggttcacatgagggttttctcttcattaatgtccctatttcccatactgggtgcccattctaatgcatttcaggtgtatctttctgtttgtatgtgctcttataaaacatgttttgccttttttttttttttttagatggagtctcactctgtcacccaggctgagttttctatttttagtagagatggggttttaccaccttggccaggctggtctcaaactcctgacctcaggtgatccacccgcctcggcctcccaaagtgctggaattacaggtgcgagtcaccacgcctggccacagtttcttacttttgcattctgtactatgtttttaggatctacttgccttgcttctgatgcatttgatctttgcttctaatcacggacattgttctctatggagtgcaggggttacttttcacctgtccacacccccagtgatggacacctaggtgacctccaactctctgtcaccacaaataacacagcagtaaccatcctcagatgggttctcctggggagttgtgggaacatttcttcaggatatatagacccaagagctgaattgccaggtggtaggatctacatatccttagatattctacatgatgccaggtcgttctccagagcggccccatccatctacattcccacaaacccgtgtaaccaacacttggcatttcccagatgtctaacttttgccagttgtacagtatcaagtgtcactttgctgttttatttttggagtttacatcttagtaccacttactcgctaagtcactttaggtaagtcacaacaacccagtgacataagcactgtgccaacaaaatgcagtcgattctgtgactcagagaggttgagtaacatttgcaaagtcacacagcaagtgtggaactaagatttgaacccagagcctgcacccttaaccactatgctattattatgttttgtctctctcctaaaatatcatctgggtctacattgcaagcctctttggcagggactgtgtggtaaacctctttggggccagtaaggaactgagctcagtgactttcttacggggtgctcagtgaatcattgttttacagctttagaggggaaaagtgagagatgtttcttagagtttatctggaggactacagggtgcatgagcaaaagcggaactcatttgagctactacccccacaaagaagctgtttggggtctggtcatggtagataggcattcctaggcccctggcttcccaacaccatttggcccccggaagcagcttgtcatgaggttggggagcaggttggtgttggggggggccttgggggaaaggaaaaggagaagactgccaggcaacgaggaatcagaatctcaaaaagactcaattgaaggggctccaacactcgttgaaacggaggctcagagggctaaggtaatgtactcaggatcaaaggcagagcagaaactcaaaccatgtctctaggcacacagttcagaggtcttcccattattcctcaggaggagaagttcatggtcaagagtagggaagtattccttctcaagctttttttttttttgtctgagacagagtcttgctctgtcaccgaggctggagtgcagtggcgtgatctcggctcactgcaacctccgcctcccaggttcaagcaattttcctgcctcagcctcccaagtagctgggattataggcacccaccaccacgcccagctcatttttgtatttttgcagagacggggtttcaccatgctggtcaggctggtcttgaactcctgacctcaagtaatccgccagcctcggcctctcaaagtgctaggattataggcgtgagccaccacccctggcctccttctcatgctctttaatcacagttcagagcagtgctggaggcttttaggggtagcaaaagagccttcttctccctttcagtgcctccttagaccctcaaagatagactccccgcctctgggaagaaaacatctaatgaactggacgtaatctcagcgcctgcgtctgtaaaatggctataataacaacaatctcccagagttgccgttaacagttgaaacagaatagtaaatgcaaggcatctagcacagccccagacacagagaaatctcccctggtcactctcacagaggtaagaagcacattaataataaaaatggtcatcacgcatattgtactcaccatgcagaagttgtgctgccttaagctactgttcattgagcacttactggtcgccagtcccctttctaagggctccatgcaacttaactcccctaatcctatgagttgccaattattatcccccactttacagataaggaaactgaggctccaagtggtttaaaaaatgaacttacccagattgtagtgcgttggtaggtagggataacctgaaagttgggaaatttcaccccaaagctcaccatctgagctccattcatctcccaccagctgagatggaacgttatgctgttcccagaagagatgcatgcactgatcttcagatagtttaagtctgagttagaacattgtggcgacacctgatttccctcgggggagagagaggtgaattgttatttcagacacctgtttagtgtctacacttagcctttcaaatcctgcatgcagtgtgaagtggggatgaaaataaaccccaaaaaggacttttgatggcaaaaagatcaggaatattttctcgagttggatgtggaaggtggtggcccagggggaagcacagtttcaaagaggaccttctaaaaatactgcccatttaccaaaaagacacagaccgcgcctctgccctgcccccacatggctcctcaaaaggagaaattgtcttgccacccacgccttccctcgccggggtgctggggggccaacagcaattcaaaaaggctatagagtgggctgagactttggagatgggtagtttggttcaaatctcagcccactaatccctctgagcctgtctcttcatctgaaaaacaggaatacaaatagctgatgtgtaagttagaccaaatggggtaatgcctacgagtcatgtcatttggtacctggcacttgctggacactgtgaattctagttctatatcattgccacggatgaagagaggctgccatgcgcagaaacatgctgagagctgggagaaggtgagctagagggatacagtccctgccctcagggagagctgaagggctctctctcctgccacgggatgatcagggccatcttttccctccatcccgctctggcaatgtggtttggagaaacagtccaatgaaggggcctttgaagcacttcctaagcatctatagacataggaaacttggctctggggatagaggaaggtcccatgccaagattcaagtagatcttggtgtgactgggaggcagctgtggcgttgtggggaaacctagagtcttgggcctgaatttcagctttgacaccctctaatgtaatgggcttcctttgactgtaggcttcccacatagctggcaccccacacagaactcccttggccttctgatgatcctgcaggacaatcttttttgttttttgttttttgttttttttttgagatggtatctcactttgtcgcccaggctggagtgcagtggcgcagtcttggttcactgcagcctctgcctcccaggttcaagcgattctcctgcctcagcctcccaagtagctgggattacagaagcacgccaccatgcctggctaattttgtatttttagtagagacgggatttcaccatgttgcccgggctggtctcaaactcctgacctcaagtgatctgcctgcctcggcctcccacagtggtgggctgcaaggcaatcttcattctccagaactaatattgggaaaactgatgttcagagaggtcaagtgacttggctaaggcatcacagccagaattcagatgcaagctcctaaaccacatgaccttggacaagccatttcactgaggcgtgtgaacctcctctaagctcaaatgggcataacactctaccctgccttttccccagagctttttgggaactcagatggtgtggaggatggaggcagaagtccactgtgagctgcaaatccttgatcacccaagaggaagtgcttaaggtgcaggcttcagtcttagggaagcaggaagtggggcgctgaaatgtgtattgggggcttctgggagggggtttcttcttgtccaggttgagccaatgacgcagatcttaggccctctggtgactttttgcccaggcaacttctcagtggtggtgatggggagcgtggccagaccatccaagctgccctgctggctgtgggggccttttttttttttctgagacacagtctggctctatcacccaggctggagtgcagtggtgcaatctcagttcactgcagccttgacacctccccaggctcaagctatcctcccacctcagcctcctgagtagctggttctacagatgcacatcaccacgcccagctaagttttgtgttatttgtagagatagggcttcaccatgttgcccaggctggtctcaaactcctggactgaggtgatactcctgccttggactcccaaagtgctggaatttctacagatgtgagccaccatgcccggcctatggggcccttcttgttcctatgaagtctgcagggtccccttatgcaaaagaacagaaagctcggcttcacaaagtttgacctcggaagaaatggaagggaaagggtccctttgtcactctcacaaacgtaagaagcaaactaataatgatggccatcacacatattatactcaccatgtagaagctgtgctgccttaaacttctgttcattcagcacttactgattgccagtcccattgctaagggctccgcgtgacttaactcccctaatccttgtgagttgccaattattattcgcattttatagatatggaaactgaggctccaagtggtttaaaaaatgaacttgcccaggttacagtgtgttggtaggtaggggtagtctcaaagttggtaaattttacgccaaagctcacgatacttgccttctttcccttctcaatttatttctctgactgtgtgcttaaccacacagcagtgtcatccagagtttgaagcagagctcatcaataagtgggggtgggctaaatgtctccaggctcctccctgcggtccctcccaccatcccccatctgtgataccacctgtgtctctatgcttgagcccagacaggacaagggtgatcatttcattgggaacattttgactggggggaaagagcaccagcctgggagtcttggcagggggagtgggggagaaggggcaggggcagccaccgacaggctatgaggtcttgtgcaagtcacgtccttcccggggtctcagtcttgtcatctgcagagtgaaggaaagaggtcaagcttgaaggtccctggcagacccaatgccctgtgagaaaactgagtttgggtaacttattattttatagatatggaattatcttatagaaatgttatagatatggaatcattttatagatatggcccaaagtccaaagtcacacaactcattcacggagttgctaggatcagtctggagctcttgtcacgagatcacactgcctcaaagaggaggcagattgctgcaatgtaggttcttaataaagagcatgggtggaatgggaggcgggcatcaggcaggagctggggcaaaggtgtcttttctcactgctctgagagaacagattttgtgcctgtgtccctgaccaaggggctgggagaggtggagcatctcacccccaaccatctcccagctttggccctgctccaggaaaagggcggtggccccatctttcagttctgcttcctctagtcatggttggctgggatctcgctgcaagccggttatgtttgggttcctgcagcccccgctcaaccgtcatgaacaagtgggcccagccagtgccccagcttggactggaaagatcattctctgtgacatccgggggtctgtgctgagcctctccccaggcagtgaaagctgtggatgcgtgaaagaaaatgggtctctgggccgggtgtggtggctcacacctgtaatcccagcactttgggaggccaaggcgggtggatcacctgaggtcgggagttcgaaaccagcctgaccaacatggtgaaaccccatctttactaaaaataaaaaaattagccaggcatggtggcgggtgcctgtaatgccagctacttgggaggttgaagcaggagaattgcttgaatccgggaggcagaggttgcagtgagccaagattgcaccactgcactccagcctgggcgacagagtgagactctgtctcaaaaaaaaaaagaaaaagaaaatgagtctcaggaatggggtggcaagttgagtgtgtgttttctcatgagcttactcttcaatgtattctcttctgggcccagaacagggcagtaggagcctccctctggtcttccagcttcagggccagctctcctcttacctcctccaggaagctccctctgtttctttccagccttcatctgcatgtcatgtgtggtgggttgaaaggtggccccccaaaagatatgtccatgtcaaatccctggaacctgtcagtgtgactttatttgggaaaagggtctttgcagatagaattaagttaaggggctgggtgcagtggctcatgcctgtaatcccagcactttgggaagctgagattggaggatcacctgaggtcaggagttcaagaccagcgtggccaacatggcaaaaccccatttctactaaaaatacaaaaattagctggtcatggtggtgagcacctgtaatcccagctactcaggagactggggcaggagaatcgcttgaactgggaggtggaggttgcagtgagccgatacagcgccactgcattccagcctgggcaacagagcaagcctctgtctcaaaagaaggcaaaaaaagaattaaagatcttgaaatgacatcatcctggattatctaggtgggtcctaaatccaatgacaagtgtctttataagagaaagagacttgctacatgaggagtaggtgatgtggccactaaagctgagtttagagtgatgcagccacaagaccacaagtcaaggatcaccagtagttcccagcagctagaggaggcaaggaagcattctcccctcgagcctccagaggcagcgtggccctgctgacaccttggcttcaacttctggcctccagaaccatgagagaataaagtgctgttgttctgagctacctggatgctggtaccttgtttcagcagccctgggaaatgaatataccatggaaacatggacctgaaccacggatcctggcaggagccttagagccacacagatgagccttcagcttggctttccccagcaagagctacatgatcttgaggaagctgcttgtcttctctgggtctcaagttcttcatctgccaatggagacaataatgcttacttcctaggttttaacagctttattgagatgtaattcacatatacaatttgcccacttaaaaagtacagttcatgcctgtaatcccaacactttgggaggccgaggagacaggcggatcacttgaggtcaggagtttgagaacagcctggccaaaatggtgaaacactgtctctactaaaaatgcaaaaattagccgggtgtggtggtgggtgcctgtaatcccagctgctcaggaggctgaggcagaagaatggcttgaacctgggaggcagacgttgcagtgagccaagattgcacccctgcactccagcctgggtgacagagactccgtcttaaaaaaaaaaaaaaaaaaaaaaaaaaaaaagtagagttcagtgttcttttgggaatactcagagagttgtgtgaccatctcccatccccacagtcaattttagcacatttcatcaccccctaaagaaactccagacccatcagcagttgttccccatttccttccaaaatccctctctgccaagccctaggcaaccactaatatgctttctttcttaaaaaaaaattaatagagataggcttttgctatgttgcccaggctggtcttgaacacctgggctcaagcgattctcctgtctcagcctcccaaagtgctgggatttcaggcatgagccaccacgccccacccctcctactttatgtctccatggatttgcctgttttggtcatttcaaataaatagaatcatacaatatgtgaccctttgtgtccggcttcttcacttagcattttttttaaggttcatccatgttccagcatgtatcagtgctttctccctttaatggtggaatactttattgtatagataagcaacattttgtttatccatttattttttggtggatatttgggctgtttttatattttggctattttgaattatccttctgtgaacattcgtgtataggtttttgtgtggatatatctggtttttcttgttttcttttgttttattaatacataatatgatacatatttatggggtatatgtgaatatttattacatgcatagaaggtataatgatcatgtcaggatatttgaggtatccacatttgggattgtttaaagattaaatgaaatagtgttaaaagtatttaatatgcccttcaacaaatgatgaggaaatcttagaatctgctcagactccttcagtttacatattaggaaactgaggcacagaaaggagcagagacttgctcaagtccacccaaagcagtagagcattgtggttaaatgcaggacttcagtcagactgtctgggttcaaatcctggttccacttggacatgggtttccttacataaatcacttcacctctctgagcctcagttttctcatatgcaaagtgaggataataataataccttccttacatggttactgatatgagtattaaatgtgccagctcatgtgcctggcgtataggaggtgctttataaaccttagctgttaccactcatggcattgccaaatgtgggacgggtctcctgactctctggtgtgagattgatggaatccacactttccagttcccttttctacctcctgggtatcttctcatatggttgtaagttccttggaggaagggaatgtggcttgctctctccaccacgctgagcatataagaggtgctgaatgagcgcttttattcactcctctcatccccagccctcaccagctgggagttgttgtaggtgtcaattttctgcctctttccaacaccctgtgaggtgactgagcattgtcttccctcccaggcagctcacagtgtgccaccatggagttggggcccctagaaggtggctacctggagcttcttaacagcgatgctgaccccctgtgcctctaccacttctatgaccagatggacctggctggagaagaagagattgagctctactcaggtgggccctcctccctctggtctcttccggtatcccccacccctcagcttgctgtagagacggcaatcaggggaaattctggtccctgccctcccgtcagcaccacggacagctcccacgtctgtgggacgctctctgcagatggggatgatctcccagccctgccccgcctctccctcgttccccaccagccctctttccagaaatttccttcttcatccaagggacttttcctcccagaacccgacacagacaccatcaactgcgaccagttcagcaggctgttgtgtgacatggaaggtgatgaagagaccagggaggcttatgccaatatcggtgaggaagcacctgagcccagaaaaggacaatcaagggcaagagttctttgctgccacttgtcaatatcacccattcatcatgagccacgtcagtcccctcccacagaaatcattgcaagggggatgcggagcaatggctggaggaacggagactccagggaagagaggggagatggaggccagtgggggaaataggccccttcactaatgaccaccaagaaaacaaaatctcatgtttacatcctccacctccatttctatacgcatttctgcttcttgctcttctgtccatcctttctacaaagcccataccatacacccctttcccttttcctcccagctccttagccaagctactctagtatttgtaataactagcatttactggatactcatagtatgctcattgctgtccatacattatcatctggaatccttacaacaacaaaggaaatacatattattagtttctgtcttttacaaatgaggaaattgaggtttagagaggtgaaacgacctacccaagtttgcattagagatagtaatgtacagatctgaaattctaacctaggtctttctcgtttcaaagtctccatttttaaccacaaaaaaagaaagtgtctggggttggaagatttgctaaggcttaagcagagaagctaatttgtagccttaagaagagctacagctttcagacaagggcaggactcttggggagaggtggtggtggtgttgctgctagtggtttgttttttgggggagagacgtgggatagagaatctcttctcaccagcatcaccaccacctcatacagagcctatgttgaaatagaaaaaagtggcctttttctggaggatgcagcccctaccaggaagtaactgcttggctagcaaagtgcaagccggagtcctgcccccattttccttgttggcttgggcacctgtgtgcagtgaacaacctgcaaaactcttcttagtggtcttcttcctgccaacccaggaacagcagcattcagcagttctgtgcttgatccaaatgtggccaatttttccccagagcacagtgtattgaaaatcataccaaggaagaaaatggaggggactagtaattgttcatgtttcagaaattacagaactgagagcttgactgcttccttcccttcctggggatttacatgggggaagcagaagtgattggggctgaggacattcacatttcctcacaactggaggcagtcattaaggatttgggcatgtcataggatttgggtgtttttctccccccttagtggcatctccacaggcagcgaaagctgtctaagcaaataggtgaggcagtgcgttagtccattttttgttgcttaaaacaacatacctgacactgagtaatttataaagaaaaaaaatatttcttacagttatggaggctgagaagtccaaggttaggggctgcatctggtgagggccttcttactggtgaggactctctgcagagtcccaaggcagtgtggggcatcacgaggcaagaggtttcggtgtgatagtctctcttcctcttctcataaaaccactagtcttactcccacgacaacccattaacttattaacctgtttatccactaatccatgaacggattaacccattcatcaaggaaaagccccagtcacctcttaaaggccccacctctcaatactgccacataggggattacatttatacatgagttttggagaagacaaacattcacgtcataacaggcagcttcacccaagtctgctcctcaagtctgtgggttttctctctgcttctggaaggtgaagcccaggcctgggcaagtattcttttgcagcatcctgaaatatgaccttagcttctaaatgtgtaaaatggagataataatcacacccaccatcacgggatggttgtaagactgaataagttacaatgtgtaaagcatttagaaaaggaatttgcacagagtaagcattcagtagatgttaggtactaccccacaaccaccgttatcattattatcaccatcattattatcatcttcattttcatcaccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttccaggatcccttcctccaggaagccttccctgattgccctattccaccatacaccttttttctcggacttcatgtcatggtgcctatattccaagggctctgagccatgtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataagtagcccaagattgcacagctagtagggctagtggaaagtagaggtggaatttgaactcaaatcctgcagtaactctaccattctgccttgctcttctttgtagcagtagataagttttcatggatacatacctcatccttttgattagattaagggcccctggagtgtcagtgttcattcatttgtttgatcattcattcattcaacaaacatttcttgagtccccactgtgtgccaggcccagaggttccccagcccaaggcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctgcatttcctgccttgttccctggggggtgccctaatacctgacgaccattcattgatgggcagtcagacccctctccccaaggtgggtacaatagagactcaccttgggctttcattgattgtgtgagttggtctctggtttttctcaaagtagagcacataggaccagatgaagtgatcggtgagagtatggagatgccagcagaagttgggcagaaaagtcagaaaagacgtgagtgagcccctccctgatccaacctagccttgcttgagacctggcctttccttgactccaaagcctgctgtgggtccaacttgcttccctcgctaagtcctgtctggttgggaggccctttaaaagccaacaggagccttaaaatgtacatctgattatttcatggccctgataaccctccaatggctacaaaatacatgccacaaggcctgtatggcccttcctccctctccaaacccactatgagacaccacacttcagccaccaccagcttctccactcctataacccatgtgccctttcaagcctcggggcctttgcagttgctatagtctctatctggaatgcccttcccccagttcttcccatggctgactcctttgaatctttctggtgttggctaaactgtcacctcttcctggaacccttctctgaccatccttccatgtagattagctcagttattctcaccttgtgtgtctttttccttgcagtttagcactcattaccatctggacatattttacgccttgctctcccactgtgaggacagggaccttgtctttcttgctcgtgactgtttccccagcatctagtgcagtgcctggtatgcagtagcacctcagtagatatctgttgaatgaaaacatctgtaaaatgggtgtaacagttaactgagtacttattatgggtctgaccatgtgtaagtcctgtatctatttattcagttcttaaacaggtgaatcgcacacagggtatgagattttaaaagtgcaaagaatattcagtgaaggctgggcgcagcggctcacacctgtaatcccagcagtttgggaggccaagggggacggatcacttgaggtcaggagtttgatacctgcctggccaacatggtgaaaccgcgtctctaccaaaaaatacaaaaattagccgggtgtggtggtgcacgcctgtaatcccagctactcgggaggctgaggcaggagaatcgcttgaacccaggaggtggaggttgcagtgagctaagatcacgccactgcactccagcctgggtggcagagtaagactctgtctcaaacaacaacaaccaaaagaatattcagtgaaaaaaaaatctccctcccactcctgttctgtagtccctcagttttgctcctatcttagtcaacctatgtgaccagcttcctttttgccttgtcagaaataaagcgagctcctgtatttgctttaattttccatgcaaatgaccacattttatttacactattctgcattttgctttcttcatttacttcattactccctgtctgggaggtcacgttccatattattgagggagaggacacggtcctatcttcagcagcttctttattttctttcttttcttgtttttcttctttatgttttcatttgataaatatttccccccaagattttattgtgaaagttttcggccaggcgtggtggctcacatctgtaatcccagcactttgggaggccaaggctggcagatcacctgaggtcaagagtttgagaccagcctggccaacatggtgaaaccccatctctactaaaaatacaaaaattagccaggcgtggtggcgaacacctgtaatcccagctaccagggaggctagggtgggagaatcgcttgaacctaagaagcagaggttgcagtgagccaagattgcgccagtgcactccagcctgggcaacagagctagactctgtttcaaaaaaaaaaaaaaatgttttcaagatacaataaaagtgaaagaatggtactatgaaggtccatatacccaccatgtaccattttgattctacaattaatgttgggttttattcatcttatcacatctctattcatctgtccatccctctatccatccacacacccattcattatatttttggtacatttcaatgtacatttcaaatgtaaattgcagatttacactcccctcgtgtacttcagcatcctttcttttaaggccatgcagtgtttcgttgggtagatgaaccataatttgtttaagcagtcccttgctaagggacacgtgggtttttaatctgttgctgtgagtgcttgatactcactcactgatttctggcatactcctgcaatgtaggaaccaccacccccatttcatagatgtgagatcaaaggttcagagaagctgcattgcaaaggcacacagctaggaagcggttcaaaagcaggttcctttgttttgttttgttttgttttttggctcaaacccatgttgtgtccccatttgtgactcggcctcttctgctgctacactgcctggtatggtttgagatggggtttgggttcaagccaaggagctggggttggaatgttagagcgaggggaggaaaatggacccccaagaccactacccagccttgaagttaaggccgtatagcctgctagagtcctgagccccttctggcttgggacatcctctccctggggcagctgatcacatgttttctctgcagccttcccagaggagcttccggcagacctgaagcactggaagccaggtgtgcagggcaggtgggctggggttgggaagggtggatgccttggggaggggatggaagagattgaactcctggcccaagtctgatggggatggtgcatggtgcagcccctgcccttctttgggtagaggctgagagcttggggtcccttagagtcctctaaggggctcacgactgtttgtggaaggtggtaggggcttggagctaacagattgttcataggttctattctgccccagctctccgtgtggaggccctagggtcctgctcagcatagctctcagagccaagtcacaaggagaggactgggggactgcctggcacagagcagttgctgatcaacacagctgcagccagggctgagaagatgacaagcatttcctctgtcaggagagacatccatgccactccagggccctccccatcccaggaaggcccctccaagcacccagtctctaacacagcccacttcctcacagctgagccccccactgtggtgactggcagtctcctagtgagaccagtgagcgactgctccaccctgccctgcctgccactgcctgcgctgttcaaccaggagccagcctccggccagatgcgcctggagaaaaccgaccagattcccagtatgttagggggcttggagagagtgggctttctccctcttgggaggtggataaggagttgacactaaggcagggactgtcaggaactggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagccccttctctgtgccaactgctctgctaggtgctaagaattccatcagggcaggacagaaacagctactgctcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccgaccacctctccctcctacctgactgctccctgacctcatcctccccatactccatgcacttggcagtggtgccctagcaccttctcatgatcctccctccccagcacaactttctctgtccctatttcccaaaaatcaaagcagaagagcagagattcctgaggtggtctgggtgcatgaccaagagtggttgtgtggccttccatatgttgctttccccttctgacccttagtttttccttattttttttaaatgtttttgtttttaaattgcaacatcaatacatgctcactaataagctaatgacaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgaggggttgtgacttgtctcagggaaggtgtgtttgggctgtcagggatgagaccaggaggatgcttccactcaagtccagagcatccattcctggttgcaagacagtttcagtataacgcactggtatctcagaagcagagaagcagttcctgatatctaggaaaatgagcactgaccacacagcaggaagagtgcaatagtagtacctgccctaagttccttatgagctaattgcacccatttcacagattggaaaagcaaggttccaggagctagatgtaactccagagctctttcttcagctctgtcctgaaatatcttcctttggaagttctactctcttctctccagacttcctgagctccacagcccagtttggagtaggggtgacccaagtgcatttctggaatcaatacctggttattctcacaccactctccacccccaatgtaggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacaggtaaggacccttagggcctgtgagaggtactagaagcaggatcgaggccctggggaaggaattgtctcaaataagatccacaagcaaagctgcctgtagggacaacaggtcatgtttaggggtcagtcgggacagggagggtctccagggagtggaggcatggttgtgggggaatggacagctagagaatccacatcccatccaaatacagccatcagccttcagctgcttgttacccagcagaaaagccagacaatgtggtcagatcttttgaagttgaaaaccctgatttttacatagatattgtgattttttaatttttattttattatttatttattgttgagatggagtctcactctgttgcccaggctagagtgcagtggtgcgatctcagatcactgcaacctccgccctacaggttcaagtgattctcctgcctcagcctccggagcagctggaattacaggtgtgcaccgtcacacccagccaatttttgtaatttcagtagagacaagtttaaccatgttggccaggctggtctcgaactcctgatctcaagtgatccacctgcctcgacctcccaaagtgctgggattacaggtgtgagccactgcacccagcctgatattgcgattttcttttttaaacatgagtgaaatttttaaaagtacagttggccaaagaaagacatatttgagttagatacagcctcaggccgctatcttataacctccatcttgggaaactcagcccatgaaggctgtaaggactaagtggcccagagggaggggggtccccaggggtaaccctcaccctaaatctggcacctgcttctccatctccagagcacaagacgtcccccacccaatgcccggcagctggagaggtctccaacaagcttccaaaatggcctggtgagtgatgcgggatctctctgccctgggtggtggagatggaagcccatatctggcttcacattgctcattcacttgacacttattcaaccccttctttgttggctcacacactcatttatttattcattcattcattcattcacttatttgattatgccatcatttcaccattcactccaccactccctcaaataatatttattgcccttcaataagcctgcactgggtgttaacacttcattgtcaggctgagagaatgaatgaggggcaagcgaatgatgaagtgagtgagtggatgaagtgagaagttgatgaggatgggagcaatggaaagtgggaataaaccagtgaataagagaattactaaattactaaatgcttactctcacatactggtctaagcatgttaggtatgctaaatcattaacatctcacacaatcccaatattatccccattttccagatgaggctactgaggcatggtgggatgtatagcatgctcagaattgctccagcaagtggtagaaccgggatttgaacccagacacgtgggctccactgtcttaactcttaacactccctcccatgacctccccatggtgagtgagtagtgatcaagcgaagaaaaagcttagtgagtaaatgaaggaatgagaaaagatggccatgcatggtgccttatgcctgtaatcccagcactttgggaggccaaggcaggtggatcacctgaggtcaggagttcgagaccagcctggccaacatagtgaaaccccgtctccattaaaaaatacaaaaattagccagacgtggtagtgggtgcctgtaatcccagctacttggcaggccgaggcaggagaatcgcctaaacccaggaggtggaggttgccgtgagctgagattgcgccagtgcactccagcctggggcacagggcaggatccatctcaaaaaaaaaaaagagagaaaaggtctaaaaggagtggacacttaaacaagagagacgatgagtgaaggaatgggtgtggaaatgagtgaactaatgaatgagtggtgggtgactgaatgaagcaaatgatgaagactgtatgggggccagatgtggtggctcacacctgtaatcccagcactttgggaggccaaggcggaacgattgcttgagcccaggagctcaagaccagcctgggcaaaatagtgagaacttatctccacaaaaaaacaaaaaagaaaaattagccaggcatggcagtgggcgcctgtagtcccagctactcaggaggctgaggtgggaggattgcttgagcctgtgaggttgaagctgtggtggaccatgattgtgccattgcacgccagcctgggcgacatagtgagaccccatctctacaaaaaaatcaaaaaattatctgggcatggtgtcacatgtctgtggtcccagctacttgggaggtggagtcaggaggatcgcatgagcccaggaggttgaggttgcagcgagctgtgatcacaccactgcattccagcctgggcaaaaaagccagaccctgtctcaaaacaaaacaaaacaaacaaacaaaaaaactgtgtggggaacagatgtaaatgatggtggcagtgctggccttgtggtggctggccctggccctgcctctcacatacccccaccctgacacgcccctggcctttgcagagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggggaagagacatccttgtgttgggcattaactgcggtcttggtgccaagcccagtgctctgtggggtctcttttagtatgcagagcagccgggtggggcagaatggattctctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaaggtcctacataattgtgccaataatttagcagtgagcttcctggtagccgaagcaaaaagggaaagaaaaccactgtgtgagttgtgagaaagtaggaatcaataaaggctggagtggtcatggaaggctttctgggaaaggtagaggttgagctaaggaaagaaagtattttaataggtaggaggacccttcatggagctgcccttccattaaggtctagcctggtcaccgtgcctgggtctgaggccctccctccacagggctgccttgagcgacacggtggcgctgtgggagtccctgcagcagcatggggagaccaagctacttcaggcagcagaggagaagttcaccatcgagcctttcaaagccaagtccctgaaggatgtggaagacctgggaaagcttgtgcagactcagaggtgagaggagaggcggatgggaggtggttcacgccatgcaggttgaggacatgtaggacccattctcaagtttgtcatgggcatttccagtgccccctgtcctctgggacaccccatgccctctttctgggcaatggctaaccagagtctctcactgcactcgctgcccaggcggagcctctagaattgaaaactttgctgcattcaaaacctgccatcatgtgcccaagtcttagctaaagccatggagaacctctccccttctaggagttaacaaggatgccttgtgcacctagtaacagaagtgacacctactgccaccctttgaggcatttaggacaactgttgtcccaaatttatagacggcagagctaaggtccagaaggcagacaaaacttgattacagaacaagttaactgtctttcattcattccttcatcacacattgtttgagcgcctcttaagtgctgtctgggataggtactggtaagtgcctaatctgaggctcatttccatgaaagatacagtcctgagatcttttatttttatttttattatttcttaaagacagggtctcgctgtgtctaccaggctagaatacagtagtgcgatcatagcttactgtagcttcggaactcctgagctcaagcgatcctcctgcctcagcctcccaagtagctgggattataggtgcacgtcatcacaccggatgattttttaagtttttgtagacacagggatcttgctatgttgcccaggctggtcttgaactcctggcctcaagcaatcctcctgcctcagcctcccaaagtgctgggactacagtcacgaggcaccgcacccagacagatctttttttttaagagggggacaacagttgccccaaggaaagcaatccccctggggaatttggggcactggggcagccatcatgggacccatgggtaagggctcagtgacagcagtgcctgctccccctaacattgcctgttctctccaggacgagaagttcctcggaagacacagctggggagctccctgctgttcgggacctaaagaaactggagtttgcgtaagcaaaggggtggattgtcttgtgggtctgcgcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctggttaacatggtcattcccatcactcattcaacagaggtattgagcacttgaatgactgaggctgctgtcctcatgagctgacagtctaatcaactcccctctggaggaggtcagggggacttcctggaggaggtgatatctgcactgaagcttcagtgaggataaggaatgagctgagtggggagaggggagtaagaaaggctttccaggaattgtaatttcgccagggatcagaaaaggcccaatgtgtccccaaccttccataggaggatgccactatgactatggagtccttttccctcctgtggccaggaactgcacaacgtcccttgtgcctgagcttgtttacttccacagccaagggatggcctccccagggagaatctttcccccattttgaaattcccaggagcttttgatgtgcagctaggatgaaaaagcaaccctacttgcctgggactatcctggtttgaaaactgaaagtcttgcatcccaagaagccccttagtcccaggcaaactgggacagttggttgctctatgtgtggccagggctgggggccacaccctaggcagtgttgctggggtgacagaaatggagacctaggcaaggctctagggagtccagttgtgtctgggtcactgaggaggggcagcccaccatacatgggccccaagaaagcacaataattattatatttagatctgtcagaatatagcttttctttctttctttcctttcttctctctttctttttctttctttcttctttctttctttctctctttctttcctctttctttcctttcccttccttttctttccttccctccctccctccttccttccttccctccctcccttcttcccccttttcttctttttctttctctctgtttctttctttctttctctctctctctcccttccttcctccctccctatctctctctttctttctttctttccttcttttctttctttcctttctctcctttctctttctttctttccattctctttctttctctttccttccctcccttccttctcttccttccttctttttcctttccttttctttccttttcttttctttcttgaggcagagtcttactctgtccctcaggctggagttcagtggcacaatcacagctcaccacagcctcaacctccctaggctcaagtgatcctcccacctcagcctccctagtagctgggactacaggcatgccccacctgactaatttttgtattttttgtagagacaggatttcaccatgttgcccagtctggtctcgagctcctgggctcaagcaatcctcccacctcagcctcccaaagtgctaggattacaggtgcgagctcccgcacctggccagaacaggcttttaaatttgcagctcaccttccatctcaattatctcaggccaccctcctctacaggcattgtcatcatctccccattgtacaaatggcaatgctgagaacaagagactttaaattgtttatccaaagtcataaaggtcaggtcagcctggccctaagctccttccacagaaaaagctaaatgaatgtttgttccttggtaggggtctagatcatctaatgattaggaaggagttgttatgcctgtggtatattcggtgctgtttttttttggagatggggtcttgctctgtcacccaggctagaatgcagtggtatgatcttggctcactgcaatctccacctctcggttcaagcaattttcctgcctcagcctcccgagtagctgggattacaggtgtacaccactacacctggctaatttttgtatttttagtagagacgggctttaaccatgttggccaggctggtcttgaactcctggcctcagatgttcctcccacctcagcctcccaaagtgctgggattacaggtgtaagccaccatgcccagcttataattcagtgcattttatatataatctcattaatctcaagagctactgtggaagacagacagtcatcatcttccccattttacagatgaggagacggaggcctggtgaggttaagtgacttgcccgtggtcccccagctggtcacccacaagctatcagctctccctgatcactgctcccctgtgccccagaaaaaagccagtgtctcttgttttgaacagagacaaggtgctaaatttgtccagaggtaaaaatgatgctgaaaaggggaaatgtctgaaaacaataactgagggccctttctggccttaaattattttcagctgaaaaagcccctagttcaagatcggaactgcgctctggggaacagcggccatggggtggaacagcctagagccgggtgatcagccacctggagaccggaagcccccgaggaggttctgaggaaggaaggaaggaaggaaaagactatttctggcattttctcaggcttctactgtgcccaggcaccctgtagacctcatctgtctgtcaaatcagggttcttagccactcacaaccctacagggacttcgtttgtacacagagtccttccccagttcagtccccactcacctgttcacccttatctcctacactcgctgggtgctctctccattccagccacagggcctccttgctggctttcaacctcctaggcatgcttctgcctccaggcctttgcaccggctgtgccctctgcctggaatacttctccccagatatctgcatggctcatgccttcacctcctctggtctttactcagtgaggccttttcttttctttctttccctgtttctttctttctttctttccctcctttctttctttctttccctttctttctttctttttccttttttctttttctttttttgaggtggagtctcgctctgtcacccaggctggagtgcagtggcacaatctcgactcactgcaacctcctcctcccaagtccaagtgattctcttgcctcagcctcccgagtagctgggactacaggcacatgtcaccacatctggctaattttttgtatttttagtagagacggggtttcaccgtgttagccaggatggtctcaatcttctgacctcgtgatccccccacctcggcctcccaaagtgctgggattacaggcgtgagccaccacacccggcctcagtgaggtcttttctgaccctcacagttaaaaataaaactctggccaggcgcagtggcttatgcctgtaatcccagcactttgggaggccgaggcaggtggatcacaaggccaggagtttgagaccagcctggccaacatagtgaaaccccatctctactaaatatacaaaacaaattagctgggcatggtggcaggtgcctgtagtcacagctacttgggaggctgaggcaggagaatcatttgaaaccgggaggcggaggttgcggtgagctgagatcacgccactgcagtccagcttggatgacagagtgagaccccatctcaaaaataaataaataaataaataaatagaactccattcccctcatggttaaaaaaaaaactccatccccctcaccactgtatatttccatatgattcattgtctcagacatcagcttgctttccgatttctttgattatctgtctatcttcccccctggaatgtcagcacccagaaggcagggattttcgtctgtttggcccacaactttcctccctgggcctggcacatagtaggcaagcggtcaatatttaacaacgaatgccttaatccaagaacccccataagattggggtgaaatatttgaggagatcaagacttaagggtgaagggatttgccaaggcctttagcagggagccaaatgccagatcctggagtcaaactctgatcctgtggccttttgctgaggccagtgttctcagacttcaggatttcagaggccgagaacatttcggaatgaattcgagtgaccgtgcgcggttactgttttttaatgtttatcaaggatgctcattcaaacaaacaaataacaacaaaatacccactgctggcaccataattttaccaaagaatgatcattctaatattgaaaaagttcaaaggacataattgcagaataaaagacagctctttatatggaatgcatttaaccatatttttaaactaaacggcccttcgttgtccttatttttctcatccccttgaagtctgctctaaatgttgatccaggctgtgtgaccctgtgtgagctatttgatcgcctagtgcctcagtttccctatatgtaaaatggagataagagcccatagctcagagtcttgaggagtaaatgagatctaggccgagggaagggcctagcatgcccctggcttataataaatgctcaacaaatggttccttttgttattaaaatgcaaaggcatattagtcaaccacctggtttaccactggcagtggtcgtcagctggcatttcaggaccccttccccaggctgcggcgggagaagggtatctgtggatgttgggaagagtaagaactggctccctacttagagacaaaagctggggagccccaagatgggagcccaacttacctctttttcttttctttttttgttttttttcttttttgagacagggtctcgctcttacccaggctggagtgcagtggtgtgatcatggctcactgcatcctccacctcctgggctcaagcgatgcttccacctcagcctcctaagaagctgagaccacaggacacaccaccacacttggctaattattgtgttttttgtagagactgagtctcactatgttgcccaagctggtcttgaactcctgggctcaagcagtcctcttaccttggcctcccaaaatgctggaattacagacatgagccactgttcccagcctcaactggcctcttatggggggctatgaaatctaccccaagcagaaaagattggggtcctacgtggaagggttgcagggacctaagaggctggggtggaagggaagaggaggggcctcagacaggacctgacttctgtgccttgtctctgccccaccctggggctgaatgaggggctgtgactgtgactggaggtcttacccttgctctttgcctcctaggctgggccctgtctcaggcccccaggctttccccaaactggtgcggatcctcacggccttttcctccctgcagcatctggagtgagtatagactctgggaccccttcctctcaacatctgggtgcagtgctgtgatcatagctcactgcagcctcgaattcctggcctcaagtagtcctcctgcctcagcctcctgagtagctgggaccacaggtgcatgctacagtgcccagcaacctctgggttttgacaaccccaaatcctgcccccaaggcacctgcagaaagaaaagccctcactttgtccctttttttctctcttccgcctactgcatcctcaatgtggctggcacatgagtgatgagatgacgccacatcagatgggaatccccagtgacaaaaaaagttgtagatcctttcgtgacctttgaaactcctttcctcacaacctcatttgctgctctcagcaattcagctggggagggattggggagcatagtcctactttacagtggaggttaaggaagttgccaagcctcaggggcttagttcctaagaagctaaacagggattcaagtccatcatgagttagactttgccctctggctgcctggttggagcccccaggtgatgaagtcctcgtctgaaaagctcaggaatgtgccggctgcctatggtgtattagagctggggggtgggaagggcaggtgccagggctgaggaggccctcactgggatgggaagggtcagatggccccaggacgctagctgatggcccccatctgattccacctgcagcctggatgcgctgagtgagaacaagatcggggacgagggtgtctcgcagctctcagccaccttcccccagctgaagtccttggaaaccctcaagtgagtgagctgggcctgcccttcctgctgaatcgggcccccaaagtccggctgactttttcaaaattaatttaaatttgtttttttagacaagggctcgctgtgtcacccaggctagaatatagtgctatgatcatacctctgcagccttgaactcctggcctcaaggaatctcctcacctccgcttcccaaagtgctgggattataggtgtgacttaccatgcccagccccagtggattcatccattcactcattcacctattcaatcagccattcatccttccattcaatgattcatccattcacttatgcagtcatttctttactccctcatccaaccgctcactcaatcatttctttacttacccaaccatttattaatttaatcaacaaatatttaaggaggacctactatgtgcaggcacctttctaggccctggagacccagctttaaacaaaacaaataaatcccctgacctcaggaatcttaaattctagtgaggagacacaatgaacaagtaaacaagtcggtaattataaagtatacagtaatgaaaataatgtttggtgacagaaaattatactggggggtgaaataggagagatagattaggatttatcaataaagcattattatcaaaacagtaaaactttttaaaaactgttctgggctctgggaagttggagatggataagatacaggaggatcaatgtgattttttttctttttttcagacaaggtctcgctctgtcacccagggtggagtgcagtggtgtaatcatggctcactgcagcctcaatctcctaggctcaagcaatcctcccatctcaaccttctgagtagctgggacaggtgcatgccaccacgtcccgctaatttttgtatttttttgtagagacgtggtttcaccacgttgcccaggctggtcttgaacttctgagctcaagccatcctcctgcctctgcctcccaaagtactgggattacaggcatgagtcactgtgcctggttcaatgggattttttttttttttttttgacacggagtctcgctctgtagcccaggctggagtgcagtggtacgatctatttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttcaacatgattttttactgaacctagaggatatcaaaatcttcccacactccccctcacaaccaaggtcttaggatggccaaataatttaccggaatttacttagcaatttccttaattgtaggactgtgggacttctccagtaatttctagtgtcctaggtaacactgtaagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagtgctgaaaagtggcgcagagggaaaagaggggatgttgtaaagtcatgggacaggtgggggcaggagggtgcactctccctcccatccacctcctcatccctgccctcccacttggccacaggacctaacagtatcctcctatttaccgagaggtagcttaagtctgtcgacagcgccattcacagcctatgacccagaactctccttgaggtcaaagtgaggcatgcaagtttggtcctgagccctccccctcactgtgtccccgcagtctgtcccagaacaacatcactgacctgggtgcctacaaactcgccgaggccctgccttcgctcgctgcatccctgctcaggctaaggtgagtggggccccggataccggtcaggtgctgagctggggggctgcagagcgcagggaacccacatcgtgctggctgcaggggacactgagaccctagaagcaatcaccacagccctgaacaaaaggattagcgggacgtggtgaaagaaactctgagcaagtcagttattcattcctagccgctgttttcttacctggaaaatgggaaccatcctaatggtctatgtaagcacttgtcacaatgccaggttctgttatgcaataaatattgctccttttcccccagggatggcgggaccaggctttttccggaacctaggggtggtggcttctggaaggctaaccacgtacgtcagcttttgccggccttgtcacttacatgccggtcagtgtttcactgccaccttctggtaggccttggcatagcacctcttgcttttgagtgacttccatccaggccctggtgtggtcccagaggtaatgagcggactgagcttggaccagagccccagtcatccaactcagcattaccagctcttcttactcgccagactgagagaaactgctctcctcttcgccagagctcttcacttactgaggacaaccagagtcagattcccaggaaagatggcatttggtcccttattatttatttatttttaatttttttaatttctgtttttgagatggagtctcgctctgtcacccaggctggagtgaagtggtgtgatctcagctcactgcaacttctgcccccccccaggttcaagctattcgcctgcctcagtgctccgagtagctgggattataggcgcccaccaccacgtccagctagtttttatatttttagtagagacagggtttcgccatgttggccaggctggtctcaaactcctgatctcaggtgatccacctgcctcggcctcccaaagtgagtactaggattacaggcgtgagccaccatgcccggccaacttatttatttatttatttatttatttatttggagatggggtctcacccaggttgtagtgcaggggtgcaatgatggctcactacagcctcgactacctggactgaagcgaacctcccacctcagccttccaagtagctgggtcctataccctcctgagccttgttaatttcttcccagcatgatcactgttttacaatattttatttatgtaggtgcttacttcttgctatgcaaagaaactcagaagcaaaaatagaatctgtctggttcataattgtgctaaaaactagagatacaagtatgaactagacagatgtcgttcttgcttttgagtttctttgcgtagtaggaattaggcacatacataaataaaatattgtaaaacagtgattcatgctgggaaggaaactaacaagccccaggagggtacaggacttctggggagatgattcttccgtgggaagctctaggggaaaaggactctaggaagaaagaacagcaggtgcaaaggccctaagtgggaaaaggggctgtgttttaagggtcagaagggccactgtggctgtgtgtagtgaatgagggacagaggctgggcaatggtggaagtaggggaggtcaggggaatccagatcacacagggaggcccttgtgggtcacaagaggtatttgcagtttttcagtgtgaatggaaaagtaggtgggcctgggaaggcgacacttgatctgatttacacttttcttttttcttttcttttctttttgagaccaagtctcactttattgcccaggctaaggtgcagtggcatgatctcagctcactgcaagcactgcctcctgggttcaagtgattctcatgcctcagcctcccaagtagctgggattacagatgcccgccaccacaccaggctatttttgtgttttcagtagagacagggcttcgccatgtggcccagactggtcttgaaatcctgggcccaagcgatccacccacctcagccttccaaagtgctgggattacgggtgtgagccaccatgcccagcctgatttaccctttaagaaacatcatatttcatggaatctaagatgccatccattgtaagaccccaatatgaggccaaaatgcaaactgtgacacgctattggttataagacacatcctgatctcaatgatattcaaatggtgacatatatgtcttggcatcgatgaaatatggtcagattactctccctgtggggtggaggaagggtctccagggttcagagattgcaaaacccccatctagtttctgcactggtaccggccgacccgtgatgtgagttgatttagcctgaatccacttggcagcagtgtaaacctgctgcatttatttatttttttctttttttttcgagacagagtttcgctcttgttgccaaggctggagtgcagtctcagttcactgcaactccgcctcccgagttcaagcaattctcctgcctcagcctctcaagtagctgggagtataggcatgtgccatcacacccggctaattttgtatttttagtagagacggggtttctccatgttggtcaggctggtctcaaactcccgaccttaggtgatccacccgcctcggcctccaaagtgttaggattacaggcgtgagccactgcacctgctgcttttatatgcagccctgcaagggagttctgaggctgaatcatggcaaagtcatggccctgaaatcatacccgcagcagcacctgacctgttaaaaggctgcttggtgtcgagtaaacagctgaagttggcatcagtgacactcatcatgctattttcactgctactaatgctggttgtgaatatgctgcagaaactggagctggtccagtgactggctttttctcttcctgcccccagtgctggtcacaccctctatgttaactcatgcgaccctcaccaatgttcctgtgatgtagtcagaaccatagctaacatttagttcattctaggcaccaaggcatgttctaaatgttatatcagcattgattcatttactcctccccacaatgactctatcatgcccattttacagatgggcaaactgagtctcagaagagttgagtagcttgcccaaggtcacataggcagtaagaggcatagctgggatttgaacttgggaagttgttctgacagtttccacacagtaaggcaagaaatgacttccttttagtcctgctgttttcctgggctcactgtttgaccacagagaagtggtctcaactctctgggtcttggtttgcctgtctttaaaatggggcagtaatcccagtaggtggtgactcccacggggctgacctccaggctgcaggggacactgagatcctagaagcaatcaccacagccctgaacaagagaactagtgggacctggggacagaaactttgagcaagtcacttattcattcctagcctctattttcatatctagaaaatgggaaccatcccaatggcctatgtaagtacttggcacaatgccaggctctgttgtgcaataaatattgattccttcccccagggatagtgggaccaggctttttctggaatctagggatggtggcttctggaaggctgaccatgcacaggcctccaatccctccccctggcctctgtttccgacagcttgtacaataactgcatctgcgacgtgggagccgagagcttggctcgtgtgcttccggacatggtgtccctccgggtgatggagtgagtgtgggagtctgggcggtgggtggctcagcccggggtgggagacactgaagtctctccctggtgtcctggaagagctggatgtgggggtggccttggtctggagctggggagtcccaagggccaggccccaaggtgagtttctcttgccagcgtccagtacaacaagttcacggctgccggggcccagcagctcgctgccagccttcggaggtgtcctcatgtggagacgctggcgtaagtccaggcaaccctggtgggtggagaacaactcactccccaggcgtgtggcccagtgtgaccccggagctcaaatcatgctcttcccttcaccaatctgcaaccctgggtgagcagacacttccccctctggcttcagcttcttcatctgtaaagtggggacagtaataatatccacccaagaggttttgtgaggcttaaactaatcaagccctacaaagctcttataacaacagtagctggcacacaaaaatgccaataaatgctatattaggctgaaccatatgaaattgctgacatccacccatttttgacctgtaaaattggcaatttcatatggttcaggtttatcttttattaagtcaccatgatgtccaatactggttactttatattctttcaaagcacttttatctccacaatcactcacctcttctaagacgcacagggtgggtcttacaagacccattttacagatgaggaaaataaagcacagagcagttaactaacctttctggggtcacacagcaagtcagctgcagaaccataaaggaatctcgggcctcctaggcttctccttttccccatgacccacaccggtcggtatcttgccaggggaaaagtccccaacgttctaggctgggtggaaggagggatttgggggcagctgtcactggggccccaggccgccctctctcctctaacctggctctgagtcccatccccccttgcaggatgtggacgcccaccatcccattcagtgtccaggaacacctgcaacaacaggattcacggatcagcctgagatgatcccagctgtgctctggacagggtaaccagggtgggcttgggaggggagagccgcagtgggttgggggcagtgtccttgtgaaggtggcattcaaaaaatgtgggcgggacacaggtggggctaggccaccacccttggacgcatgcgtcatcagagacatcccctcatctccaccctgggctcggtggagctgtcctccaggctttgcgagcttggtccctgtggtcaggcttagagatcaggggacaggaaagttggccatccacatcccacagcctcagtgcttggaagagcttcctttggggactccaagccttcccagctgctgtttcggcttggtggctgccctgatgctccgggtttgtctcagatgaacttgcttgacaagtctcctgctcctcactatgaagatcactgtcccccagccctgtgctccccgcactgtgctgcacgtccacctccattccactgcccctcccatccccccatcttgatagcacccttcccaggtgtcaagctgcccctcctagagtgtcctgcctaaaccccctctcctggctcctcccgctacagcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacattta

SEQ ID NO: 1633 - DNA, 30152 bp, Homo sapiens
  source 1..30152: mol_type = genomic DNA
tgtgaatcctaaccgctgattttatttaaccgaatatatccaaaatatgatcacttccaggtcctcagtacacaaccaccacgagggaaacccagacctaggtttccggcgccgactctgaggcccgggagttttcttcttgcgtcaccccagcgtgggcaccccggcccgcccccctccacctggagcgcctctgccttgcccccagacccaccagccaggagccagaggagggaggctgaggggcggggacgaggaagaggatgtggctggtgccctgggtggccgcagccgctgtctttcacgcctttctcactccacacggtgccccgaccccagggtcccgaaagtcccaggctgttggacgtggtctgggtggggtgggagggacgacgctggcaaaggcgggctgagaggatttctttatttcgcgttcagacccaacacactcggacaccttggggccctgtgagggctaagcagggtggtggcgtcagctcccggggaggccccactccctggggaggaaatacacggcagggggccgcacccagccccccacggagggacccgtgttgctctaacagggacactgaagttgcctctgccgccccgtgaggggcctgtggcggccccagacccagcccagccaggccagaggagcctcccaggggccctcaggtggtgaggtgggggcttcccggccccggtgcccaccggcccttctagctgcctgtgctgggccaggtgtcctctgaggccggcaggagtctggcccccgctgcacctgcgcttggtggctggcaggggcggggtagggaggtcaccctcgaggccggggtccccatgtgctaggggaagacctgccttcccagccagtgtccacagggcagcaattccacgctctgaggctcagggaccaaggcagggctgggtgtggggcccagactccaagctctgggggttgggggaccaaggcagggctgggcatggggctcagggccttggaggtttttctcagctctcaacatcacagcacagggcccgtgagtcaccccagtcctctgggcctgtgtacccaagccggatgcaggccggggagtgcacgtggggctcctctgtggcgccagtgtgaagctgctctccggggcggtcgcagcctccaaaccctggtgctacgagtccgtgcctcaggcccagggaccacaggccgtctgctcatggctgaaaatgaggccaagcagctcccaagtctcgaagactccactggtgtggaggcagaggggcccttccagggcagggcagccctcggggcagcagcaggggcaagggctctgtctcacgcacacgggcacaggcacgcaggtgccggccctgccgctggctcccaagaggccgatagcccggtagggaggtcacacacacacagctgatccctggaggtaaagaaacctagacgaggagagtggaggctgggcctgcgcaaggaggcgccaaggggggagaccactgcccacaacagggtcagtcccgcgagagggtcagttccgcgcctgccgcctgcccgcccagctgcagggtgctcgccattgccactgctggggagcatggtttgggccgagaaaccagtgactccgggaggaaatgcagaagggccggggtgccagcgccagtgcccattatgggcagggctgggcctcacgtctgggccagcgagagctcctccaagcctctctttcccaggcggtacctggcgaggtccttcctggtcaccaacccgacaacctgcaggacaagtccaggccacagtgacacacgggtcggctcccgcctgcctgtggagctccctgccttgtgtgtggctggggcagcacaggcagggggccctgggggcttcagcacagcccccgagctgagcacggggctggggaggggtgcagccatggggcatgggccgactcggtgctgggtcctgtgcttccgtgtcccctgccgggagctgagagtaagcacgggcaggaggcagaggggagccctgcacggcatgcctgcacccccaccgcccccgctcacctgattgcggttgtccaccaccaccaggtgccgcaggcccagggcccggaacagcttgaacacccgtgggagcgacgcctcctgcagcaggggcacagctgtcagtgcccgcccacacagcagaggcaggcgggaccctcacccaagctggctccctgcaccccccaccacggcgtccaggcacgtcctgagcccccacgcccgtctggccagccccctcagccccttgacttcagctctaaagcctgccaggcccttcacaggagacagagtcaccgagtcctctccgctgtggccccccccggctgcccctccccgaggctctggaccccaccccctgctgttcagtcccaggccccacgcccatgcccatgccctgcacatgcctggggcaccgtgtagggggaggggttcatgaactcggagaggtccatggtgcactcccgctcgtcctgggacacgtggatggactggatgggtgggaagcgcgggtaggcgtctcggaagtccttcagcctcaggcgccgctgtaccaggcccaggttggaccgctccacaaacacctgcgggcggcagagccctgtgtcaggcacccaggcagcacccccggggcccccacccgcccaatggcccggagcctggcacgcaccttgtgctttaggagaacgatgagctgggagcgcaggatcaggccctggagccgggcaggctgcaagacaggcccgcggtcagggccacgggcccgagggtgggaggctgcgctggaatgctgtgtcgggccccgctctgaccctgttccggccagatttcccatctgggcatgggccccgtgtcggtggctacctgctcacaccagcctcgccatggcatcccacacgcacaatgccacgggacccaaggatcggcgacagggtagcggggcctgaccgcgcacagcagagagccaagggcccagggatggtggctttgctgcagggcagatgcagccccactgggtcccaataaaaaccaacctccaaacacccagtgtccacgtctaaaagacacacagcagtggccgagctgtgtgtcctgtcagggcctcctgacaaagtcacggcccccagtgccacggctctcagcccagcctgggtgccaaccccaagaccctgccaggccgcagccccccccaccagcctcagcgtccacacagccctccatggctgcacactcagcttccggcactcctggaactgccagtgcacccaaacgtgcagcttccccatcctgcaaaccttgccgtgtgcttcccaccaatggactcgacagaggtcacataggcaggaccctgtctatggggtgcccggtacctgggtgtcatcggcatgctccaccacggggaagccgttgtgattggacgccgtgtcgctcagcacgtccacaatgacgccgaccttctcacgccgcctcaggcaggtcactggtgtgctcatcacctccctgccggaggagcccggccacacatgcccgtcacacgccaccaactcccacagttacctctgcgggctggtgaggtgtgaagccgctggacaggaaacgcggggctgcctggagcccgcaagccgtgcaccctgcccctgtgcaacaagaggccgctggacaccctccccacccacaggtgtcctgggcgctgtacctggcagtgagtgagtgtgaggtgaccggggcctcccagtgcaggaagggcacactctgcagctgaatgtgcatgtcgtacaggccctgcgggcggggcgggaacacagggcttgaggagtccacacccacccctggagccccgagcctacccctgggagcccagaggccgcccccagaaaccctgagcctaccccccgggaccggctgtttggaggctcacaggggcccctcccctatggcagcacccacgctctcagggtgaggcttcgaggccctggcgcacctcaatgaagacgtcgcccacgatcttggcggtcatgagcaccagcatgatggggaagccgtaggtcacgttgctggtggcctccatcatgatgacggtcaggctcagtgtcatccgcacaatcccgcctgcgggagccatcatgaaccccagcacgtccaccctcctggctcagggtcacgtggccactgccttctctgcagcacccatcccatccacctgctcccagaccctagccccgcaaggacagccatggccccctccagaccccgtggagctccccacccatcgggcaagagctgggacatacccagctgggcagcagctcccatcagggcgtatttgccggggtccgcccagatctgtgggaggtgacacggaggaggtgtcagtgtggtggcaggcccaaacccaccaagatacacagacggaggaggccctgcccaggcccagcagccccacagccaggaacaaacctcgtggccgcgtacatacacacagaacaacctagcacagtacaccctgctgcggaggctgcatccttggcctgaaccaggcgctcagcacccgagcaacaggggagtggcaggcatggaggatgcagagggcacagtcaccacgcagcagcccaggccaactagggagcaccgtccagcatgaggagtgaaaccccggcacacacgacacagagagccccgggaacatcaggctgggccacagaacccaggcatggaggctgcagaaagcggggcacgagggtcggtgggcacagggtttccattctgggatgacggaacattctagaagtggtagtgacggccgcactgcctcgtgaacgtgagaaacgccgctgaactgccctctttaaaacgatgagttttacggtatttgaatcatgtttcaattttaaaaaccaaaccaaacccttgtgcggagggagatgggcagagcacacgggcctggggagcaggagtgggcgcttcctgccggggatgagaagcatggccgggggcttcctgccagggcctcttacaggttttcagtcttatttaagcgactgaaatgagaaacagaagacacataagagaacccagtcccagcagaggcaggcagagaaggaaggcctgcgggggctgaggtctggagggcagtgtatgccgctctggcccccggcctcacagagagcagccctggccggacatccaccccatggagtctagaaacagctctgcagcagcccacaatcacctctgcttttcatcacattctcaagaataaggacacgagcctccgccccctaccttcgcctggtccagactccacacatgggctgcgctgccacagtacacgctgccaccacagcaggacaacgcccacggcccgtgaaccacgcgaggacaacgcccacggcccgtgaaccacgtgaggtgcgacacttttgtcctgccctgggacttctgctccggcccgcgatgccgcaagacctggctcagctgcagggccccacagcctcccctccggccccactcaccgccgcccccgtgaggtaggacagggagatcccaaagagccggccccaggcagccccgatgagcagggacgggatgaagaccccggcagacaccgtgagcccgtaggtccagcaggccaggaagaagtagaccagcgtgaacaggccgagggtcagggggttgtaggagcctaggagagaagaggggctgacggggcctccacgactcccgcctccgcaggactgccctgccccgctgcccagtctcgggcctcacagtcaccttccaggagcccagcaacctgagctcccgagcccagcggtccccagaaggctccctgttctcagcctccctgggaagcagaaaggctaaaaggatcccatggggaggccacaggggaagaggctctgcggggccctgatgccagcagaagcaggagccgcgtccagcggggcggcccagctgggtctagcagcgccaggtctacactccatgggtgtgcaccgtggtgcagctcgcagcctggctccgggaagagggtgccccccacagcctggggttcctttcctggagcaggcagcactgtactgcgtgcagggcgggtgagaccgccagggacacaactgcagaggtgaaaggccggcactccaaggtcgcggtctgcgcttccgtgaaacacttgtggtcgagcgaggccaggccgtggtcttggtgtgggagtcaccaggctgggttttcttttgttttttgagagagggtctcgctgtgtcacccaggctggtatgcagtgatgtaatcacagctcattgtggcctcaaccttctgggctcaagcaatcctcccggcccagcctcccaagtacctgggactgtgggtgtactaccgtagccagataatgttgcttttttgcaaagacagagtctcgctaagttgcccaggctggtcttaacctcctaggctcaagtgatcctcctgccttggtctctccaagtgctgggattacaggagtgagtccctgctatgatccatgctagggatgaccccccagcccagggctgcaacctcagcccacaggggacactcagccagaaggcatcacccaggccctgatcccagggcctgcccagcggcactgcccacacacacctggcgggtcgtggaagaggctcaccacgctcttctccggggtgttgaagaaggccgcagccatggagttgtactcgccatctgcacaaaagagctgtggggtcgggagagagcacacgttgggaggggagatgagctggtgggctgcaggcacaaacctggtgtcgccgtgagaggccgtgtaccctgtgcctggccagcatcaggcgcgaaaccacacgatcctgccattgggtcagggccacggtcacagagggcaaggaggacacacaaggcccaagccatggtcacggagggaaaggaggacacacacggcctaggcccagcagggggccgtgtctagccctggggggtgggttagcaggaccatgggctgagacgctgtccatccctggtgccggggaaggtgggcccaggcgctcacatgagctcctagaagaggctgttggcgccccggtgccacaggcccagagcctcctgggctccagcagcacagggggtgttatccacggggctggagcagagtgtagcaaggctggtcaaccccatggccccgggcctcccacgtctctaacggttcacacctgacccgtcccatcctgcccactcccgccgtggcacccactggtctgctgggcctctaggctctccctgttctggatgtttcatgttaatggggctacgtcgcgtgacctcacgtgtggttcctctgagcgtagtgctttccagggcaaccgtgtcacagtgcagatggacgcacggacggcggtgagccgtgagcgccaggcacaggtccagttgtggacggaggtttgcatttctcctgggtccacatctatggtgcccccatagggcgcctgaggctcgccccgtcaggctgccattctgggaagaggactggggggagcctctggcccccataccaccgcccattcccctggcacctcagcagacacctggcctcctctgagatctgggtggacaggactaaccctctttgagacacgccagcccatgcgcttctggaactcggcggggtgggcagccctcctcccgtagcctaagcgagcctcctggaggccgccctgtggctgccctgcctgctggaccccgcccgggcccagcctcccacctgcagcgggtaggacatggagcccccctgcaggggctggcaatcccgcgacgagtagatcagcacgaaggcaactgtggccgtgacggcggccaccagcacggcctcaatcacctgcaggcagggccggtggatgtacctggaaccaagaatcaggctgcatggcaggcaggacggcagcgcggcccctccgcaggccccatggcaactcgagtccctgatggaggacactgggcccgtggtgctttttgtttgtttgtttttgtttttgagacggagttttgctcttgttgcccaggctggagtgcagtgctgcgatcttggctcactgcaacctccacctcccaggttcaagcaattgtcttgcctcagcctcccgagtagctgggattacaggcgcccggctctacatctggctaatttttttttgaattttttagtagagacggggtttctccatgttggtcaagctggtctagaactcccgacctcaggtgatccacccgcctcggcctcccaaagtgctgggattatagtcgtgaggcaccgcgcccggccaggcctgtgtttaatcatcaatcaggcacccaaatgtcctggggtcgtcctcttccctggggtaaagactcctcggcagcaacttctccagatgtgtgggaagtggcgctacccgtgccccggctgtacccgacagtattgaaatcagcacagaccaagaaggaagaagccggggggccccggtgtcccaggacagctgcggttgctaccaggcagagccaggcggtgaaggttgggcatgcctcgcccaggcccgatcccacgcagggcctcacttcctacccaggggccgtcctccaggagccctcgcactcctagccttgggctagtccgtcaccctccaggccccgggacacatctctgaccagctccaccggggaaaccatcaggaaggacgctgcatacacagcctttctttcggctgtggcctaggagtgtaaaccccattccaccacgtccgctttcaaagggcctgtgtggccacgcctgccaacgcgatatgcaatgcggtttctcctcacctgattcgaaacatggtcagccagtagttcaaggcattgaacactgctccaagcacaccgcctgcgaacaggggaaaggccagtcagcgacaccggaggaaaagtgcgggcctccgcccgccggctcccagatggcaggagaagctggagggtttgcagagggaaggggacggcagggggctagggggtcctggtaagatgcttcctccacatcatcacaccctgagggctgggggagctgtttctcaaaggctctgccttccttccagggcaaaggtgtccagcagagcaataaatactggtgggagcaattctatctcttacaggaaatcccatccatccctgcagccctgtggtttttgccaacagagataaacaacgggaagccacagaagcgaagctttgggctccccactccccacgtgtactgcccatggaagaatctggaggcccccgggtggccctgggatgagggcaggctccagggagccacagcctccagtcctcgtctctatggccacgtcacagctgagccaggcccgcaggccgtccctgcggtgctgggagaagcccttacccaccacgcccatggcgatgaagaccgggatctcgtggatcgtgtaggccattttctgtgcagagagagggagaaggcagaggatgtgagggaaaaggcccacagctcctttctgctgaaactcaaggaccaccatcttaagagagctgtccccacagagagccttcccgcccttccacgcaggctgcggaagtccacaggggagaaacacactgggtgttctgagcaggcctggcccctgcctggcggggtggccagcgaggctctcagagaccctgccaccctcagcacccggggcggggagggccccaagcactgggaacatagcccgtggtcccccagtttcctgcgcacagagccgccctatcgatggcacggagagtctccccagcccaggccccaggctaccctggaaactaggcctgagcccacctgccccgagagcggctgctgcacgtgcccccaggccgtgggaggccccatgcacgcagcaactgtgtgacatcccaggtgccctgctggtcacatggtgccctgacctgaggggcagcttggggtgtcttcctgcagcccctcggggccctggagcttacacaagagctctcagctccacagctatcaaccagagttttctaaaggaccaaattctcaacctgggccttaagcaaacagggtcctggaccaggatacgaggtgggcgaggtgggcgatggggcaggttacctccgagtcaaaccttccgaagttgatgaggcctgggctggacaggtcccacatgttcccgtggtaaatgctcagaacaaaattcagggtgaacgtggagatcatggaagcaaagaactgcggcagagggcaggaaaccagcgccctcagagccacgctcccagcccagggctcacggaccagcagggaccatcgcccctcctgtcagccccggggccaggagtctgcagaccccgcccaaggcagaagggaaggggctggagccaggggtgggcgcactgtgcgggcaaggagcggcccagccctctctggacttgccagtggagagcaagaggggaaggtggggcagggctgggttcccggctgtttgatcccctacccgggagccacccagggctggcaatggtgcccaggaccaagggcgaactgggcagcaaaggcaggaccgctgctttgggcaggaccaaggcctgacagacccacagggggtccagctccagccgcagctcgatgggtggccccaaggtggaccccatggtgggaaatgagagcgcagcatgcaccctgatcaggaggcagccatcagcaggaacttacgatcctccaggtcaggaactggttccagaaggacgcaccctcctccaagctgaacaggaccccacctggaaggcaggcggccggctcgggtgccagctggacacagggcaccatgcccaccaccaactccctcccccaggctccagggaacccagaccacgtcagaaagaagctaatggggtgggccccagccacacagagagggaccctgagggaggtctgagggctggacccaagtacactgccggccgcttccaaatgccccggccgtgactccaagcctctgccaccctcagcgggcactgggcctacagagaggagaccgttccttccaacacacagggcgagggcaaagcattggacccggtgcggccctcctcacccacgggggctccaaacgccgctgacactccggccgcagcccctgcggagacgaagtcccgcttctctgtgtctctgcggaagtactcgaagatctgcaacagggacagaccagggtcggggcaggttccttgagggcacggctctcagaaagggagagcaactgccaggacaggggctgtgcaggggaaggggctttcaggacaaccgagtcagcagctctgattcctgaagagcaccgtgctgcagaccacggcaagagacagcagggtcagcaccaccaccggcagcccagggaaacacgcaaacacccagccaggagctccactttccagcgcacgcaagattccaaaaacctctaccctctaacgaaaagcgcacggatggaaacccagccttgctgttctttgtcctgcgggacgctgcctgcctctaaattcacacatggccggcgcggtgcctcacgcctgtcatcccagcactttgggaggccgaggcaggcggatcacctgaggtcgggagtttgagaccagcccggccaacatggcaaaaccccatctctactaaaaatacaaaaaacttagccaggcgtggtggcgggcacctataatcccagctactcgggatgctgaggcaggagaattgcttgaacctgggaggtggaggctgcagtgagctgagattgtaccactgcactccagcctgggcaacagagagactccatctcaaaaaaaaaaaaaaaatacaatcacacacaaatgcagctcaatccccatcaacatgctggggacttttttggggaaaaagtgttccaaagtgtgtcttgacaaataaacaacaggtgggcacacttggtctcaggttctgcactcctctgagaagccgcttggagccacagaccctcccacgggaaacactgatgcacgtgtggcaggggacccaaggagggaagcagcgggccgtagggaggccttgccgggcagggactgtgcccgctggctctgggagccacccgccaggctgtcctcagatggggctggggctctcggcctgggggtgctgagggaagcccatctccctgagtggtgcccgtgcccgtgcccatggcatctggagcccacccacacaagatttcaactcaccttgaaatctcgtttcagtgacgttgaccttccctgagagatcccggcggcaatcactgaacctgagtggatcatcggcccttcctggagaccagaaggaccggtgctcagagacacgcgtgacgcggcccttcctggagaccagaaggaccgatgctcagagacacgcgtgacgcggcccttcctggagaccagaaggaccgatgctcagagacacgcgtgacgcggcccttcctggagaccagaaggaccggtgctcagagacacgcgtgacgcggcccttcctggagaccagaaggaccggtgctcagagacacgcgtgacgcggcccttcctggagaccagaaggaccggtgctcagagacacacatgggcgtggcggccctcgcgggcccggcggcctcaggctccagctggagtggccatgtgcactttgttacctttcccacggccaggcccccgaccacggacaggatcacaccggacactttgatcaccaacgtctgaaacacagggagacgcatggcctctgatgaaaaggcaggcgctgtctttggacctgagccgtaaaacagcacacacagccccgatcaggcagagtggctgggacacggggcctccgggagggggccagcacccccaggctgggtctccccatggccacagtggagctaaacagcagccaagcgtcccccgcactcactcgggggacctgccctctgtggcctcagcactgagcaggcaaggggttctttcgtttccttccttcctgaggcaaagctgggccgcccaccgcatcctacaggcacacctgcctccgccagcgtggccagcacaggggaggtgttcccgctagccccgcctagcaaggctcctcatacacccctggcactggaaggctggtcacctgcggctccacgatgccccctctcccttcggctgctccccgcccccaggggcctcatcctctccacctgagaaggtgtgtaaggtgtttatcagcctccctgccccagggcagaacccacaagggcgcagaccctaaacacaagggcgctgagtgtgtgggggaggactgtatgttaaagatgccgagcaaactcaaccctcagccaacaaaagttatagagcaacatccaagaaggttcaggccagcctggcgcgggtgacaggcgggtcgccattcccagctgctccagtaaacctgatctcccaccacagggcaggggcaccccaaggtcacctgggagctttcgccagaggggacacactggtcccgctccttggccacggggaccaggccccggaagcacccccagggggcagcggccatgctgcccacccatcctcagacgggacggggctgcggcaagtctcaggctaaggaacgatggcggcacagacagaagcaaccacagcggaactgggtcaggactcccagcacctccagaaccagatgctctgataacaccaagtgtaaatgaccatgaggcaaactgaaagcgggaaactgctacacgcccactaccacgacagcttccacggtgaatcagtcaccaccacgcagcccacagtcacagacgcgtcgcacagctgtgtcacacatgcaccacgcaagcatttctgtatgactactcatttcttacgtaatttaatatgtgcaaataccagttgttaccactttcagaaaaaaaggtgaccccttcacacccagccagcccatctgcacacagtgccaccagtacacagggtggctgaggccagttctggaaggcaggcagccaagagagctgctcctgaaccagcaaagagcgggcgcccaccctgcccagccagggccaccgcaccctcaccttgagccgcaccacgtgggggatcttcaccccgttgaggaagcacttgatctgggggattccgctgccagcagccaccggctgaaagaggggaagcacggctgagtgggtcacggccaggctgagacagatgcagcccctcagccccaggagccccaggagctgaggagagcagcagacacgtcggggcctcagggaaggggagctcagcacacaaacgtcggggccccagggaagggaagagcagcacacacgtcagggccccagggaaggggagagcagcgcacacgtcggggccccagggaaggggagctcagcacacacgtcggggcatcagggaaggggagagcagcacacgcgtcggggcctcagggaaggggagagcagcacacatgtcggggcctcagggaaggggagctcagcacacacttcggggccccagggaaggggagagcagcacacatgtcggggcctcagggaaggggagctcagcacacacttcggggccccagggaaggggagctcagcacacacttcggggccccagggaaggggagagcggcacacacgtcggggcctcagggaaggggagctcagcacacatgtcggggcctcagggaaggggagctcagcacacacttcggggccccagggaaggggagctcagcacacacttcggggccccagggaaggggagagcggcacacacgtcggggcctcagggaaggggagctcagcacacacgtcggggccccagggaaggggagctcagcacacatgtcggggcctcagggaaggggagagcagcacacacgtcggggcctcagggaaggggagagcagcacacacttcggggccccagggaaggggagctcagcacacacgtcggggcctcagggaagggaagagcagcacacacgttggggccccagggaagggtctcatgtcgttggggtagctgctctcactcttcccagcccagacacagatcaaggacgtggtggaggcggaggtggagatggaaggaggggagggcagagtgaggagatggaaggaggggcggagtggggtgagggtgcccaggcctgtgctggtaggtcaggagcagcaccccagggctctgggggtgaagaggccctggtgtgtctgctcctcctgaggttgtgagtctggaccacgtgattctaaaagtgcccgggttgtcagccaatgtgatggtgggggtgggtgagctgcaggggttcccgcccattcaccaagacccccaatccttcatggggtccgccatagctgcggcatcctgccacccacctctatgaaagccacaatcacagagcccacgagcacgaaggcggcgttcagcgtggcccacagcaacagggagaaggacagtccgcccttctctgtgaacttgtcgatatctggggctcatcaaggagggctggctgcttccccgtcatgaccacccagcccagacctcagccctgccccacagaccagcctggcagatgccaccctgctgggtggagccatgatgttcactggacatcccagagacgtctcacggcccaaccatgacagggacacagccagcctggccgggccgcctccacctgcactggaacacgctgggctcaggacttctgcccgggactcggcccaggccacgcccccctcccaagctgcagcggccgcactgggaaggatactgcccttgatgaccctgtacttgaggccagccaggttttccaccacgatgtcaatgaagcaggccacgaggcccgtgaggatcccaatgagggcgcagatgacccagcgcttgatctccaccgtccggaaggcctgcagggcgcggtcagggcgagggtcaggcagggccctggcgcagtcactctggcagcagcaggaccgcccagaccgcctgcaggccccgggattatgaagggcccagtgtgcacggtgcgctgagtcccacaaaggacagtttctggccaacatctgaggcgcacccggggcccgagggtgactcggggaggtgggtgaattcccaacaacttcacagccagcggttgttatgctgggcaccgcatctggcggccgtaagagcagccttcttggttacggtgaccgtgaccctcccactgtctctagaaaccagacgaaccacaggcctcagaggcggagtcagaggaggagggaggaggtgcgtcacctcaccccggcagaagagcagccccaggcccggccggcaccaggccccgcaccgtggggccctgcagggagcggcgtccagctcaccgtgtgattgatccgccgctcctcctccaggaacagctggttctcactgttgtcatagtccaagctctgcaggccgggacagcaagggcagcactcagcaccgaacccacgctctgggtgcgggcacaggggaccgggagtgggctggcagggggcagaggccgggtctcagggtcagggggacagaaggacgcccacctcatacttgagggacaggagcttctcgttgtgtgggatctccttggggaagggatgtggagggtccatatcctgtggcagaaaaaggcaaagagagaagcacagttgacaaggccacaaggagagaggcccctctcagctcacacacgaggccattatcatcccgacaccaaggacaaggacacagcaagagaactgcacatggggcgcggtggctgacacctacaatcccagcactttgggaggccgaggcaagtggaccagctgcggtcaggagttcgagaccagcctggacaacaagatgaaaccctgtcgctactaaaaatacaaaaattagctgggcgtggtggtgggcgcctgtaatcccagctactcaggaggctgaggcaggagaatcgcttgaacccgggatgcagaggttgcagtgagccgagattgcgccgttgcactccagcctgggtgacagagcaagactccgtctcaaagaaaaaaaaaaaaaagagaactacagaccaacacccctacaaccacggatgcaaagatctttggtaagacacaagcaaagtgattccagcaatgccaggagcaaggtgaattcagcctaggaatacaagttagtttaacatccaaaaatcaatccatgaggccgggtgcggtggctcacacctgtaatcccagcactctgggaggcagaggcaagaggatcaactgaagccaggagttcaagaccagcctgggcaacagagtaaaaccctcatctgtctttttttttttttttttttttttttttttgagatacagtcactctttttgcccaggctagagtgcagtgacgcgatctcaactcactgcaacctccgccttccaggttaaagccattctcctgcctcagcctcccaagtagctgggattacaggtgtgcaccaccacgcctggctaatttttgtatctttagtagagacggggtttcaccatgttggccaggctggtctcaaactcttggcctcaagtgatccacccagcctgggcaacacagtgagaccccaactcttaaaaaaaagccaaaaaaaaaaaaaaaaaaaaaaccaggcatggtactggcatgaagatggccacaaaagaatggaagagaattgagagagtccagaaagaaatccaaaacatgtacgatcaattgatttcccacaacagtgtcaaaacatttcaacagagaaaggtagtgttttcaacaaatggtgctggtacaactggatttccacatgcaaaaatgaagctgggccgggcgcaatggctgacagctataatcccagcactctgggaggcagaggcagaaggactgcttgaggccaggagtttgtgatcagcctgggcaacatagtaagactccatctctacaaaatattagctgagtatggtgacatgcgcctgagtcccagctacttgggagacagacaggaggcagaggctgcagtgaaccatgattgcaccactgcactccagcctgggtgacagtgagaccctgtctcaaaaaaagagagagagagagggagggtatgacgttggacccttacctcacaccacatccaaaaattaactcaaaagggatgaaagacctaaaactgtaaaattcttaggaaaaaacgggtcagtcgtcatactcttgggtgaggcaatggtttcttagatttgacaccaaaagtacaagcaacacaagaaaaaacagattagctgaacctcagcaatacaacctgtgcggggtgtgatgcacctgtggtcccagctcctcaggaagaagctgaaacgggaggattgcttgagcctgagagatggagttcagcctgggccacacagtgagacctcatctcaaagaatagtaataattaatttttttagacagggtcccgtctgtcacgcaggctgaagtacaatggtgtgatcatggctcactgcagcctcaacctcctgggttcgatcaatccacctgcctcagcgtcctgagtagctgggaccacaggcgcacaccaccacacctggctaattttcgtttttgtttttgttttttgtagagacagggtctcactgtgttgtctaggctgatctccaaatcctgggctgcagccttggtttcccaaagtgttgggattacaggtgtgaaccaccacacctgcccagaaaaaaaaaaaaaaatttgaggcaggatctcactctgtcacccaggctgaagtgcagtggcaccatctcagctcactgaaacctccacctcctgggctcaagtgatcctccaacctcagcctcccaagtagctgggactactggtgcctatcaccaggcccagctaatatttatattttttgtagagacagggtttcaccatgttgatcaggctgatcttgaactcctgagctcaatgaatccatctgcttcccaaagtactaggattacaggcacgaatcacctcccttggccaaaacttttttaattaaataaatttgagcaacaaaagacaccactgagaaagtgaacagaaaacccactgaacgggagaaaacttctataaatcatgtattggatgagagatttgcatctatgtataaagaactcctgcagctcaattataaagacaacaaacccagtttaaaaatgagcataaccaacacgcgtgtggccggccaggcacccgctccagggttgagacaggagaggactgattgctgaatctcacgtgctggctttttcccttctctcccaactcctgcccctcccaaagctgacaccagagcaaaggctttgaagtccaaaaaggcagtgccgaaggcgcccacggccacgaaacagatcttccgaaggccttgtggctccagaggcagcacaaacgtatcagaagggcagccccggaagaggcgctgctggctgtacaggacggcatctgagcacggcgccggcctcgggagcgactgcggcagagctcaaacggacgcaaggccgaagagcacccggacaggtggactgtgagatgcctcagcctctgacgtggcccagggcagagccaggtggggcctgatggggagaaggaggacgcccggggtgttgccaacatcaggatcatctcaacaggagtcccgcacagacatctacccagagacgatgagtgaacggccagcggcagcagaggactcccggcctcaccagcggctgggggaaaaaccgaggccggcgggagatgcccccgaggggaaggaagacgagcacgctgccgctgagctcaggactcccagggcagccactggcacgggaacatctaaacccctgccctctgaagtcagaggcatccggccccctctcactctcctggggctcctcactgcccccccaagatccctgtccttgccctgtcccaaagccaggtccagccccctcgctgcccatgctgtcactgctgtcctgaccggcttcctgcgccctgcactcctccgtctgagagcacttctgcccagctgcctctgctcacttggcgtcagggaccatgtccccccaaggaaatcttccctgaaccccggccctggggccccactatctccctgccgctcggcccgtgcccatccctgtcaccctctgctaagatgcagctagctctgcgggaggacggggaacacccccaactcaccgggtccaaaagttcatcatccagctccacgctgctcatatgtccgactcggaaaagcgcagaacgtggtgactaaaagcagaagagaaatcatgagggcgctcaggcgtcgcacgctctgctccgtggattctcactcccgccgccgcaccctggcctcgcctgaccctgcccgggagctcaggaatgggctaggccaggcctgcctgctgggtgggggcagcagggctgggacgggcctccctgggccctggaagcagaactgatccggctgcccctcggcctgtcagcgacacgtccagcccgagtccagggcgcaagctccctgctctagactgaaagcgaggcacctgccacccaccaggaaagaagggctggacaacacgccgcccccaatgcagtgcccgccacagcaccctgggccatcctgcccaaccctgctcccgaggccctgctcagccacctgccacctccacagagtcacctccactgcagcctctctgggtcttgagacacaaacggctccacagtgttcacgctgccctccccacaggacgcccagctgtcaggcagagctgggtggggtctcagccacctaaggctttgcggccgccccagctcagggcaggggcagggcagcgggccctgggtggcgtggtgcagatgtgacttacggagctcccaccccagtctccggctccttactagagccaaggcgctgaggccaggctaggaggagccaagacctcagcctcctttccccaaagagatcctttggagacgactccaatttccactatctcctgaatctttagcaacatctggggacatgaagggaagaagggctgccttccaggtggagggaccgcatgcgcagggcgcccgccatctgcatcagagagcccgtgcgcctgtcaggaaagtgttggcggaggagtccagcggctggtaccggccgtgggaagaccaacgaggctgccgcccgccttccctgggagcagccctcccggcccccaacgccgtcccctcctcatccccccatctctccctccaccttcctcaggctcggcctcccgcaccaggtttcagcagggcctggaagtgcttcttggtgatagaacggcaggtgatggcgccaggagcccacagggccgaggtggggacggggagacgtgcaggaacggcctgcactggggcccagttttccctcaacctccacctatccacggggatcacgattaccacacacaggcaaggacacagaagcagagaaggaaggtttgggatctgaggtcactgcgagccaggggtgggggtcctgctttctctggagtgctcacccctgaaggagacgggctccccaaaccgccatcccagaaactgccttcagaaccagaccttcccggcggggtacagtggctcatgcctgtaatcccagcactttcagaggctgaggcgggcaaatcacttgaggccaggagttcgagaccagctgggccaacatggcgaaaccccatctctactaaaaatacaaaaagtaggcgggctacttgggaggctaaggcgggagaatcgcttgaagccgggaggtggagtctgcagtgagctgagatcgcaccactgcactccagcctaggtaacagcaagactctgtctcaaaaaaaaaaaaaaaaaaaaaaaaaaaaaaagaacctgaccttccagcccactgccctccagggaccccttccccaaccatcgtcctgttaccagccaccgtcgcccttgctgtacaccccccgtgttgatgacccggtaagtggccctggcaggggaaggaacctgggcacgtgccactggcccttggcagacaccagtcagagcctcctcctctccccaggcaaagagcactctcaggccatccccatcaaaagccaggagcagaggccagacagacagacagacagactcgcaggtgtctgccgtggcatctccacgcccaggggagagtgtgggaggggctagagtgcacaggtcctgctggacacaaccctgagtcacagggcgcctgcccctcctcttcccccagccttgccacatgccagtggctctccctgagccctcagtcacaggcgaaactcacagcttgagtctcctgccacacgggctgacggtgggaggaggaaggtgccacggtccaggcatgatggaagcagtggcctggccagctgcccactccctcttgctcacactcacatcaaagcccctggactccaggtctcaccaccagaaaacagccctgggaccagcgctgggcctctgacccccacctcccaggtggacaggtgccccgatgccccaaacagagaccacggaacccaaaagacccatttcaccatgaggaaggaccccacgtccaaacaggcaccctgtgggacacaccctgcccagagggccaccctctccatcactcaagatgtcagcacttctctctaacgccactcaaggcctgccgtgcttctcaggctattccttgctggaaataacggatcattctggccggacgtggtggctcacgcctgtaatcccagcactttgggaggctcaggcaggaggatcgcttgagcccaggagttcaaagccaacctggacaacgtagtgagaccctgtctctacaaaaaatcaaaatcagcaaggcatggtggcgtgtacctgtggcccaaactactcaggaggctgaggcaagaggatcgcttgagcctgggaagtcgaggctacagtgagctatggttgcaccactgcgctccagcctgggcaacacggcaagaccctatctctaaaattaaaaaaaaaaacccaaacaaaacgaaaacagccacagtcacatgtcctgggcgccaggcctgggaggccttgaggagggccaccgtctacaccacgacagcactgtcccacagcagcaggcagagccgcacatgcattcaggccaaggtgaaggctgccggtgcagtatgtgaccagcgggccacccccaccgccgccgccttggcagatccgagaggggtgaggggtgaggggttgccccccagcagggcatcagctgcccctgcccggagtgaaaggatggggctccggcgccttgccttcccagcatctctttccttaactctgccaggactttgagaaggtggctttcgtaatggaagaacacgacgtttacttcaagttcagcaatgcattccgtgcggttactttcttttttaaatgcaagctcttataaattaaacactagatgctgttcctcaaactcctgccacacacggcaacctacacggtcccaagcgccggacactaactaaaaacagacaggctcaggaacacgtgagccaacactcccgagaggcgagactcgggccggacgggaggcgaggtcatcagggttgggagtgggtgggactagaaagatgggtctgaaaatagcctgcacccccttcctggtgcttacgcggatctacacgcattgcaccgacactctcttggttttggggctgcgctgttacggaaaggtaaacattggggggaaactcggtgaagggtacacaagccccctgtgctacctttgctgcttcctgtgaatccagagtgatttaaaagtcaaaaaagggctgggcacagtggctcacgcctgtaatcccagcgctttcggaggccaaggcgggcagatcacccgaggtcaggagttcgagaccagcctggccaacatgaagcaaccccgtctctacttaaaaaaaacgaaaaaaaaaaaaaaaaattagccgggcatggtggtgcacacctgtaatcccagctactcgggaggctaaggcaggagaactgcttgaacccgggaggtggaggttgcagtgagccgagatcctgccactgtattccagcctgggcaacagagcaagaccctgtctcaaataaataaataaaataaaacaaaataaaagtcaaaataatgtatagaggggaactacatcaaactttaaaacttctacacatcaaagaaaacaacagagcaaaaggtaacctatgaaacgagaaaatatttgcaaatgtgataaggaattaatatctgataagggattaatattcagaatacataaaaaaactcagggtcaggggaggtggctcacgtctgtcatcccagcactttgggaggctgaggcgggctgatcacttgaggtcaggagttcaagaccagcctgaccaatgtggcgaaaccccaactctcctaaaaatacaaaaattagccgggcatggtggtgggcgcctgtaatcccagctactcaggaggctgaggcaggagaatcacttgaacccaataggcagaggtcgtggtaagctgagatcacaccactgcccttcagcctgggcgacagagggagactccgtcaaaaacaaaaacaaaaataaacaaaaaaccaaaaaccaaaaacaaacataaaaaagcagcgtctgaaagtcccacttgcacgccatgttcacagcagcaccgttcacaatgaccaaaatgcggaagcacctgctgtgccgatggatgagtgagtcaaggaaatgcagcctctccccgcaatggaataattcagccataaagaggaatgaccaccgacccgtgctgcagcacgacgggccggaggacactgtgccccgtgaaataagccagtcagaaaaagacagctcccgcaggtccactcgcaagagggccctggagccgtcaggtcccctgaggcagatggcaacgagggggctgggcagcaggaggaagggagagcgttgaatgggtgcagtttcagtttggcaaggaatgggttgtgtaacactaagagcgtgctcaaccctactgactgcactcacggatgattaaacggtcattaaacaaaatgttttttagaaacaaggtcttgctatgttgcccaggctggtctctaagtcctgggctcaaataatccttccgccttggcctctcaagtagctggtatgagaggcgtgcaccaccatgcctggctcaaaatggtaaatttatggtatgtgttctttaccacagttttttttaaaacttaaagcaggattaaagaccatttgctgttctgctcggcctgtgttgcgtcctaacattcagcaggcctctgccaggaccaggctagacgctaggcacagaggatacagcagctgccccgcggggggatgggggttacagtcaaaggaaacaaggtgacacacaaaggccacagagaccaaggagaggcctttgctgtccatgcagtgtccccatggcgttaaggcagagacctaaagcaagacagacactgaacagcaatgctggagggcagggaagggcaggggacagcaggggaaccctcccaggctggcagaggacttcctggaggccagaaaagaaccaaggggcacttcctcaagtacagcagagctcaaggggccactggcgacgaccccagaccctcccccgcagccttgctgcgcccacagttctttctcaggctgcggtctgtggctccgggtgcccaggcaggacacagtcccacactaacccagacccctgccctgccaaggtcttatgtggagtgtcccaacatgagttcccagggatgtcctgcaaatacccacctcccctcactgccccctgagacccaagtgtttctggctccagccgctttccctctcagttctcaaggagttctgcttcctgccgcccacacacggccagggctggctgacctcaccctcgccctgtcccaacaccaccagatgagcagtgactggcttggtcaattcaccactacaccacacaaagcaagaccggcctgagaacaggaacagcaacccacaggcagctctgaagggcctgggctttcagcgggcacccagcctccaacaagccactccacagtctgccctgcccagggcagccacctcatagtgtttggccagctgtgcccacgctgaggtggcaacgacaccaccagccaacctgaaaatcctgcaacaaaccctaaagagcctggaggcagctaggaccagttctcatgttcactggaacagtcccgtcagcaggggatggcctgggttgatattttagctcaaaacagctctggaggccttgaacccaagggcagcttacagtaccccgtctgtggccacactggggtgcgcctgagcctaactgtgagctgtgcccaccagtcagagcagaccctcccccagaaaagcagcaccaagaaatccagtagctactcaggaagttggacaggaaagtcacaacgaacacgaatccctcttgtgttgctggttttaacacgaccgggcacgactcacgtttcttcagagcgtagtttgtgacaggcaccgtgctcagcgctatgcatgcgttaactttttcgcagacgggaaaactgggcaacagggaggctacaggccttgcaggaggccatcggcgagtccgatgctcagagcacaaacgcctggcctaagaggtggtgtcttggcctctagactccgcctctccagtctgtctgcaggggaaggctggggcccttcaggaatggggtcctagcttcccatgggctcccctagagatgagccaaattcaaagcctgttcatgtgcgcagcagggctgacctccaggctccacagcgcatcccaaacacacactccctctgtcctttccccccgtccgcctgcctgaagatcttgtgctcttcaagcccaagccttgtgactgctcctgccccaggggccctgcagaccatccgcacagggcactgggcctgtctccagcaggaaggaagcagctttatgcgcctgcgtcccaggcagccacagagcaagtgcacgataaactattttttaaattgcttgtaagcagagtatccgctgttattaaatgcaaacaaacaaataagcttacaatgacttttaagggaatagtttttttatttttatttttgagatggagttttgttcttgttgcccaggcaatggcgtgatctcggctcagtgcaacctctgcctcctgggttcaagcgattctcctgcctcagcctcctgactagctaggattacaggcgctcaccactatactcggctaatttttctatttttagtagacatggggtttcaccatgttggccaggctggtctcgaactcctgacctcaggtgatccacctgcctcggcctcccaaagtgctgggattacaggcatgagccaccgtgcacagccgggaatactttctaaggttaagagatcaacagattatttcccaaaaaatcaactcttctatttgcaaagacagacaggaaaccccaagcacattcagtcccaagagaaactcaaattcaacctccatcaaggttcctaatctttacctttcagcccttaaagttgggtttattccttctaccttgtgaacttcagatttctttaattaaaaaaattttttttaaattttttgagataggttctcaaactccagcctgggcaaaagagtgacaaactacctcggaaaaaaaaaaaaaaaagcacctcactgcagcttcaacctcctgggctcatgcgactcctctgcctcagcctcccgagccagtagctgggactacagatgcatatcaccacacctggctaattttgtttttttttttttgagacagggtttcactattttgcccaggctggtcttgaacttctgggctcaagtgatcctcccctaccttggcctcccaaagtgctaggattacaggcatgagccaccacacctggcctttcttttaaaacagaaacacacacacacacacacagaggcatacacatacacacacaggcatacacacaaataactaatcacccatggccccatcacttcaaattaaccccttcagatcacttttcatgcagactacagcacggagagcaggagggcccacttcaaagggagctgagctgctgcttcttatcagcaaaaggcagactatgaccttctttgtctggtgcgtttctaaggaattgggaaaacctaaatgtaggttctatggaaacaggctgattttcgtgtccttcctaaacttttttttttttttttttttttttgagacggagtctcgctctgcccaggctggagtgcagtagcgccatctccgctcactgtaagctccgcctcccgggttcaattgattctcctgcctcagcctcccgagtagctgggactacaggcgcccgccaccacgcctggctaattttttgtatttttagtagagacggggtttcaccatattagccaggatggtctcaatctcctgacctcatgatccacccgcctcggcctcccaaagtgctgggattacagatgtgagccaccgtgccctgccgtccttcctaatctttaagcacaagacaagtgtttaaaggactagacaagagaaaatgtaaagaataactgcaaagcagattaagacccatcaacaaaacggtccattaactcaaaagtaacacaatacggccaggcgcagtggctcacgcctgtaatcccagcactttgggaggctgaggtgcgggggatcacgtgaggtcgggagttcgaggccagcctgaccaacacggaggaaccccgtctctactaaaaatacaaaattagccgggcgcggtggcgcacgcctgtaattccagctactcaggaggctgaggcaggagagtcacttaaactcgggaggtgggggttgcagtgagccgagatcgcgccattgcactccagcctgggcaactacagtgaaactccgtctcaaaaaaaaaaaaatattaagacaatacacagacagggaaacaaatgtacccgcaacggttctccagaccttaacactgctcagacgcacgctgcagggtgacatgcggaacgcattccaacctctgacttgctgcttattgtgtttgcctgcacattgcaaattcaactcggtgcgaagggagactgagtacaaatactcgtcactcccaagatcacctgaaagtcgggactgatccccacacagaaagatggcagataaaggcgctcagtcattctcactgaaagacagtgacccggctgcaatcttaactgtttccatctcccagggggtcaaaaacgcaaacaaaattagttgctcgtgtaggatgacaatttttaaaagtcacctgaacagaaagccacttgcacccctttagggccagtctgggggacaccggagggaatgaacgtgcgccacggctgccccggcgcccctcagcgccccacattccgcggggtctggcgagctccgcctcgcccacgcagccctcccggccaccgagcccggcgcggcctccgaagactccagaccccaggcgcccccgccagcccggccccgccgaggagccccggggcgcgttcccgagtccaccgcgcctcggtcgcctccaggaccgagacacgcggcgccgccagaaggctcacgagggcgcgggctgcggggcgcacgagggctcagtttccccgcctgcgccctgcccggcctcacctggcgcgcagccccaggcccagccccgttcagcagcggcgtccccccgccgggccgcgccgtcctccgcagcagcggcgccgcctcctcgtcgtcccggtcccggccggaccaggacaccttcttagagacgttggccatggcccgccgcggagcgacaccggccgggaagcgccggctgcccccgtgtttgttctcgtgacccgcgccggcggccacgtgacgcgcgacggggccacgtgatgagcgac

SEQ ID NO: 1634 - DNA, 30152 bp, Homo sapiens; identical to SEQ ID NO: 1633
  source 1..30152: mol_type = genomic DNA

SEQ ID NO: 1635 - DNA, 136039 bp, Homo sapiens
  source 1..136039: mol_type = genomic DNA
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtaaccggggctggcggggccggagtcacaggttcctgcggggctgagccgggccaggggcggcgtctgtcagggacccaccgcggtctccctcgtcccggcagcagagggaccgcgagtgaccccagacctgcgggctccgctgctctgcgggcgccgggggcggtgagaagggggagccccagcaacctccggaaaagcgaaggggtttcctgggtgttctctccacctgaaaaggtgccttcaaggctctctggatgggattggtgaacggtggtgcctcgagaagtgtcctccaaacacccctggaggcgtttggctgtgtgagctgggagagtggaggagagcacaagactggatatgaaacagatgcaaaagagcagattccaagataaggtagcgcaaatgggggtcgggagaccaagagagcagtggtagggataagggtgcatttccacggacaagtgacaacaattgcaataatttgcagcgcgaaagaactacctttgcccgtggctgaaatgaactcatatctactagtttttgttgagccaagcgctatgatttgtgggctcaggctgtatttctttagaagataaactgacagcatgctctcacaagtacctcctgaaacttaagttggactttacagctcctcacatacccagccatctcttctgtctctgtgggtcgctaggtaaattggtcatgacagtgtaacataaagaagaacatatgtcaaagttagagagttttataggtgaatatgtaggtaactgaaaataagctgtcgataacaatttgattccgatatgtaaaaaaataacattgcaatgtaatgaataagaaattagggctctggagactaccacttattagatagaaccactaaatgtgtgcatcatgatttgagtaagtcccttcactaatctcagcttctgtttaggaattaggaatcctgctgttaagtttctcatggttgttatttgaggactcagtgagagactccaggtaaagtcctttgcaaagagcctggcacttactctttcttaacaaatattaattttatcataaaatttatgaagtgtttaatgtgtctcatattgatatttattatatcatttaagactgctacttgctctgatatagataacatggccttcttttttggacagagttttgctctttttgcccaagctggagtgcaatgggcgcagtctcggctcactgcaacctctgcctcccgggttcaagcgattctcctgcctcagcctcccaagtagctgggattacaggcatgtgccaccacgcctggctaattttgtatttttattagagacggggtttctccatgttggtcaggctggtcttgaactcctgacctcaggtgatctgcccgcctcagcctcccaaagtgctgggattacaaggcgtgaaccactgcgcccggccacataaccttctttttaccatgaggaaaataaagcatggagagagtgcagctaggttgtcatataactagtaactggtggaactgtaatttgcatctgagtctgtgatttcattcgttcaacattactgattacttctttgaaccagaccttaggacatttcaaggctatagtctaaagaaactgcttcacttcatgggttttttttttctgtacagtaagtatttatagttgtaaacatatttttgcttcctctgaaatattaaattgaatttatataaatagttttactgtttttgtcaatccagccaatatttcaaaataacaaatagaaacatgaaagggtaagcctactagaatatacagtagtggaggtgtagaaatgtatatctgcagaatttagtgtacaatggggatgtcctgggcttggttctctgctctctcttccattcatgttttctctgtaagaaaaatcttgtactttcatggttttaagtagcaaaaagcatgattactctcaaatttataactctgtttctgacatctactgagctccagatttgtagaattagttgtctatactatacctccaattggatactgattgacgtcatagaacttaacatgggcggaactcttgatttttccctaaactggttccgctctcactaaagaacgtcaccatttacccagtcaagcaagaagcatatgaataattttggattcttgtcacttttttttttttttttttacatctcctgcaaatccacaaacatatcttataggttctactttgaagaatatttttggaatatcttttttttttttttgagaccaagtctcactctgtcgcccaggctggagtccaatggagagaacatggccttactgtagccttgatcttgctggctcaagcgatcctcctgccacagcctcccaggtagctgggtctacaggcacatgccaccatacctggctaattttttgatttttttatagagataggggtcttactatgttatgcaggctggtcttgaactggcatcaaactatcctcccaacttgacctcccaaactgctgggattacaggtgtaagccaccgtgccatattttggaatatctctttttcatttgtactactgccatcttggtctaagccactatcaaaccatactgggattatttttgttttttctcttacctacctcctttcttgtacccctttaccattcattttccttacaaagttggaataaacttttataaatataaatcgtattacattactcccctgcctaaaatcgtaataatttctcataacttcagtcatagtggccttccttctaccactttagggtctttgtactcattgtttgctctgtctgtggaaggctttgtccccatgactggctgttgcctacactgaggcctcagttcaaagtcacctcagagaggccttcccctttaagtttctccaagttctacttccagttattcagtttctagcctggaggattccagtacttattcttaaatagatcattccagagatagttaatgtgcacattatatatgtgtcaactaggtatacacaagtaagtatgcatgtatatattccttttaagtttttaactgttggtattacaactgtttctatgccttgatgtttcacttaacatatctcaaagcttatactacgtaagtgcataaagattttttttttgtgaatgagtatatcataatttatttaaccaatcccttttagatggacatttatattatttctagtctttgcaattcccaacaattctgcagtgaataatcttgtatatataacactatacacaagtaagtatacccttcttgtgttctggaaataagcatgcttcagtaatttgaaggtcattcaatatttttcggattggttaatgaaaataaatcatttgaaaatgatttcattacattttgtcttgagatttgaaaccatttaaaaattagttccagtaactgtcttctgttaccaattgtataggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggtatgtaaactcttttcatttagcatatattgagaacttactattacgcctggctctgtgctaagtatttttttgaattaggttgatatgtttgctatttgtatactatgcccaaatagaaagcttagctaatttctcttgctgcatctagatctttatttgtattaatgtgatttatgaatctgtgacttccacaaatattaattcttagaaagttaacattgttctagaagattatcttaggaattttagcttttttaacaaaaaaattaacatttccctgaatggctttccaatagaaatatcccctcattgcataaacctctcttggataacaacttctctactggagattaattagaattgagttacttttactatatcctaaaatatgaaaatttcagattaagatcagtaacttcaatgtattaataatgattcatcatacttgagagtgtagtccactcaccacagagtgaaaataaattttatgttattatatctttattatgtaatattttattagctgttttaatacattgtaatactaatatatttctatgtgagttatggaagtgttgcacatggtttcaatgagtgttcaataaaaataggttgtttttgacaccttggtaggtttttattgactgaagactaatactttggaaaggatttttttaaaaaaaattacattagagatggactcttgctatgttgcctgggctggagtgtagtggctgttcccaggtatgatcatagtacactacagcatcgaactcctgggctcacgcaattctcccacctcagtttcccaagtaactgggactacaggtgcctgccaccatgcctggctcttttaaacatcatttcctactaaaaggaacaatcttaccagtatcagaaagcaaagatgctatctgagactattggatacatgtcaaaaggactttggagctaatgtgaagaggattcttctactggccaaacataagactatttgaacatcaataagagtaactgcaattgaataacactagcaataaagggatattcagttttataaagcatttgctgttttcctgcggtcatattctctaaaaggaatggactattttctttacattttttctaacactagatgttattctttttaatcatttccaattttaaatatgggatctcttgtcatgccttgaccaaaaaaataaaaaattatgtaactaaaataaggatttagctaacagaagagaatcttcttcttgctgtatatatgatgtttgatgttacttttcttcttttcaggaacttgaaagcataagcgaagatgttcaagcaatgagcaactgttgtcaagatatgacaagtcgcctacaggtattatataatggctagattttggcatagttcctgatataaacttacaaaaattattattgacaaaatgtgtagatatctaatccataatgccctgtaggaaatttgggtataaatataatccttatttttaaaaattgtagctatctttgtgtttctttggataatgatttattaatattgttcaattaactttagagcatttatattttggtctagccagtacagagctaactacgtagaattttgataaacctttcaattccgtaatattctagaaatctaggagtaatgattttttttagtaagaagccttaggaataatttcacactaaagctgtgcctgataaagacctagcttaattctgatttatgcataaccttaaaaaattctgggaaaatatgtatacttttaggtcttttaatgaaagcagtcctaaacttatagtttggtagcagaatcagcatttgacttaattaacctcattcatctaattttggaatagtacatagaacggtttcctcctaagggccaatcatgattatgtctactgccttcacattttaacagcgaatttatatctctaagtgtctcttggaacgattgacatcaacagtgattctaggaagaatcattaatgcatattctacagattaatcacaggctacttgcatcatcagtttgcaggatgagttaatttcttgtttctctaaaattttatcttttctggtcttgtctaaattttgatattcttactaatctatcagatattattggcatgtttattgtctcttagtccaatatttagatatttgttaatttgacaatatttaaataattatataatatatactaattattaatggccatttcacatttttggcatatatttactttattcctcagtggttgattttgtttgacccttctttttctttaactttatttccttttctcctcttttagcttccatgacgtaatgccttttctcaaattatactttataaggttttctatattgtacttttgtgttttttaaataacattatgctttgttatattagactactcagtttctgatctttagtgatagtatctcttattttttaatttgtatccttaattatgtttttatacttttcatcatagagagatttaaatataaaaagatcatagtatttttatttgtgctatttttcaaacagtttataaatattttaaattacaaccaaagtgtctctttctgttttgtcctttgtattttttttttttttttttgagacagagtctcgctgtatccttagtggcgtgatctcggctcatagcaacttccaccttctgagttcaaacaattctgcctcagcctcccaagtagctaggattacaggcgcctgacaccatgcctggctgatttttgtgtttttagtagacacaggatttcgccaggttgtccagggtggtctcgaactcctgacctcaagtgattcacctacctcggccttccaaagtgctgggattacagacatgagccaccatgcccggccagtcctttatattttctttgcacccacctcacatcctgttttttcttctgcagtggcatgggcctattttctttctttattcagatcaactttattgaggaataatttatgaatggtaataaactgcatccattcaaagtgttcaaattgataggcttggcatttttatatgcctgtgaaacaacaactataatcaagatacagaacatttttatcacatataaaagattgcctcatagctttctgattgaatatttaaaaatatttaatactgcctattgtttacatttgtttttgatccacatatcatttttaatagtaggaggtccatgattttgaaagttttgtttattccttaaaattttgcttaaagctaatttatttggatatagcactattggaattctaatagtatacattcataatatcaactctaatgtttttaagttattcataaagaaaagtgtttcttagagtatcctcactttccctttttcttatagaatgttgttataatgattcatttaattatttaatattttctgaaatgctttgactatggtaccttttagaaattattagaaaacatttaaaaatgtaatcagtcattttatatatgttaatatttattcctttgtggttttccttgcatatgtttaaataataaacatgcatttagatgcatatgtttattattaactcaaaaataatcatctttaacatttaagataaatggagattgaggttaatcttcattaatattattaaatattactttggaattcttaccatagtttataaatgaaaaaatcaggaaatatgcaaaaaaattagcaaattcttattatataacattgtgctaaattatcatatttcattgattaataaatggtgttgattgtaaggtgcaccctcaataacgactagcctaaaaagctagtaaaggttttttgatgttgattttgtgaagcattctttttttcagaaatattaaaatgtaaacatatctttgacttgaggggatactatattttaaaaattgcacaaggcaagactgtacaagggtggaaatggaactttagcatttaagaagtatgagcatttgaagaacttattggcagtctaataattctaaaagaatattttgggagctatcatgttgagctccattccttaaaagtcagtgaaatggctgggcgtggtggctcacacctgtaatctcagcattttgggaggctgaggcagaatgatcctttgtgaccagcctgggcaacatagcaagaccccatctctaccaaaaacttttaataagttagccaggcatggtggcacatgcctatagtcccagctattctagaggcttaggtgggaggattgcttgggcccaggaggtcaaggctgcagtgactcaagattgcaccaccatactccaggctgggtgacagagtgagaccctgcctctttaaaaaaaaaaaaaaaagataagggatatgcaaaattatctaggttcaaattgttttcttaaaaaatctatttcctgggaacatacactcaaaatagcttcatttgaggtggcaatcaggctctgttattgacagcatacctagaaagcaataagacagagaatttccctcacagtctgaaaactgagtttgtagaggattaggcctctaagaacccagaactggaggtgtctaggtctaaggcagctctagaaagaaaccgcagtagcagaagcttgactctttattgtggtattccaacatgaaaatgacccagtgtcttcaggtgtttgctctggtattttctctttaacagactgattcaccttctattttatgtgtttttctccactttactaatgacttaatttatgcatctttctggctcatttaatatttcttcaaggcacagaccttgtttctctacgtgcctcatgactacttctcttcttattgtttattgccttatttttgtaaatattccctagttcagatatttgagagagaatctcattgtcttttgtttaaagccacttcatgaatgttttctaatcttggataagatgcttttttaattgactttccacttttgatcaactctggcttagggaagggagaattgcttagaatgaaagttgattaggaacagccttgtgtcctttagatggggctagctctgatcctcaccaaaaacttatatggcaggtagtttgtatattacaactttcaaacttttacctccatcttatacatttctattgagctccacactagcatttcagtgacttagttaacaaccccatgtaaaggttgcatggtatctcagttcaacacgtccatacctgaagtcatgttcttcattcttaacttgtttttccagtgcttctgttgcactaaaaagcatcatgaactattaagttcctttgtcagtatctggatacctttttctttcttgtaagccttagcattatgtgtatattaagaactgagtgtgttcctccagtggatgagccttgaaacatctacgtatttcattttattgtgcttttgagttccatagagtgatctcatttgttttaagtctaaattgcagtaagtggtagtatttgttttctgaaatataataaaattggaatttacttatattagatatgtttataattttaggcagcaaaggaacagactcaagatttaatagtaaaaaccactaagcttcaatctgaaaggtaagtttttcttcatacaaccaccttttcaataatttggagattggagtcaaagaaaattatatataactccaaatcagaattaaagcagaataataaaaaacatggttcataaggtcctaaactattatattacccaatagtaacttaagcataaagacagtagtttaggagcaataaacttgacattgaggttgagagattattccttctttggaagagaggtgatgatgtatcgttattgtttgctgtggagttcagaaatgatgctttttaaaatgtaaatgttttcagatttttaatagttttattacttttttttcacaatcattgtcttttatttttaagctatgatatatcctctctggtataattaagagttaattgtataaattctccttgtagtttatacaataggtatactattggttgattgaatgaatgagtgagtgagtgaataaaggtgagtacagtctggatttgtgtaatgtgtggtgttcagtattgctaaaactcatagcaattatgctaaaactcattaactgcatctctcatgtgtggagtagtatagggggggagaagcattatattatgatgcagtatacttgtctcctgctcagtagttgggtacatcacttaaaccttttagtattctaggtatttcatcagtaatatggagatattaccactttaactgctgattttggggtaggtcagtatactatagtatagaccacaggttatcaaactatggccacaggccaaatccagctcaacacctgcttttgtaaatgcagctttattggaacacagctatggttgtgtttacatactgtctatggctgcttttaccctactgcagtagagtcgtgtggttacaacagagaccatatgtggcctacaaagcctaaaatatgtactatcaagatttttacagaaaaagtctgtgacttctgatccaactagtgtttttttgtagttcaggtcaagatcaatgggttgtaaattatgatttatcaatcattactactatttaaatcgatcatagctagccttaaaaaataaattagaatgaaataaaatagaaaatagtttgggtagctgggcatggtggtgcacacctgaagtcccagctattctggaggttgaggtgggaagatcatttgagcccaggagttcaaggttgcagtgggctatgatagtgccactgcactccagcctgggtgacagaaggagatcctgtctctaaaaaataaataagtaaaaatagtttgagtgaatattattttgtgaagcctttctttcagtttcagtaatggttttaaatggtttaatattatgggtcataatcaagagtttgaaaaacactgccctagaccaaaaatggcaagtacatgacccccaactccttagttttacatccactgatcttgacattcttttattttgagcccttaatccttcttaacacaattctcttcagactaagattgatgaatgggaaattataaagagtgcagaggtgtaaagttacttgtgtaaaaggatatcatgggtcttagggctacaaaggactcagagatcaactggaatgatccattgcagttaaaatggtaaccaatgtaacttacttttctgtcttataaaaacattgagaaaatgtgacaaaattagcaaaataaaatatatgtaccaatatcatctaaaaaatactatctttaatagcacaaaacaaagaaaacattttctttacacgtataggaagtacattattggatattggaacatgtaccttatcttagacctgtggctttcaaaccatagttcattgaacctcagggtttctttgcaagacgtagaaggataatggagttttggaggtcagattctctcaccctaattttagtgagagcagtttcacttttacttgtttaatatattaggattccatgtaagattttgtttgaaaaaagagtttgacagcaggaaaatataaaaatattgcacaattttaagactagttgaaaggtagaataccaaataaaatagtcttttgattttattcctcatgccagagaaaaatctttaaaaacaactaagtatcaaagctttataaaagcttaatcataatttcatgcatttaatcccctttttgtttactaactaccttctctttcactaaaaatccacttttacccgttgtgtgttttctacaagccaaaatgagagcaagttgatgttgtcctcagatttatagaattgcaaattgcctggatagaaattaaatttaggaagtctggccttaaattcccttttatcttgttgatattgtcattctgtattttatagctggataaatgatcatatcccccacattggtggttaattacttgatgttgacctataagtcagttttctagtacttttcagagcatcttcaatccaatccttttgtgtttaacatttaatcaaagactttagtgtatatatagacaacttacttggaaaattgtgaatgacacaaagtatggaatgttaagtgtaaggtatcaacagaatcaagcttttaagaaaaagtggggctgggcaagaggtgaataggatgataaagggtctcaaaaaatgatgtagggttgaaaaaaacagaattgtttatttagaagtataggactaagaaggacatgatggctgtcttcaaatatttgatgatctttcctgttttaaaaaaggctaaattttattatatattgctgctgagtttggaactgagttttaaaggagaaatttaggcaaattttgacttaacgataagcaagaattttctatcccttacaatttgaacaattcttcaaagctttttttttaaaatcactggaaatatttagtcttatgttaggtgtcattggagccatcttttatttcagttttcctttctggtcttttacattacgattcatgtatccacaccttatcacagtaaacataagagccaccaaggagcttgataaaatggcaagttttggcctccatcctcagagaatctgactgaaaaaagtaagcaactgtgtttttttgattaatgactcagtaaatcttgatttgggctcaggattcggcccttttaacaatatcccaggtatttttatgcagtggtccagagactataatttgaaacacctggccttagacaaaatattacttatatttttaattttttgtggaatgtccctctcccctaccttaattctctcatctcctaactggtaaactttgaaaaaacattttaactttttaaatgttaaactttatattttgagataattatagattcacatgcagttgtaagaaacaaggccgggcgccgtagctcacacctgtaatcccagcactttgggaggccgaggtgggcggatcacgaggtcaggagatcgagaccatcctggctaatgcggtgaaaccccatctctattaaaaatacaaaaaattagccgggcgtggtggcgggcacctgtagtcccagctactcaggaggctgaggcaggagaatggcatgaaccagggaggcagagcttgcagtgagctgagaacgcgccactgcactccagcctgggcgacagagcgagactccgtctcaaaaaaaaaaaaaaagaaaagaaaagaaacaatacagagatccaaggtagcctttaccttgtttctgccaaaggtaacattttacagaactatagtatggtaccacaactaggataatgaccttgatactatctacctgtcttattcagattttgcagttttactcgttggtgtatttatttttatacattttatcatttgtagattcctgaatgcgccaccatagtcacgatatagtacacagttccatcaccacaaatagtgtcctgttggtgggtggacagtgtgagaaaagttgcagactaagcccatgtgggagatggttgactctgcaaagcagccagctctgtgaggaaaggcagtgttaaatttctttatcagaattaagcctgtgccttcaccataaaattagattgcattttataacagttcttttgaaagaaaagtttcctagaaaaacacattccctgttagagaccttgacattaatttttctctaagttaatgctgaacacaaaaacaagcattactttaattgaaaattgtgattaaaactaagaggataacagatcaataatcctgtatgcaaagcctttttaaacttttcctgttctcagttaaatctttttgttttaatttttagtgtaataggtattacagttgtttgcaactaatcgttgatttgattgtctctgtttctcctaaactgtgagctccttgagaaaaatgacaatttcttattctcctttttgtatttgcagtgcctgctattttacagattcaataaataatttttgagtaaatgaatatggaaagcaactataatgttaggaaaggaacataaaactgaaaaataagcattgtattggagcttgtaatatggggctctaaataatgtatataggagacaatattagaacattgtgcttctgttcatgtgttctcaaaactatttaagcaaggtttatgtttattattttagtaagcctgtggaagtgttttggcctgatatgcttttgggaagtgaaaatttatgacattctggtatcccaagagctatagatatgatgtgccaagtgaacgtttgtgtgaatgtattttaggaaaattgcaaggcagaaattatgataacaggtctctgggggctggcagggagttgttttttcattttaaaatatctttttaacaagaaactttgttaaacaagcagttagctttagaaatagaaatctgtttctatatgggattatttgaataatacgatacttttattcagacaaatgtatgaatgatatgaatatttttccaactgagtgagaaggaagtcagtcgtcaggacagctgagatgctctaatagataaagcttaatgtagaattttattcacaggactgcaggttagcatttccccttaatagttcattggtagtcagacgatgggcttcactgataatcaggaaagactatatgtacatgaacatacctttgtatttttaaaatactactaaaatcactattatatttttattatctcttataaaggcccaccagccagaattctctctggactcagaaaaataatctctggagaatgtttatgtgtgtgtatttttttaagttcagtatgttaaaatggaaagaatataggacttaagacaaaaatctgaatcttaatcgaaaccttgggtaagagattattagatttttgattttgtacagttatttcttaacctcccttaacctaagtttctatgtctgaaagaaggaaggggaaaatatctatgtcatggggtttttgagataactaaattatttacgtaagttgctgaagacactgcatggcatacattaaagactgttgcccctccctagtcctccccttttattagacaaagaaatctatgtcactcatcttatttctatttttgctctgtcatctaggaagcttagagctattttgtgcttaattgcaatagctttcctcagatgtatgatttactttctcagcctttccctttatttcttactattttagtttttaatagttttaatttatttttattgcattgtaaactactttaactcaggttttgaaattggtagcataaaaatataaaactttatcttgcataaatggttttatattgcatgtaaaagtatattacagaagcgtatgtggcacattttctttcattacctaataaaaggttaggggaaaacaggggagcatcacatctcctttcttctttcttcttgtctcatttgtacatagtagcagctatccaaaaggaaatattgccagtgacatgcaggagcctgactgagataagctataacaactttatttcagtcacacatattggactggaaataaaaatttgggggtaaggcacagtatggcttatccatttcttgtgattatgatcatgctgtaagggaaatagtatgaggaaaaatttagaaataatctttggtttaagtattttaaaagttgggtttggagatggtatggatttttttaaatgaaaattttgtctgatcaaattttccccaccaatgaaaaagagcttttttttgcgtaacattttttccccaccaatacaaaagagcttttttttttcttcctttttttttgtgggcacgcttcatttaaagtggctattgctgtttatttcctgatttaactacatttatcaaccaggtagactttttctatattcttattcattctacctggaattccatttcccaaaattaatttgttgaaaactcatttgtcattttaggttccctgttgtttatgcccatcatatatttcaaaatattttacaaaacttaagaattttaggctatcatgtatgtgtatgtttgtgtcacacatgcatgtacatgttccttgagaatgtatatatgtatgtacctatatatgtttcaaagaaagtcttgcttactttaaaaaatacttcagcttataggaaatttatttcacctttgtactttacagttttattatatattttccatgttcagccaggaacctttactcagtcaccagaaaaaaaaataattagttccttctttgtactcccacaacacattattcttctagcacttattttctgccctatgatttctcaacagtgctggacgttatggtctttgactattttaactggatagcaaaggcagtgtattaatgctctttgtacccactcctttctacacagaaaacttttcaactgaatatgtctacatggttactttaacattttaaatagttacagctgacattgcctgttaatatttgagactcttactttataagagtaatagcaagtgtgcatatatacttaactaaatgttattaaggagtggaaagtatcaagctggaagaatgtattagatgccttttaagctgtattttgtacagttataataatacatgtaattgtaattcaaaaggtagatccttttttgtttattataaaaacatctttgttgagatataattcacatatcataaaattaaagtatatagtttattggttttagtatattcagagttgtgcaatcatcattatgatctgaattacaacattttcaccatcccagaaagaaaactcctgaccattagtagttatccagccttagtgaaccattaacctactttctgcctctctaaatttgcctattctgaatctttcatgcaaataagatcatacagtatgtggccctttttgactagctttttccacatagataaacacttttaagattcatccatgttactttaaccttttttatggctgaatagtattccattgtatagcaacaccacattttgttcacccgctcactagttgatagacatttgggttatttccactatttgactattgcaaataatgctggctgtaaatatttgtttacaagtttttgtgtgggcatgttttattcctcttaggtatatatttaggggtagaattgctgaatcatatatgataactctttaagtgtttgaggaactgccacactgttttccgaagaagctgcacagttttacatttccaaaagcagcatatgaggattccagtttctgtacatctttgtttttaatctgtcattttgatgatagccatgctactgggtgtgaagtactactcattgtggtttagatttgcattttcctaatgactaatgatgtcaagcatcttttttttgcttattggtatttgcatattttctttggagaaatgtctatttacgtcctttacccattttttaatttaggttatttgtgtttttatttattggttgtaaaagttctttatatgttctggatataggtttgttaacagatacattatttgcagccattttctcccattttttgggttatcttcacattcgtgatatcatttatagcacattttaaattttgatgtagctcgttttatcttttttgtcatttgtatgtgctttatttttcaatgtatttttgtattgaagttattttatctatttgttttaaaatactaagataaaaatttagaaatttatcaggttttgaaatcatggcatggtactggaaatgctgacaagaaaacaacctcattacaggattttatctctattgagttttaaccagtctttcaaaaacgtttaactttcagtttgatactttataaaaacttaaaatgaaaagtttcttctttttttctattttagaaccaaaaaaaattatagaaatactttttcttaaggattgtaaatgataagcagattctttaagatcctgtcaaacaggttatttcacttatctttccatcatatgaattaggtaaaaggaatcttttaagtgtaaaaaactgccttttctttcttaaatttttttgacataatgttaatataaatctattgtataaaatttaaggaaaactaaaatcatatataactctaccactcagatagaaccacaattaatattttggtatatttccttccagagtgagtatgtgtgtgtattgttaatattttacttttttcccttaatattttatgttcattttcctatgattttttatatcaagaggatcatttttggaagtgtcctgaaatataatgcctaaatttttctcaaaaaagattatcacaatttctacttccattctgtctattttattaaacccttatcagcattagatatcatctttaaaaactttgccaatgtagatgaaaaatattatcacaccattttattttttatttttatttttaattttttttaaattatactttaagttctagggtacatgtgtacaacgtgcaggtttgttacatatgtatacacgtgccatgttggtgtgctgcacccattaactcgtcatttacattaggtatatctccaaatgctatccctcccccctccccctaccccacgacaggccccggtatcacaccatttaatttacatatcatcgaatagtgatgaatcgacatgtttctcattttgttttgccatttatatttctttactttttttgttttggtttatatcttatgtccatttaaaaaattatttcgaaattatttggtgtaggtgaacctagaggtagaattaagatacgacagagataagttttcaagaaaaagaaaagtaccacaggattcataaatcatgttctgggctgatttgaaggaatcatgaaaattaagtagtccgtttattttaaatacttaggcagtatacgactggacatactgaaaattgatgtacatgtgtttatatacagtaattcccaaccttgtctatggttttgctttgtgtggtttccattacttatggtcaactgcagtctgaaagtaataaatggagaatttcagaaataagcaatttgtaagctttaaattatgtaccattttgagtagcatgatgaaatctcaagtggttggctcccactttggtgggacatcagtcatccctttttctaatgtgtgatgctatatacaccaccactcagtagtcacttagtagccgtctcagttatcagattgaaaaacagtacgtgtaggatttggtaccgtcagcagtttcaggcatccactggagggtcttggactatatcccccgaggataaggggggaccattgtaattacttcttaaaaataagtggggattcctatacatactttctcgcaactttttatacctataaaatgccttatggatcattttgttagtacatatagatctacctcagtttgatctattatgtatttttccatagtgtatatttcacatattattatttatttatataatatacagtgattgcacaaacataatcttaaatacgctagaagttataatttatatgttatgttaatatttatctcctatactttttacttagacattgaaagccctctaaaagttccatatgttgatgtaaagtaaggacaaggtctgtgtcataagtgccttttatcacactcgtctctggcataggccttatacattgtgagtctccaataatgttatttgaatgagtgaatattcccaaaccaaatcactggaccatctaacaataacttcctgtcagaatggttgtgaaaatttacctggaaagaatacatgtggtaaaactagagtaatatgataataaaaaatatattagaatttattgtcactacttttaaagttaccatcttgatatattaaactcttgttttagtactgtgcccattataaaaatatttttgcaccatctcttttgtagctatatatagagcctgtgtttctgtctttatctcatgattgatttttagatccacattatttggaatgaattgtaatgattaaggggtatgatcaaggtgggtagcatttgttttggttacaacaaaatgaaactataaactaaagagacaaattttcctttgtgcctaataaattgattctaaagatagatccaaaaaagctcccaaaaacattttatttcacatggttaatttgcatagtctcaaggaatttgatgaaattttataattactttaaattcttaatgataatgactggaacttttaaaaatataaaacaaaacctgttaaggtaactctttaagcttttaaaaattcatttttaatttataattgacatataatgattatatatatttatggggtacaatgtaatgtttcaaggtaattaccatatctatcactttaaacatttatcatttctttgtggtgacaatattcaaactcttcgctatcttgaaataccactgcattgttatttgctgtagtcaccctagtttgtaatagaacagtagaacttactcttcctaactgtaactttgtactcgttgaccaatctcttcctgtccccttctccccactatcttccccaacctctgataaccatgatctctcaccatacataaaaataaactctaaatggattaaagagtaaactatacgaccccaagttgtataactaccagaaaaaaaataggagaattgtttcatgaaattggactgggcaagaattttttgaataagacctcaaaagcacaggcaacaaagcaaaaataagataaatattaagataacttttagatatcaataataagatgattaagaacatgacatttaaatctgtgtatattcaattaggtgatttatcatttgaaataaacagatctttgctgccacctggaggatttttgcttgtaaatttctttattcagtaggagcattagcattcaactttgaatttaaaacctccatcccaaaggtgcaaataaaacagaggtggcagatgcattgtaccatctatacaaatagtgtttatgtttatctttgttcattcttatttgaattttgtttaattgtggaatattactattctctgaatattgctagtgaaatacttttataactttatttatatattttcagttctgagatacagaaaccaggaatgttgagtttctgttcaagtagtttgtgttcctaacttgcctgtgggtattgattcttctcagtcccataggtccttgagtgtgcctttttccgtcagctagtttagataggttgcactcatataatttaaaaggttgtttttattactatattttgtagaaaaagtggggaagaccaaagtggataagtgactagcaatttatggagaattaataaaggagttcttctataacataaaataaactaataaatttgatttttgatatgtacgtcatgtgaaaacttaaaaggcttaggaattgttttagtgactgaaaagaaattggttgaaaacaggaacatatttctctcttataaaagcatctagcaaactgcaaggtgaactatttaagtacttgtaagtggctgcaaatttgtaatgcagggaccatgcatggacttatttgttcttttgcgtaatgatcaactccatttattgtgtgcaagtatctgaaatagaacaatattagctaattttatcacctacatgtctgataaaattctaatatttgaggcagaaacaagacttttgaaaatattgagaacttttcatacctttgttttaaaaatttattatgtctgagatagaatttgttttaaagctatgcaactgtgtaagatgcttgatttttattgcttgttttgaaaattacagccaaaaattagagataagagctcaagttgcagatgccttcttatccaagttccaactgacttctgatgaaatgagtcttctccgaggtacaagagaaggacccattactgaggtatcctggctttctgttataatcatttaaagtttagtagttacagatattagagagaaattgcttttttgaagctttattttcccattaaaaaaagtttcatctgagaatatttttatgtttggaaatttaagatgtgtattttaattatatttttcaaagtaatacatgtactttttaaaaagagtcaaagttataaaaagaaaatctatgtcacctattttactcttcctcacctctaggtcttttgtcaaccattttcaatgttattaattgcttcttttgtaaattctatattctagatctatagttaaaaagaatatgctttgattatctatgttaactattttctattgattctctattgtgaaatgtgaggatttagccttctacccactctgtctcctcccccaacacagatagtacacacatatgttctctttatctccttcatacatcatagtacagttagaccacattttctattttcttttcctttttttttgagacagggtctcgctctgtcaacctggctggagtgcagtagcacgaacacagctcactgcagcctcaacctcccaggctcaagtgatcctctcatctcagcctcccaggtagctagggtatccaggcatgcaccaccactcctggctgattttttaattttaatttttagtagagataggatctcactgtgttgcccaggctggtcttaaactcctgagctcaagcgatgtgcctacctcggcctcccaaagtgctgggactataggtctgagccatagtacctacccacacatttttcattttcattacagtgacattacagtgattgcatgttctttcttttataactttgtgtctttccttgggttagaaatcacttgttttttcatctaattaattttttaagctattccattttttccaaactggctgacagaattatataacctctcaaaatgttaaataacaagaaaaagtttcgtttctttttttttccttgaagacattcaatttttccagaaaggaatcttttggtcttctcgctgggaagaactgtaaacttaagcctatcgtcatcattgtgggatcagagggcaagaagggttcttgaggtggggaagggttctcactgagtgtctctgagtaggtatcacttttactggcttggctaaaatggaaccagtcatttgggtgtagagaggtaaataggtgagagaattaatagagatattatgtattagtatgtactgccctcatgttttgaggaactttgcacatatgaaatatttgacatatcattttttctccccttggtagaaattagaaaatgagggttattattattattattattttaagttttattcatcaaagaaaaataacacatccgttatttttcgtgggtggaacactatttgtggcactctgaaacctaagcctccagtacatttaaatatcaatcaacagtttggcatctgtcacctcctatatatttaactttgcattctactcttggacgagggagcaataatgagtatacaacagatacataaaacatcatcttcagcaataagaatgccaggcttaagtaataaggtgtgtaatacacaatactttttttcatgtagtaatttttagttttgcatttctcactagactacgtacacttcttgaggacagggatttttgtctttataaattttattttcctggcaactgtcaacactatttggcacatagtagaaactgaattaatatattaatatgtcttaaaatgtgaataaataccagttacaccgtctatgaaaacttagagaaagttgagatcagtataggaaggcttccctaaaataggtgaaagagtttgtttgcccttggtagtgacctttcagttttaaataatgcaattttgcctgaagcatggacataaagtcacattcttaattttaaaggattttttcaaggcactgggaagagtaaaacagattcataatgatgtcaaagttctcttgcgtacaaatcaacaaacggcagggtgagtaactgctcactgaactaattgcattgctgcttatgtttccaaaattttaaagatattctagattgtttgtgaactatatagcattttgtgaaatagaagtttaatctttatttatctttagagaatggtgaagttatactctgacaggtttaggctaaaacagcagttgataaataagtgatggttaaaatgtgacatttatttaattgtagaaaattattgaaaaatcatcccataaaatgataaaaagttaatatgctgtaatatgtaatatgcaaacaaaataattaggtgcttagatgtatctgttgactaaagtttaaattataatcattaatttttttttagtttagaaattatggaacagatggccttacttcaagaaacggcttatgaaagactttaccgatgggctcaaagtaagtgatttcttttatgttgtctagattcatgaacatttgtagttgttttttaaaattttacttggtctttatttgatatattttgattttagtaatcaaacattttttaaaaataaaaatagtatttgtatttggtttttaaatttttacttggtctttgatgcattttgatttagtaatcaaaaatattttaaaaaagaaaaacaaacttcacatttgagcacactgttttttgtgtttgtatcatgagcaccagctatcagccaagcagtatgcttgattaagtgtgagaataaaacaatgaagacagtttctgccctagattattttaaagcagattaggtatctcttgttgtttacataactgtaaagttgtaagtggtaaactgattttctgctgttgctgtaacaaattattacaaactgagtggcttaaaacaacacatatttgttgccttacacttctgtaggtcagaaatcagatgtggttctcactatgctaaaatctaaatgttggtagacctgcatttgtttctgtaggctttaagggataatgtttccttgctcattcagttagttggcagaattcagttccttgtgtttgcagcactgaggtctgtgtttccttgctggctgtcactgagggtttttcccagtttctagaggctgcctgcattcttcggcttgcggccccttcctccatcttccaagccagcaatgtcaggtcattttctcatgttgattctaccctgcctcatcttctatctcatatctctaacttttctgccagccacttccattgtgaggcctgtgtgattaccttggacccacttgggtaatctgagaaaatctctccattttgaggtctactgccttaatttcatttacaaagtcccttttgccatgtaaggtaacatattcacagtttccagggattaggatgcagacatctttggagggccattattttgcctaccaggaatgctttatttgctttagttttgtttgaaaatgtttcaatagattttttgcagaatagcctgttaaaaccagagaagatatttaaaacaagcaagcatggaacaggagcacatattttaataggtgttaccaactgactgttggaaggggttggaattaaatttggttaaccagctactcctgtactatgctgcgcaaatggaattctctgatctggttggttaagtctttatctctaaaacctgtttgtttttctacctctctccttctttacattgtttgcttccatctggagtgttgtctgcctttctctcattgcatctcattgtatttttttcatgtatgtcttatctcactagttttctacttcctcaaaggcatggacattgactcaaatttttttgtgctcccgcaacatcttacatagtggttcccaactgtgggctctgtcttgtggagactatgaagtcattttaaggtgtcttcaattctctatgcatattttgttttcagtcagtgcatgctagaaagtatactgctagtgtgaagtccttgtgtaccaaaggttgggaatttctgagaagttctaaattctttgaatatactaggcacttgtgagcattttatagataaaattagaataataaagaaaagttggtgtagaaatttttaagagtttaaaattcaaactcttttgaaattatatcactatatattagttaaccacattaacaattttagcaaactgtttaaagattgcttcccagcgaaggaactgataatatctttttagtactcctccctgcctccctaatactgtcatgtatatggcagttattaggaaatacttgttcactggttggtttcttcaggactctatagtgttttataataataaaatacagctttggggcatacctgatagcatatgtggtcatttaaagttatataactacttaagcttaactttttagtttggttgacagcataaattcatttttgattggtgtattctctaggtttttctgaggatttttttttatggggtgtttgccatagaatttagactcctggaatgcaacagacataataaacatctaagctgaatttaacaaaagttataatgttaattatttttcaggtgaatgcagaacattgacacaagaatcatgtgacgtatctccagtattgacacaggcaatggaagccctgcaggacagacctgtcttatataagttggtgactttttcttaattaaaaatgaaagcctacttttcttttgatatcttactttaaattttagtattatcaaaagcgtatataatagtttgagtaatatttataataatttacaacaatactgttcaccttaacttgaatttgtttcatggggtatcagcttatttgaattttacatactatagaatacaatatggaaagagaaaccaaagtgtctctgtatctagactacctcttacttatatagaggttcagtgacttttcccctgtcgtctcattaactcccttagaattgtaagtaactaaaactcctgtatgaatacttccctacagagactgaagtcatatcagtactgagaaatatggttatgcagagatgaaaaaagaatatttaatatcaaggtaatctgttaataggatttaggaggagagggcccaggtctttgatcctgtaattgatgccaaacaagagctatgtggtaatgttttggataagaatttaatgcattttgtatttgttgatatgttttttattattttatattttaattttattcttttaatttttataaaataaaaggtaaatactttctttaatgcctggagtagtattagcataagctttaggtagatgtaggggttgatgatattaataattctgaaaacaggaaacgaggggactcttaccaaggtagtgcatcctgctttgaatcatccctttcagaatctgtttatactatttttagaggacctccccattactttctgattggaacactacttatcctatcatcaggtcacagaacacaaatgctgaacagctgtgtaaaataataacaccccagtgttacttactgagtactatgtgttaagcaccattttaaattctagaaacacaacgtcagtaaagcactgccctcaaactgctttattttatggaaccagagataaacaaacgcattttaattgaatacactaattgatagtctagaagtcatgtgccagatgctgtgtggctcaagtattctggtgtaggggaaagagatgagcatcagtgaaagtttcctaaggaattaggtataaagtgagttctgaaggctgaataggcattttcctagaagtaaaggaagaacagtttgcaggttgagggaacagtaatgcaaagatatacattgagagataatgcacctttgggaaattaattgtaaaagcttgcactggctattgaattaggagcaacagctggatcataatagccctgaatgttgtgcatatacataagataagttaatgtttaccattgatcagcagcttaacagtttattcctgctttaaaatttctttcccaactttttcactttaacatattgacattaattatgagtcttttagcacttaaaacatttggcgtttgattttaacagctgttgcattgtctacagattaatatttattcacaaggttaatcttttatgtattaaaaaaaaaaagcctttctgtgttttgggcacctttgtttgttttcaacagctgacttctgccatgcaaataaattttcactgagttatagttctttatcaaaacttggaaaggagcaatattaaatggctataaggtgggttcttgagtcaaatttctttgagaagtccgtgtacctttataagcttgtttccttagctgtaaaatgaggataataatagtgcctattttacagggttgatgtgaagattaagttagattgttcacttaaggcacttagtgtaatgcttggtacatcactaaattttagatattatttttattttgagaggagatgactagaaagttttcaactaaggagggatgtatctgagggctacatggcaatctgggaaaaagcttgaaagataaagaatggaactataataggcaaagaaggtttatctgtgaagggcatatgctaagaagcagggggcagtaatggcaatttggaagatttttttttttttttttttttttttgagacggagtctagctgtcgcccaggctggagtgcagtgacgcaatctcggctcactgcaggctccgccccctggggttcacgccattctcctgcctcagcctcccgagtagctgggactacaggcgcccgccacctcgcccggctaattttttgtattttttagtagagacggggtttcaccgtgttagccaggatggtctcgatctcctgacctcgtgatccacccgcctcggcctcccaaagtgctgggattacaggcgtgagccaccgcgcctggccaatttggaagattttaagacacatttagaagttgagtaggaaagtaagtttttaagaccagatgattagaacaagatgaatgctaaaaaagagaaaattggcctttcattaagtaattattttcaaagtggtagtttccttacatttagggaaaacttaataatgtatcatgttaaccaccagatggcactatatgaacttaataagtaatgtataaaagtttcactgtccattattgtgtctcaaataatgtaagtattatatacaagaaaaatgtcaattattgaaatccgtggggaaagttgccatactcagtgtttcttatgtggtgtataactggaatgctaatgcattattgacttttaataataaatcatgtacaattataaatgaagtgaaaaaatttgataatttattttctttggtaagcctttagaatataagttattttaaaatgtagtaatacatacaatgctgatttttcttccttctttatgtatttgttgtgtttcaaagaggcacttctttactattatcttttaatttgctttttgataaaaatttttcttcttttaatttgctttttgaccagaatttctttaactgtagctaaacacaatttttaaaatgagacttttaattttaacttgaggtatttgagaatatttacataatttgaacattcactctgaaaaagctccattttgatttttgattattgttggaagaatgtctgattttggtcaaagactttttcttctgtctctgggaaggatgtttcatgtctaaagatattgaaggttcacgtggcttatgctgtttttgctttaaattatatttgttctataggaggattgacattaatattaatgtttattgatattttatagtattgaacagatgaaattccagtgtttgccaggcttggtaatttaccccctatttaaaatacactggattttaagattcactggattctgttacagctgtcgtcccagtggacagtcctagaaacaaattatgctgtttatttttaatatagttagtagggtcttgggaatgaggattagctatatatacttaaaaagttaaacgtttgtgaattttatgctgtgataagcagtcataagttcattatttcagagaatcaggtgatcatttaaaagaaggcattcttcacactaaatggattaataatttaagagcatgagggaaaaaatagcaatgagcattttggttctaatttgtttaaaaaatagtaaatgcaaggcaattatgcaatttagcaaaacttagctggatattgcacttccccttttctgtagtatgtcaccacagggaatctcaaaaccatttctttttaatggaagacaaacccacaaagaaccatagtctggttaatagtaaacagtcctcaaaaaaggttcatattcctaaatatttatagctatttgccagttctacagactttctctttgatttggaaataaaccgtctttcacatgtttaccaaaatgtggatttttcatccaattaacagcatatgaaagaaagctatgtagcctaagatattaattattttgggtatcttgggaagttttggtaatttttgtttatatataggttattgacataattcttaaaatttagtatggtagaatactgtttagagatttaaaagttagtctagaatctgctgacatcaagactgctaaaatatattttgtttttctttatacttttaaaatggaaagaactttcaattgagggatggatgtcaggaatggtggtgataatggaaaacaaggctgagtcaagtcaaagaaatgggcactccagagagctccaggccatttttataaattgaatcccaaattgtcctattccccagttaaaagctttccttccctaccagttccttcaccttagaaagcctttccatgccttttcaattataataggtgacttcttaatacatgttttttaaaaaggtatttgcttgtatatgtgtttggtcagtaaatttaaggaacatctgttatgtctaatattggagtcaaaataagcttttaaagatggatagcaatttttggagcaaattttggtgatagattgtgatagtatgtgtaaagaagacttttttaatgtagaagagaaaaatgtcaattttgggattgcagaattcttttattttttctgagacagggtcttgctctgtggctcaggctggagtatagtggagcagtcactgctaactgcagcctgaacctcacgggctcaagtgatccccctacctcagccttccgagtagctgggactataggcatgcaccaccatgcctggctattttttttttttaataatgagaaagggtttcattattttgcccaggctggtctcaaactcctgggctccagtgaccaccttcctcggcctcctaaagtgctaggattgcaggtgtgaaccaccgcacccagccttggatttgcagagttctaattataatcagtttttgagaactgttatggctttacgtaaaacagtagagcatcatgttttagactgcaaatatgtatactgaaatataccgaaacctagtatagtgaatatactgaaacctaaaaagttaagtcttcccaccttggcttgattttcctacttttactaagtccattgctttatcccttattactgctgcctctgctttagtcccaaatcccagcattgtttcttaggaggggtaaaagtttttactttttgattgaattttcaatgagctgaagttatctcttaaatatttttttcttgtttgaaagcaatgttgcttgaccgaatatctaaaggagctttaagtgctttttaagtacttggttgtctcagaaattgcgtgaatagtctgatatagccactagaaacaaccccaaccattttttatataacttgtttcttctagatataccttagatgaatttggaacagccagaagaagtacagttgttcgtggatttattgatgcgctcacaagagggggccccggaggtacacctagaccaattgaaatgcattctcatgaccctttgaggtatagtaatcagacagcagaagaggagttgatgtttttccaaaggaaatcttcattaacatttagttttcattaggtatgtaggagatatgttggcttggctccatcaagctactgcttctgaaaaggaacaccttgaagctctcttaaagcatgtaactacacaaggtgggtccaccaattgtattgctaatgcctaaatatagaaaataacacaagcatctctgtttctgttcttgttgccatcttcttcacttagataaacaccttgatggtacaataagcatcctgattactctttctcttctctagattctccctcattctgctaatagactttctcttccatcacctttgtcctgtcactcaactgttcagttttatagtgaaacctagtgacctttcatatcaaacctagactcctctgtgtcacttttaagaaatttctggaatatttagcatacattttctcaaatcctctgcatgacactttaaaggtacagggtgatattatcttaattttatctgtgtgtaaacaggctgagtgacttgttttaggtctttaagctactaattctttcatttctgctacccagcctcttttttcattctcatggcactgttttaaaattttaagacaattatcatatctgttagtatgtttctgcattgctataaaggaacacctgaagattggtaacctataaagaggtttaatttgactcacggttctgcaggcagtagaggaagcatgatgccaacatctgcttctggtgaaggcctcaggaagcatagagtcatggtggaaggcaaaaggggaagagccagcatgtcacatggtgattgagggagcaagacagagagatgggagagatggggaggtgccacacacttttaagcaacgctgactattgtgaggacagcaccaagccattcatgagagatgcactcccatagcccaaacatctcccacaggcccccacctccgacattggggattacatttcaacttgaatttagaggggacaaacatccaaactacatcaccatatgtactaaatgtacttaaaatttttgtcttgatgtcaaggaagaaaaataactgtagttgagagttgctgatgtcttgtttacagaattccaaatcttcttagttgtgattacctaaagaggcctgttttagagtttgagggtttagtgtatgattttaaagtgttctatttttggtaggaagttaagagagacactgtggcttggtatcacttgactattttacatagctcagccacacatctctgtggttcacattatctgcaagatgagtcagtgttacaaattggtggtaatactaactttatagcttctaactcttcagtatcaagattagactcagcatatatgttagattggcacaaagtgtgcatcgttaggttctctttctgttattattctccttacccagtttaaataaatgtgtttccttaaagatgttttagaaaagtataaggcagtattaaggaagtaaatagactgtagttagttgaagtaggttattctacatgaatgacttcaatcttctgggcctcagtttttccatctgtgaaaatgaaggtgattacaagcagtaaatgtcaaatacccagtacagagtttgataaatagttggtgttttgaaaataccagtttttctgaaagatttcaaggtatatttttcatctttataccctcagtgtatgtgctaagcagcactgcctggaacaagatgtttgtaaaacaaatgctaatacatcttggcatcacttcattcaattaatacatttcaccctctttttttcctctgtcttataactttaatctttttcacaaagaaatatttattttattaactcaaagtcagatgaattaacaaggctttctagacacattaggtattatcacaattaatatgttaacacaattagtaatgtcccaagagatatcaaacttactaaaatattgttatggttattttaaaagtcattagtgccattaattatatgtattatatattatttgttagttttttgaacttatatgaagcaaagtataatatggaaacaaatattaattatgtagtcattaattttaggtgttgaagaaaatattcaagaagttgttgggcatatcactgaaggtgtgtgcaggcctctaaaggtaaaatattttgtttttacatatgctatatggtacctgcttaaattattaccttatttatagaaacttaagaaactgataccagctcaaatacaatctataattttttcaaattagcacactaatgtagactaataagaaacattttaaaataataattgccagttttctctctgagaaagaaaattggaaatatttgtagtttgcatatattgacctattttttacagattatatttcctgtagtaatttttcttattcaattgagaaaaaaatctattaaatttaaacagcgaatctatgaactcttaacagagagatttactaagaatattttgtttacttgattgcttcaagcatagaagagtttttgcttgtcatagcaataaataatgattaatccaaggataaaataatgtgtattggtattatcatcaatactgtttatagtgcaaggaacagaatttggaatcaaatttgagttagaattcccatattgccacttaattgtgtttacttattgcatccgcttaactcttctgcacctgaattatgctctggtgggacctgtatattaaaacacctatcatccagggttgttgtgaggatgactgtgtagatgaagtacatagtttatgacactaagtatttagcagatggtaaatacctttattttcctttattaatatttagagaatacttggcaattgttggtttacttttccttgtaaaccaacttcattgattgactttaatttcatacatagaaattgaaatccagaagtttagtaattaatttttcaagaaatgaactttaaaattaattttattttatttctaaggtttttgtttttttggtatatgcttcaggcaaggaaatctcagatgacacacttggtgacaattgattatattgacaaatttaactgttactctaacttgatctcataggacctaactgtatattcagtaaataaatggctaagtatcttgaaattattttacttatttctcccaaatgaaatatttacttgtcatagtttgatgtagacatatataacttatataaatgttgtttattttgtatactggcagttactggaaaggtagaagaagaggaggaataaaatgaaatttattttgctatgcttttatacctttttataacttcatatagttaaattaaactcctagtcactttgataagtaaattttactttatctgccttaccttccccccttccttgcttatgtaattatgtttctttttacaatttttctaatttttgtgggtacatagtaggtgtatgcttttccttttctttttaaaaagtaattttataaatactataattttagaatctaagggttataatggacttttcagtttcctgtcctggtttgagtaagaattattatattaaaaatgtttaaactaatccagccacttgtataaagactttatatactgaagtctgcctttgttttaaaatgtacttagaaattctcacttcatcttcctttaatgtacatacccagaaagatctttatggcaattgtaggacattattgtgatctgctggcaaatttaaatgtaagatgccaaaggtaaagaagacactagtaagcagacaagcatctttttgttgtaaaatgaagaaaaattccttttctgaaatggcagaaacttcaaatctttccatatgatgataatatgtattgcatccagagaatatttagcaggtgttcacaatagttacgtatcaaattagcttgatagtgatatgtaatccagcaactctcataccttcccttccttatatactgatagacagtgttacagtattttaagaattttttttctgtatgaccttatttgagtatcttatgttttcagtgagatagttgttagttgaggaaaaaaatttcgactttaattatttttttttgcaattataattctgaaattttctagtgatcaatctgctcttgtaatcccactcatacaaaatttcttcttcctaattgataagcaactaaactttttctaatgacatatgatattggatgttatggctacttttctgtccatcattattctttgtagatatgaattttttttggaataagagattttgatttttagaaacataaaaggttatagtggtaatgggagataatccttgagaaactatatatttgatttattctaccttgtttaatcttttctttgtcttagtaaagtgaaacatcataggtagtagattaaatatttgtaaatgtatgcattaagataagatctgtaaacctattgccagtttaaagaatctgtgctctaagtttaagattgcatatgttgtgtagggggtaccgtggctcatcagcatcaaccctattactttgtacatgtctttattccaaaactgtagctagaaagaccagaactaatatattaaattttttttttaagcccatgggtataaaatccttcttttatgtgaatgttttagattgctgagagattaccagctatcatttgaattttctcttttaataaaaactttagtgtagtgtatgctacagaccttagattatggtgggttctatgaaagcaggtatatgtaaaagatcaatgacatggaaaataaagctgaatattgtacacaatatagtcattggaccctcagattgaggtatacataggaacagatgtctaccctgagcagctgtctgtgatattaaggtaaaataggtttgtcatcatcttttttagtcctcccttcttcctgtgtccccttcatgaacacaaacccactctctttctcttgctctcgcttttgctctagctttctctctggccttggagaggagagccactgttctgtcttttagctcttccctaccttctctgctgtcagggtgcctgaagctcattttgctacttttaatatctctgcctttatggttgatgctgcttctcgtaatgcagttaggatttattgagtgcttatgatgtgccagggtctgttccaacatactttatatctgagccattattcccgttgctgctttccagctctgctaatgatttttccctccactgtcatcacagtgataatttccagtcagttgctgctaccaccactcctttaagtctctttgacctttttttactttttacttttcgtttctcttgtcctttgttgtttctcctgtgactgttgggttttgctgaaaatggttaccctcttatatagctctcataagacagagtgtttatttctgtgtggcaaacaaagcattcttggtgtattatttgtcagtctcctgattttccagcctttctctgttgtattttgtattgtagctgttgtattctttattgccactttccctcaaaacctttatattcatggagagagttggaaattgtttttgttttttcttcctttctccctcctttccctctttgcttttcctttctttctttctctcccctcttttctctctttcttaagggagtcagaactaagaatattttcttgatgcctcaaaattctggaaggcagctggccggatagctgagatgttgtttaaaatctgctagtaaagagctgtttgcctacaactaacattttttatattttgctgtaataattatattaaaattaagaaaatatcacttttattgatgtaatgtataatttaagtcactgttaaggccttgatttaaaaataaatcatggaaaaatatattttttaagttcaaatgccattcatgatccatggtattgtgttaattagatagtctatcacctataccaacagatcaatttcataaacatattaatgtaaaggtaaattgatttctgtaatctaagaggttttcatatgcagatataaaatctcattttagcaaatcacatttgttttatgacatatgccaaaatctaaatacagagaaagttcagtttttaaaagcatatattaaacatctgttgtgtgtatactgttctaccagatgctacagagatgtaaaataggcagaagacataatgtctatactgtatttgtattagaaactagttaggaaagcaagaagatagaatgtaagcagtagcttaaggacagatacaatatttaagtaagcatttatcagtgtagtttagattgtattcattaatgagataatataaaagaaggatcagtgagggatggaatttaattagaaaagattcatatttcctaaatcttgaggcaaatcaaattaatcttgaactagatctgatttttccctggtagtcttataatttggcaaatatgttggtgctaattcaagatttgcctagttttctattctttgattaatagacaaacgatataataatttatagactggaatttattttatttttttcttgaatatttagcaataaagcattatgttttcattgataatctgttttagggatgtaacagttgccttttcaatttcatattgaaccaaattccattatatactggtgataaatctcaaatgatctcaatgtattgacatttctggtaacaactgccttgaaccaaattctgcaaataatgggtcagatttttgtagagtatatctctgttaaaatgtttgttactttaccatcttctatgacttactactcagaaattatttaggaggcattttgtgatctctgcagtaataaaattttatctttgttatgctattcataccatatgttattaatgaaaaaaagttatacttttaagaaatgtttactttcctctcacatattttaataggttcgaattgagcaagtaatagttgctgaacctggggcagttttattatataaaatttctaatctcctcaaattttatcaccatacaatcaggtaagtagaatggcaaaatgtgcttgctaaatccaatgtgatatttctttcagttagagcacagtataagatttttttttatattgtgtatagtaattatacactaagtatagactaagcgtaactagtaggacttccacaccatgtaaatcattatatgcatattatacatgctatgccttaaggtctattatttcctttctccttttttctccaagcttaactacacgcacacacacacacacacacacacacacacacacaccccttatatagcaatataagtctataatgtaagtctttattgagtcttcctgcattggtaaaagacatccaaggcaactaaagcaactataccttatactcacaatagagcatagtgaatgaaatgttctattctggatgtaaataacctaccatgtactcacaatagggcatagtgaatgaaatgttctattctggatgtaaataacctaaattctttagcatttagtttactataagtgataaaatagagtcatagctttatcttctctacataacagcaactttatctgattaggaaccacttgtcttatataaaatgtgatctttgactccaaaatatgcattcatttttgctttacttacgtgttttggtggtatacccgtgagttttattataactctcactgtaagactgttatatatgtagttatgttaaaacaatgtctttccaagccatatttttgatagtttttgtatttttccattaaataattatttaaaagttatttgttatgcagtatgccagtatcaggaatagtaggccaactgttaaaaatctaagaaggatgtaactaacattaccaggaaaggttcagggagcactagtttacagagtaccaaaaaactgtggtaaggttatcacctaccccttagtgacagagagtagccacccagaacttaacagctagggaatggatttcacatcttactagtagattttcaaacaaaactaacaagtcatagtctacaaaactgatcagagataggatttggattagtcccttaatattttagatataaacttgttgtcatcattcccataattcaaaagcaatgaattagtttcagttgtaatattatagcatcctgtaataagagaatgataaatacttagaaaacacaagggcagctgaaagctagacatagcaaatgctgtgttataaaaagatgctggtaaaataatttttaaaattgtttatttaataatgtccatgatgggactacatgaaatttattatttaaagatattgatatcttagtttctaatgtagaaaatgctggaaataaaataattcagattctgaagatgataataggtttttttaggctctgagaattataatttttctatctttgaagatgatattgaagatgacaattaaaatctttttttattgattgcatgtactttgtctacttgttcacacatttcctcatttagtcaattaaacagttgactgtatacttgtcattcttctaggtggtaaggaaacagtaattaacaaaacagagcttaaacttacattgtagtaggggagacaagcaagtacaaaataataattttaggtagtggtaagggtactgaagaaaaagcaggaaaaaggaagtagaaagtataggcagtgatcatacatgagaagatatatgtgtgtgtgactgtttttgaggccattcgatagaggtgatatttgaatatggatgtgaataatatgaaggagttgggcatgaaaagatcatggagaagagtgtccaggacaaaaatacactctggtgctgaagctaggaaaagcttgcattttggaggactagaaagaaaaccaggaattggagtgtagtgaattggaaggagtagggggagatgaaatcagaaaggtagagagaggccagctcacacaggattttgaaggcgatagtggatatttcgattttatactgagtggataagattggggaaaatgtgagggttttgagtgacctgagcagatttgtgttataaggttactctggatattctgtgaatcatgtagtgtagtgagacaaaagggaaaataaggaagatatttagaaagcagtttgtgctcctgagaagagatgatgatgtttagactagggtgatggtcttagaaatggtaaacagtagttgattttggagataatttatgtcacagccaataggacatgtatacatactagatagagtgaggtatgaggagtcaaggatgaatttttggcttttggtttgaacagctgggtgaatggtattgtttgctgagatagggaatgctggaaaggaactggttgatgggagtggtgggtaatgaagagttccgttcagttttggccttgtcagatttgatgtatctgtgaatatacaggagattttgagtgatcaaataatacagagagaaatcagggctgaagctaaaaatgtcttagttttcagaaaacagatgacacaatgccatgggagtaggtaagatcacttaagaaatgagtatagataaagaatggttgctaaggactgagtcctgggaaactccaatattttgagtcaagaagaggagaaacgacaaaactgggaaggaatagtggtgaagttggggaagaagcaggacgcatgcaagatctcaaaaaatttacctctcatacattaaaactcctaacaaaaggaagatatagaatccaggaaacagggactcgagcatgcttggattatatatcctttcctgcaaaacttttctccctggaattaataaacacttggcttttgtacttgtttactttcctatgcccttatcactattttggatccaagctatttaagagaactcaacattgcattgtctcaccatgtagtccaacaagtaatccgcctctctcctgcccctatctgatacccttcttggagccctcattcccctccagtctagatgtgttgccctttaggcctactgcaagctgcttggctgtcacactgggatttatcttcttcactagcctgttcactggcttgttttgggtatccctgattctttggtcagctctgaatagtatttacatgagtgtaatgatgtaaatattgaatagttatttaccagaactctgtgcccatggctatattaggaagcctggggaaggtgaagtttgggtgtgttgtggtggaggaggagaactgtataagagagtttaactctcatcttctacatcagggaatttgtagataatacctaaaactgaaaaatcaagtaatgggagtataggcatgttggatagaaatatggaatgaaatgtcagaagaaacatctacaattatctgtaccagttactggaacataatgagtgttcaataaacgttagtaaattctagatctgaataactgcaaagtacagctgataactccatattaaaaaaaaaaatgaatgtaaatgtatgttgagttctctccaaatttttcattaaattgtttccatttgttttcatttaatttgcttcctctgttgcttgatgtacacttttattcagagaaatacttgttttcattgcatgtgcaggcatgtgtgggaattctatccagtttattttagtatttggcatacaatatttttaactaaaatacttattgtttctttaaaatataagtattatggctactggtttagtaatttgctagtattttgctgtttgctatatatatatgcactttactaataatttacattgttttcatgaactatgtaagaatttacctaatttattttggtttcggaattgtactgaaatattacatttgcaaatattagtatttgcttttataatacatgtggtatatgatttatcagtaaacttgctgtgttttagcttactgtttagtagtatttaatgccattatattcatctttaacaatctaaaattttttaggcatggaagatgttgttatgcctttagaaattataattccttactggattacagcatattttcataaccacatgaaacttttcccctagaaggttgttaaaatcacttttagtatgtgaattaggaggaaaaaaatgggaattgttttatatacatacttgtcttagatcttggcaaaaatgggaaacctccttgaatgggtctaagaaatagccttatacaatagcaaattgaggattatggaatgtactaatgtaattagccatttcaaaatgctatcagacttttcaattagtctaaatatactgctctgtaggcagctgtataaaaattgagaaactgatttataggtgtgttattgatatagtataacagttttaattaaaagaataactcagtatttatacaatttaaatattttatcaatagagctgttgattcagtgctcttcttaaaattaaaattaactgtcttagataattgagatatatatttactctaatagaggaaaaatagagatagggttttatatatcacaaatatctgttctgacccacggttttgctaaaagagattgtgaaatattgaaaacatagtagtttgtttttattttttcatcacctaactcaaaagaaaaacaaaaatcctgatttttaaaatatgaaactagagtatttttaattcacaggttatattttacataaaaacttttatttaaatctagatccttttaaagcattctactcagttaaggaactgttttgtttcagtttctgttttgcaacctgaaatattctttgcttttagtggtattgttggaaatagtgcaactgcattattgactaccattgaagaaatgcatttgctaagcaaaaaaatattcttcaatagcttgagtcttcatgcaagtaaattaatggacaaggtatgtttgaaaaatgtaattattaaattatgtgaatgtttcacattaaagatgttttagtgatttttgtattgattgataacttttcccattacattctgtgttcttttgagttcttcctgtcaccaacaactttcattttgagatggcttactggacctaagttgatagtctttgttcctgaaacagtataacattgagttataattggagatggcatctcaggctccaattttactaccatttttttctatcacagaagttgtataattaaagcaaacttactgtatttagctgggggctaagatgacatacagattggaaaaccagaactcttacaaaatattttttccaaacagcttatatttttacccctgttgttacagttttgtccttatgaaatgtatgctcctctgagttatataattatttatgaaaacaaacaaggaaaaacatcccacaaaaaaacaaacaacaaaatcctcaaagagtcctgtaagatctaatatcttaaattgagcagggtattttggcaggaccttaaggaatagacttacaatgatcaaatccttctttatttttgtttcattattgagaacatgagtttttcaaggatgtgtcacaatcaccatgctggctttttaattgtactactctatctaataggctagctatattaggcccagattttgtaatatggtataaaatagtcagtagcaatttagtccagaatacgtggtcaatcttcactttcctaagttcagtcttcactttcctaagccttaataggagtctacttcctgacccacatgcatgactcagattcatttggaaaagcaacatgaatttgtggagctggaatatctacctttatttttcttgccttgtgtatttctgtttgcatcaacagtttactaacaatcatttctggttatatttgttattatgagttcttatttagacagaactcttctaaaataatttatacatgatacacaaacattaaacatgaacaaatatgtgctagctgttgagagtacaaggatgaacactcaacatctgttggcctcattaaggttgcttttcctttagtggaaaatgaccaaataagtctggttattatagaattctatgatttatgaaagacatgtgcctagggtatatgctagcaccaaaggaggagtatatttagcaaacttatctgtactcctttacagagaggaagctttccatagagagatgtaatggagttgaactttgaagaacaggtaggctttagataggtgaggaaaggagtgcatagaggtcatcttaaatagaagaaagaaatagaatatgctagaacatgagtatgagttacctataaaagaatttttcatttattaaaaaatatcacttgtaaagtgatgtgttttatatatataagtggggaggctaggttggaaataggaaaattaaaggagtattgaaactgtttttattcatacatgatctaagggaaagactctgggaataggcaagaggggacagattcatgaagggtaaaggtaaaatcttcaaaacttgatgactgaatgtgggttagtgagagggagtcatctagaataattcctaggctaatcacaaatatctagaatgcagaaagagggtacaatttgggagataaagatggtatcatctaagttagataagttgagtttgaggtgcctatgagagatccctctggaattggtctaatctaaaagggagtgatacatttggatttagagagttttacatataagagatagttgaattcatgggtttggatgaagtcactaggaataattttttttatgagtagagctaccaggacacagtcttgggaaacactgacgtttaagagaaggaaaaacgtcaacagtatgatgctgagagaggatggccagagaggcaggacaaaaattaggataaggttttatcagaaaagccaagagaagacagtttctagaaggagggcatggttaataatgacagatgcttttaaagagttcaagtaggaggcttgttatctttggcaatatatatgtgataggtgacctaaatgggcaattttagtcctgtggtggagataggagccaggttgtagtacgtagaaaagttcatgggtaagcatattacccaaagctttaccaattagaaaacatatgggcctcaagactgaaaatagatgcattaggcgtttgtattaaaaaatttgaaacagagcaataaaatgaagatatatggaaaggatggaattaaatttccgtgacaaattagaaaacaaaagcagaattatttgttgaaaagataaacaaaattgacaaacttctagcaagtctaatcaagaaaaaaagaaaattagaagtttttagaaattagagacaatccacagatgagaattaaaacttagagagtaccatgtgcagttttgtgctaatcatctgaaaatcagaataagatgaatgctttttaaggtgacataaattggtaaaatgtgagtcaaaaggaagtggaaagtgtgaatatacctaaggaaggaagaaaagttattaaagaacgtgttgccaggcctagttcagattatatagagaacttcattcatccttaggaggaacagataattctccagaacatgaaaaaatatggaaagcttcccagtttgttttaggtagtataacaccgacataaaaccttttaaagatagtcagtagtggaaaccatagattagtcactttttaagttttaaaacttcaaaattcagcatttatatattaaaaccaagaatggtttattacatgaatataagaatgtttcagtgttaggaaatatactaaatgagtatataaaataaattttatattctcatatttgatcacattggggaaaatcttaatattaaaacaagtcattgatgaatacttccttaaccatataaagagagataaaactaacagccaacatcataattaatattgacacactagtggttcttctatttaagtgaagaacaagaatgcttgccaatacttttaaataataaccacggtagaaagatgagataaagaaatgaattgtaaatattttaaaggaggagacattagattatttatggatgttatgatagtctattttgaagacctaggagaatcaactaaaaagctatacaaccagaaaatgaattctagtgaagtcgttggtgaaaagatcaatatacaaatgtaattaattttcttatataccagctcatgaggtgctcaataaatactggtaacatgaatggttcagttcattttctgctggcctatattccatcactatcttgccattagctttaaatctcttgcacccttgccattttaccacattcactttgcaaaaccaccttgagttaattcaatttttcaatttttcctgagctctgctaaagaaaattacatcatacagacaggaatcactaaaaattgtctccaacatcaggaaagccccccaggaggtccagcaaatactgattgtcctttggcagccactcacatttacctcacttattttcacccatttcctcaaatctaccatactacctcctactgaaaaagtgccaactcttgctaaaactggataatggacattaaaaaaaaatctttaccaacatgacgagcaaaagcgacattttgttgtttttctcatttggatttctgtgattctagtgagaatgaacattttaagatatgtttttggctgtttgtgaattgcttgttcaagtcctttgccattttcctattgggttgtcttgttcatttctgatattctttatgcattaagaatattaactccatcatatatattacagacattttctccacgttatcatttgcctttaaaatttgcctgtagtattttctgacacatcaacttttaatttttttatagttcaatagaactttttttatagtttttttcccttgggagcattccatgcttgaaagtattcccacaagaaaaaacatttagaatttaatatataataaagatagcatctattagtggggaaatgatagattgtttaatacatttatttagatgtattttcttaggtgtttctatgttttcactttatttatttttttaagcaacagggtcttactgttgttgcccaggatcgtagctcactgcagccttgaagctcaagccatccttctgcctcagccttccaagtagctgggactataggtgcatgccaccatgcccagctaatttaaatttttttttttttctgtagagacatggtctcactatgttgcccaggcttgtctcaaactactggcctcaggtgatcctcctgcctcagcctcccaaagtgcaggaattacaggtgtgagccatcacacctggccctagccctggtttcacttttgcaacaaatttttaatctactgaagtttattattgttcagactgaaaacttagtatcttattctttcccaagtggttatccatttattttattttattcccctaatagtaagtttctatatattttattagtcatgtaaaagttaaaatgaaagttgcaacaaaacaggaaaacatacagttgactcctgaacaacatgggagttatgatgctgacccctgtgaagttgaaaaaatctgcgtgtgactttcgactctcaaaatctaactgctaattagctattgactggatgccttgctaataacataagcagtcaactcattttttgttgtatgtattatacactgtattcttacaataaagtaagctagtgaaaggaaaatgttattaagaaaatcataagggagagaaaatatatctactattcattaaatggaagtgaatcatcataaaggtctttatcctcattgtcttcacattgagtaggctgaggaggaggaagaagagagactggtcttgctgtctcagagagtagcagagggagaagacaatctatgtaaatgtggacctttgtggtttaaacatgtgttgtttaagggtcatctgtaatggatagtaaaaggcaactgaaggatgacatcttccaattaaaactttgaacagaataggatgaaaatgaggaaagaaagtaattgtaatctgaatttattaattaccaatcaatattgcagcttatatgagtttatagcagtgaatgggctctgatcattattgttgttgtttttgttgtcattattactaattgaaccctggatgtttttctcagatatgaactgggccatatttagagttatttttacattagattgcgaccgtgttatgattctctttacaactcatatgttgcttgtatctacaaccatttcaggttttttgcaagaatatcttcctttcatcaaattttaatgttccataattttatattagttatatcttttacttattctgcttcttgtaaatgatttcacttcctctaaaaacactgtagctttatgaagaaaacaatatttattgtagcatgttcttcattagcaaagcacccaagtggaaatttttgttaatagaattttaagtgaatagtataattgttggaaagaatagcttttaaaataaaggtatagccagagaggaatttttaaaaatatgattgcttttgtgcttttaaaaagacatacttgggagctaattctttatctagcgtgagaaaaaggaaattcaaggacataattttattgaaagatgtaccttttccctaacaaagcagtttgaagcacttgagtattcaagtaggcatactcccttccttatcaagctctcctgaaatattcataactgcaaatctagtgaagtttaaagagaatatgcatctatactgcaaaagacacaatgttgtgtcaatttaggctagactgacattttctaaaattatttctcactatagtaatagtgcagttctaattgcaaggatatagcctgtcttaaatgaaacccatatcaagttaatagtagtcaggattgatttgcccagtcctctggagaaaaaaaaacaaaccccaaatgattctttaaataaattgtcatttaaattctaggatatggttactgctttgaatctctttttactactcatagcatagtatgtggattagcagcttgggcatcatatgggaacttactagacatgcagatatctcaggtcctgctccagacctactgaattgaattatgcattttaataagattcccaggaggttcatgtgctcattatagtttgagaggtgctgttctggttgaatagtttgagttttacattattccttacagatgattctgccaggaaaaacaaacagaaaaccaaattttttttatctgaaatgctttaatatttaaaaaaataaaagtgtgtaaaataagttgtaatttgaaattatttcaaacatgttagtttgcagtcctaaatttatcttggacaattttattgacttaaaaacttaaattccacatattgtcaattactagaatgtatgtatttagagcaaaaggaatgtatatatttatatatatgtatatacacacacacttcttttatatatatactcctttatatatatatatactcctttatatatatatatactcctttatatatatatatatatatatatttaaatatatatagagagagaatgaggaaattagtttaaaaatatgagaactttgtgtttggttggctagtctttattttttgaaagcaaatgggcgaagggccttctaagaagctacacaacagaaaattataggaccttaaatggaagatagctgaaagaataaaactaaagttggtagtgggatgaagttgtaggaacagcttttggaatttttatggtgcaacctttttatttttctctagtaaaagtcagagcacctaaactacagaagggataaaaagtaaatagtcacaagaacaatgaggacttttgtgtatagctctacacatttaaaaaaagagaggttctaatatatggaatatgaagttttcaatagcttaaatgctttttttaaaaaaattattgattgattaattgattgggtcagagtctgtctctgtcgtccaggctggagttcagtggtgtgatctcggctcactgcaacctcctcctcctgggttcaagcgattctcctgcctcagcctcccgagtagctggggttacaggcatccgccaccatctccaactaatttttgtatttttagtagagacagggtttcaccatgttggccagactggccttgatttcctggtctcaagcaatccacccacctcagcctcccaaagtgctgatattacaggcatgagccaccatgcctggcctttaaatgcttttaaatgtgaaatttttctgtatacttcaactttgtcacttagaaaatattcaaattttgaaataagtatttaataataatgacttgatgtttagtatgtacaataatataaagaagaagaagaacaaatgagctcacttttttttttttttgagacagagtctcgctctgtcaccaggctggagtgtaatgcacaatctctctgctcactgcagcttctgcctcccgggttcaagtgattctcctgcctcagcctcctgagtagctgggactacaggcatgcaccaccacacccagctaatttttgtatttttagtagagacggggtttcaccatgttggccaggatggtctctatctcttgacctcatgatccgcccgcctcagccttccaaagtgctgggattacaggcatgagccactgcacccagccaagctttatttttaactgcagatatagtacccaagtctaaagtatacagttagttgaatgtttgtatttgcatatgctcattagctatcacccagataagatataaaacatttctagcccttcagaaggcatcctctttccccttcccagtcaatatctaaccccggtgtaaactgctgtctgactactgtctcttgttttgcctgctattaacttcatgtaaatagattcatacagtgtatacttttttggccctgacttaacatatctgtaagattcatatattttgcatgttcagtagttcattttttaattgttgtgtagtaatttcattatatatattcaccacaatttactcattctgttactgatggacatttgggatgtttctagttcttggatattgtaaataaagctattattaatagtcttatacatgtgttggtggacataagtttttatttctcttgtatgtatgcccagaaatggaatatctggattataagattgattagctttactagatattgctaagtatttttccaaagtaattgtcctagatcacttcaccagaaatgtgggagtttcagttgttccacattctctccagtacgtgatgttgttagtctttttaattttaggcattgtagaaagtgtgtggtggtatttcatttgcttgtagtttgcatttttctcaagattaatggtgatgaacaatttttcatgtttattggctgctggatgtactttcttttgaagttgtcttttaaagactgttgcagagagtccttactgggttgttacctttttcttattgacttataagagttttcaaacatgtgtttggatacaagtcctttatggaataataagcatcacagatattttctatcactttttgaactgtcttttcactctcttagtcatgtattagattaacagaaattctcaatttttaattcagtcttgtataacaagcttttatttcatgattagttccttttgtgtcctgtttaagaaatctttggctatctcaaggtcatgaggacattcttctgtatttttctctaagaagcttgattattttagcttccacatttaggccttcaatccatctcaaatttttgagtatggtatgaaggtaggggtcaagtttaatttgtgtgtgtgtgtgttgtttaaattactttattttccttgctttcaatttttcttgcctttggccttgatccgtgtcgtaatgtctggtaaaatataacaatacctaataccatgttctcatagtaggtcttcaacagatgtttgatagattgaaaaactagaagagccttagaagctaatcttctcagtcatctttgtccttagctacatatgtatttcttaggttacctgagacttttatgtttttttccagttaagttgatatttaataattggttgtcttagtaccagtagtgtagttgcaggtggtttttgtgctgcgatgcaggtatagcctttcttaaattaaagattcagtctgagtttgttggggatacttatctcgggtgagcaattgatggggctccgcattagaaaggcaatatatggctcaaggagaaatcctgggctttggagtctgatagagctgtactcaaattctaacttttccaatcattatgactttcagtaagttgtcactatgtaattgagtttttactaaatgtaaaacaaagaattacggcacagtcaacgtagattaacctgccctaggtcacatagtcactaagggtgaatatatatccaggtctgcctaattgctaagcctgtgcctacttcctggtggatgttccatacataatagttccttttaacattttccttttatttatttttaatttttataaatttatgagatactaatgcagtcatgttacatttatatattatgtaatggtgaagtctgggcttttagtgtaatcatcacctgagtactgtatattgcacccagtaggtaatttctcatcccccattcccctcccaccctcccaacctgtctgagtctccattgtctattattctactctgtgtccatgtgtacacattatttagctcccacttataagaacatgcaatatttgactttgtttatttcacctaagattatggcctgaagttccactcatgttgttgcaaaagaaatgatttcattctttttcatggctgaatagtattccatggtgtgagtgtatgtgtatatatatgtgtgtgtgtatatgtgtggtgtgtgtgtatatgtgatatgtaacacatatatgtgtgtgtccacaaatatatatgtgttatatgtacacacacaccacattttctttatccagtcatctgttgatgggcacttaggttgattccgtatcttcgctattgtgcatattttcatgtggatatacacttgatccagcaccatttattgtaaaggccatccattcccactgcagtgaagtggaaatggtcataaattacatgaccatgtatgtggatttgtttggtaattgtgtattccattgatttattttagattatttatttattccattgatttcattttatttagaatcaacttgtgcatttttaaaataaaaaagctttctgaggctttgattaaatctatagatcagttgaggagaaattaatatcttaatgataccaagatttccaatttatgaatatcatatatctctccatttacttaggtctttagtttctctcactaacctttcatagtgttcaggccttgcacatctttggttagatttattcccagatattgagtggtttttttgatgcttttgaaacttatttttctctttaaattttattttacacatatgtatttctagtatagagttgattttgatcgttgattctgtttccacatacctttaaggcagtttgtttttgagtgcaagagtaagccattgaagatttggtctcacatcttcatttttgaaagcattttaaaaatatcattgggactgctgtatggagaatggaaagtgggtatggaggagcaaatttggaagaaaggagaccacttaggagactcttagagtaagtaaacctggcaaaagtggcctactatagagtagtagcataggatgatttggatcatttgcatttggaatatattttaatggtttagagataattcagtaaattaaatgagggaaatgaagaaaagaaaaaaatcaacaaatacttttcggttgttgatctgattaattggatatcattaatgcttaaatacccccatttaatgtttgtaaaataaaaagtgataactattgttcctactcccttttgtatttcatacaaactctaagttctttagaagatttttcttttttaaatagggcagtgaagacattagctggttcttttctttttttttttgacattagcttttgtttttgacgaaagaaaaattttaactttaccatataatgctaatttctgtcttttaaaaaatattaacttataaaacagcatatctaattttacttttgtttaagattacattggagcccatgagtgggcttctattaatctataattgtttctgtaattttccatgtttatcttttttttttgagaaacaaatggtaaactcaatgatattcttaaagaagtctgccttcctcctccacctgtaacatgtaagaatcaccggtttgaaaagtttaaagcatatgagtcacaaggatataaaattagctagcaaaatttcaatgtagcaaaacatttaggaagaaaggatgcgttatgtaaacttgaagaaggcctcaaataggttgtaagatactggggccattagtgctcatagacttcaatgtggtcacgatcttaagaaacagctgttaatagcaccttatcatagattccctacagaagaatctaagagctacagcatcctctctgaaaaaattaactttatagaattcaagtaaaaatatcacctatgaaaatcaaaattaacacttcggtgtagtggttataagcgtgacctttggagtcaatgcttgggtgagagtctaagctctgccccttctaagaacagtgggacctttggaaggttatttaatctgtccctactttagtttcctcatatataaaatttgatattattccttcctcctccttctcatcagtcttactcatcttctgtaaaatgggaatgatatataccttaggctcattaggattaaatgaagatcacatgtaaaatacatggtacagtttttagattattttttcacattacaaaatactcattttgaagatagaaatataaagaaagtttaaacatgactataggtaacattcagcatttttaatatttcagtcttttaaaaatatgagtgtacacacacctgtacacatgatgtgcatacagttttgtctttgtttttgtttttgagattgagtctcgctctgtggcccaggctggagtacagtggtgcaatctcacctcactacaacctccacctcctgggttcaagcgattctccagcttcagcctcccgagtggctacgattacaggtatgcgccaccatgcccagctaatttttgtatttttagtagagacggggtttcgccatattggccaggttggtctcgaactcctgacctcaggcgatctgcccgcctcggcctcccagtgctgagactacaggcgtgagtcaccatgcccagccctgatgtgtatcttgcatttttcatttaacatattattggggcttaataaaatcttaattcttttttttggaaacatctttaatactgtacttatggatcccattcttccacgtagaagccagttttagatgaattattttagttcattttccctattaaatagcatttataatgccaaaatattccctcataatactgttggaacatgtctgttgtccagaggcttattaagaaatgacttactgtttagtcccttggtatttcaaaacaattgattaaatatgtagtggtatatgtatatgttttatgttgtaactatgctgcaggaacataaattgaatgtaagtgaccatagtcaacagtttttattgatatccattatgcttaaaacattgtgaaagatagagcagttaagaagatatgtgcctgaaataaggagtctaatctgtttgaagtagacgttctcacatgtcattttagtagccttgtactttggatttaaaaacaagcaaagatgtttgcttattgtccctaagggagtatgctttgaatataaccagttattttgtatccattcattcacatgaacctacttaggttagtggaacataaccatggtataggtatttggaagtaatgtggccatgtttgcaacaaagcttacctgcccgagcaagtacttgcatgcctgctgtagatactcagcgaagtgtcatgtggccaacgtcaggttacaactctagttaagatttttgagagtttaagatcatgacaaaaatagagggaaaagtcaaacatacagaataagaaagagggaaatctttatttgtaaggcaaaagttcacattttcttcaactttctgtcagtatgtaagatttctatgaatagctcaagtcctggcataagtagcagtgataatattaacacctctttctcccagtcacatcattctgaggatgcatctgccactcacttactgatgctgactggtttccaaggaagtggagtgtgaataaacttggattttctacacagcttaaagcttataggaatttctgtattatgattattgttttacatgaagttcataaattgtttgtttctaatggttgctactacctgttttaggctctctaaataacaaagcccacttaattctagtatttggcctccacagccttatatggagatatgaaagacatagtaaagagggtctcttccctaagggagattatggttagtataaagtaagtgcaagaatgcattggagggacttcaaaagaaatatagacttggccaggtgcggtggctcacgcctgtaatcccaggactttgggaggtcaaggcgggtggatcacgaggtcaagagatcaaaaccatcctggctaacaaggtgaaaccccgtctctactaaaaatacaaaaaaattagccgggcatggtggcaggcgcctgtagtcccagctactcgggaggccaaggcaggagaatggcatgaacctgggaggtggagcttgcagtgagccgagatcatgccactgcactccagcctaggcaacagagtgagactccatctcaaaaaaaaagaaaaagaaatatagacttgtctcttacaaagtttaaccattagaaatgaattttacaaaatgaaactaaagtgacaaaagtgagctatttctcctccttagattttctttctgttattctgctacaggattttatagtcacaaagtttgtttatctgaaaaactgccataattttcacttagctttagaagtgtggttcttaccttgttgccgatctaatggatgtgtgtaaaaacacctcatagaatggcagtttgttgaatgacttgagttcaagtagcactcacttgcaatgatttaccatcaactctaactgtggcaaagtgtgactttagccttaaatttaaactccttaaagaccttatttcaagggggaaaaaaatttcctttcaactttctcccatcagtgtgtaagttttacatcattggtcttctgttttgtttggcaattaaaaatctcttgtgttaatttttgaaagtttttttttttaagatttattgcttccaagtgcaacaaaaataaaaataaataaatgggatctaattaaactaaaatgcttctgtatagccaaagaaataaccatcagaggaaacacacaacccacagagaaaatatttgcaaactacgtatctgaaaaaggactgatatccagaatagaaggaacacaaacaaatcagcaagaaaaaaacaaataatcccatcaaaaagtgggcaaatgagatgaacagccatttctcaaaagaagatatacagatggctaacaaacatatgaaaaatgctcaacatcactaatcaaggaaatgcaaattaaaaccacagtgagacaccaccttactcttgtaagaatggccattattaaaaagtgaaaaaaaaaaccatattgatgtggatatggtgaaagggaatgcttatatactgctggtgggaatgtaaattagtacaacctctatggaaaacagtaggaagatttcttaaagaactaaaagatctaccattcaatccagcaatcccactactgggtatctacccaaaggaatagtagtcattatatcaaaaagacacttgcacacatgtgtttattgcagcacggttgcagttgtaaagatatggaaccagcctaagtgcccatcaactaatcagtcgataaagaaattgcaacaacttgaatggagcaggaggccattattctaagtgaagcaactcaggaataggaagccaaaaactgtatgttcttacttgtaagtgggagctaagctatgggtacacaaaggcacacagagtgatataatgtactatggagactcagaagggggagaggatgaggagtgagggatgaaaaattacatattgggcacgatatacactacttggatgatgggtgcactaaaatctcagacttcgccacagtacaatcatccatgtaactagaaaccacttgtacaccaaaagctgttaaaatttaaaaaaaaatttttaaagatttattgcttccaaaagacactatatactcctctctctctctctctatacacacacacacacacacaaacacacacatactatatattatagtttataacctagaagagaaaattacacattaaacatttaggttcttaatcatacaaggtttgtagttctactagagctgtactcctcatctagcttccctggaggatttattagatttttttttctgtttatgaaaggtattgggaactgacacataacgtgtttgctctggtttctatagctgtctatttctatattatagctattagaatgctagcagatctttctgatttgttctaagctaaagattccactgaaaaaaatttgagtatcttcagtttatatttcttatgtatatgcatgcacatatatggaatagctttatatttaaatttttggaattatgagtatgttgatttctattaaatgtatatttatttttaaaaacaaatggaaacacaagaaaataacactcatctacatcctgtcaccctgaattgactgttattaactgcttggtagttggttgtttcttttagggggcagagatcactctattaattttgtaaaactgatatgcatatatttatacataatttaaaccatggagaagagcacaaagatgaaaatttttaaaaaaccctcttcttggaaataacattagttaactttattataatcagtttaacaacagtctggatatcatttgaagtaggaatgataaatagaatacttttgtgaagaaaagatcatattctggaggttttttttaagttcacatttatttgaatctaatgaaagaaaaggagacaaaactgaagaaactgtggaacttgaaatatgtatctcttcacccaagaaatattttccttcaattttgtaagttttggctttatgtgttttggggcttttttgttgggtgcatatatgtttataattattttattttcttgatggattgacccttttatcattatcagaatcttttatttctagtaattttgttttaaagtctgttttgtctgatattagtatattagtgtagctaatttaatctagctttctttcagttattgtttgcaacgtatatctttttatatccttgtacatctaatttatttttgtcttaaaagtgtgtctcttgaagttggcatatagttggtacatggtgtggtttttcaaattaatctgctagtctctgctttttgattgtcatgtttaatccatttacacttaatttaattgagggtagagtaggatttatgtctgcaatttgcccttttgttttctgtatgtcttaagtgatttttttttctctgtgtccctgttacttcttttacactgagtagatactttctagtctactaatttaattcccttatttaaacatatatgtatgtgggtatagggttagttatatttcctgagtggtgccctgggaattacaattagcatcttaatttataacaacatactttgaatagtatacaaaaactttgctcctacatagctccattctcctcttcctttatgccgttattaatacagttaaatcttattacattgtatgcccatcaacatagacttataattattgcctcatgcagttttcttttaaattagagttatgaacaaaaaatacattaaaactgtcttttatagttatctttgttggagtcttgaccagtgctctatttctttatgtggatcgagttactttctagtgtccagttttccttagtatgtcttgtagggcaggtatgctagtgaagaatttttgcctttatttggagtgtcttaatttcccccttactcttgaagaatagttttgctgaatttgaaatacttggttgacagtttatttcagcctgtgactatgtcatccaatatgcagacttctggcctgcatgttttctggtaagaaatcagctattgatcttgtcaaaaatccttgttcatagtgagttatttctttttagttgctttcaggattatctgtcttttgacagtttgattatgatgtgtgttactgtaggtctcttgagtttatctttcttgggggtcagttagcttcttggatgttgattaatgttttttaaagtcaaaattggtaatctttctgtcattgtttcttcactgcctttttttctttgttctttccttctgggcttcccctttatacttatattgttaaatggtgtcttatctctgatgttctgttcattttttcaattctttttctttctatttctcagactcaataatctttaagttcctgtctttaagttcgctgattatttattccacctgctcaaatctgctgtaaggccaagcacagcagttcacacctgtaatgatagcattttgggaggctaaggcaggaggatcacttgagcccaggagtttgagaccagcctgggcaacatagcaagactaccatctctacaaaaaagaaaattagcgaggcttggtggcatgtgcctgtagtcctagctgttaatacttgggaaactgaggtgggatgatcactcgagcatgcagtgagctgtgattgcaccactgcactttatcctgagtgacagagaaagaccctgtcaaaaacaaaaaacaaaaacaaaaacaaaaccctatagttaatttttcatttcagttgtgtactttttgactccagaatttctctttggttgtattttattattcctgtctctttattgatattctttatttggtgagacattgttttcatactttagttcttcagacatgattttcttcagtctttgaacgtatctaaaatagcttgtttaaagtctttgtctagtaaatctaacatctggacttcagagaatgtttctgttgaggtgtttttctgtgcatgctgtgcatggactatattttcttgtttgcttgcatgttttatgatttttttgttcttgttgtttttatgaaggagagagtatttttggacatgcttactttgctattcctggtgatgtcacttatgtattaactttctacatgaaaccatcttataataaatgccgatatttgaaaattcttacacctttctgcctacctgccactaagatgtagtctcttacattgtcttctaagtgctatttttaaaaaatttacaaaatgttactttattaacattgtaagtattctgaaaatatttttaaagaaattcataggcacttctttttatgtatcatggtgccaccaaataaggatagtgaacttggcataccttctacttagtaagtgcaaggcatgttactcagccatgcaacaatctcatttaatatttacagagtccctctgaagctctgaaaacttaagtaacttgctgaagattacacaactagtaagtgatagatccaagatttgaacttaatgtgtttaactctagagcccaatatattaatggtaatgttatactgtttctgtgaagtgattttcaaaatgtgggacccatgggttaccttcttgagagactcctggggtgcttgttgaactgtcaattcctgaacccctaacctatacatattgaactaaaatctctgaaatttgggcctgagagtaggtgacgtttctcaattatattatagttggaatagtgctggtctatagactgcttttttcttatgatttgggctaaaaaataaaacagtaggccattttaaatccatattaaaatgtaattctacaattcaattgaacactaacttttcaaattaattttttgaattttagagtacaaggtgacatattctgagataatctgacaaagaacttttctctcactttgtgtgctgttaatatagttcaaagtaagctattgataaattataggtttctaatgtgtgagtctgtgctttataacttttacatttttttttactatgaacttacatttatacattaaaatttagtggaaaaaatataaggagtgggtaaatcatctcttgttttaggttgaactcccaccacctgatcttggaccaagttctgcactaaatcagacactcatgttgctgcgtgaagttttagcatctcacgattcttcagttgtaccattagatgctcgtcaagctgattttgtgcaggtatgttataaattcatttttaatgattgttttttgctcttctattgtacactgtgtttcaattctggaattttgtaattcatatactttgacagtctctttcttactgttaattttccatcaaatattaaaccagttatcataacttaaaaagcattgatttatgtttaatcttttcctacgtgcttctataaattggcttccttccaattagtttggcattaaatatcattaacccaagaccctatcagtgattgagaaataaagagttcattttatttttcatttgtaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcaggtaaatttttctataaaatgactattgactatgattgaatctttttctctatgtgatagctttaagttattggcttaactagttttaatgacctaattcctatagatcccttgatatcatctgatgaaaggacacacatgcatatacacaacacacgcacatacacaacacacacacacacacacacacacacacacacaaattcagtatttcagttttcagctttagaggaaccagaatgtgtaatgtttaaaatacttgattcataccataatatgtgatagtagattgaagctttctgattaatttgaacagttagtctgtatgtggattttagtttctgaactgtgaataatatgctatatttttcaagctgcatagttaatgcaaaatgtgttacagaggacagatatatttttatctatgtgtaaaccagtgttaggcaaaacattacaaattgctataccaaccacttgagttcttgagtcctataaagcaaatggttatcacttaagagagtatatgatgactaaaacaaagccagttgtaaaatttagtagatagttggattccagttttaagcagtgattattggtaaatatactgttttttaaaaaaacaactctgaatgttctgtgctatcacacatatatcaacagtttgacagtgggtataggaatgagttttgatatatctaaattcatattttctaatttttaattttttcttttaaaataaatgtatcagaattttccatatttgtggtttaaagtcaaataattctacagaacttgttacgaaaagccaccagtgtaccatcctctccacccccaacatctctttctcatttctccctcaaaagcacaatttctttcagtttttatagttgcttcttttggtatttatatttgtaattctaaacacttacgtgtattgctacttatagattttttttagttttttgtctaatgtattaaattagatatattctaatacattgtgaaatgaaatgaacaatgaaaatttagttatctactgccactcccccaacccccctggataagaatatggtcatacttaagagttttcccatcctcccaatgtagctatattataaattttggttagatcaatgttttgttaaattattattactatgtaaacattattggtgactgagccatgtaatgaagaatggttaatttacctttcttggataacttcttcattttctgtggaattaataacatttttatttaagaaatgtcacttttttatgtatttgtcactaattcaagcccaaatccctgccatttatctaaatcttaagatgttaagatatgtcaggtgtttatcaatttgctttattaccaattatctatgtttcttatgtgttccatagctattttacgcatggtaaaaattcttcttggtctatgtgctaaattaagcttattagtttattcaagttatctatgtccttgcttatttttgccaccattggatgtgtcaactggacttttacatgtgttttaacattctccagaaatctcttgagccagatctttattagtcctggcagcattttcagtaattgttctgtcagcagataattcaggttcccctttctccagactccagtagcaattttcccagtgccctttcagaccccactggcagtcccttgagtgggtattccaagtggacaaatcccagtgtggaagtgcttattggcctattcttgcattatgcttgtcagagtgctgtcagccaagactggccacatagaacagcctggattcggtgtgatagaggacaatacaaaggtgtggatatgtgaaggtgtggtttatcacgtttctccaaagtaacaatttaccttgttgggtaaaggagtcttgattttaggacctttactaccaataacctattatttttttcccactcttatatagcttcttccagtgtttcaagcaagaagtccaggctagtcagattctcttgtttttagtaatctagtcccttcatctggtaacttacagggattttccattgagtttatatgttttcccaggatatttttggtatgtctctttttaaaaattatttgcatcttggactttggagaaccatttcaatgtaaagattcaaacctttcttttgcttagtaaagagttctatttctttaatcatcacttttctatgtgttactttttatattttgaagcccctgtccttggttggttttatctcacggatctgccatctaatttctttttaaatctcttcactttaatctatttctttgatatttgctctgtattactttccttccatttttctttcagaccgctgatttgatgctttgcagtaactctttttcaccttcattgagtgtttacctttgcgcactttgtttttctttggtttctagtaaatccagcaagtaagggctctaattgtacttccttgggcatttatttaaaaaaaaaaaaaatgaaagtactttatgtctttcagtagtgttgcctcaggaaagaaaccatacttgttctgattattcacaagggctttcttttagcttcctcacctcttttaaatcagttctaagttttttagggggacgagcagagctattggagttgcttggaaaatggcaatcatttagatggtaacagataccatagttgacagtgtactatgtcattagcaagcaaactggtaaaatctgggggaacattctggtgaggaatagaaggaagacctctagactcaggattgtactggcacaaaaaaaaaaaaaaaaagaacaagattttttctcaccagggaatgtttcaacccatcaaggtagttctcttctgtggtttttatctccattagcattagttggaatcccccaaaatagcacaaagctggggagcccatactactcacatctgttagctgcatcttcttaggcagttcctgaacctgaaatctttagtcaagtttctactgggccctcagctcttccctacttgtcacagacctgccttatcctcaggagaatttactacctgagctgtagtgggatttcctctaggcttctccagatggtatatttgatttgttaagtcagtctagaaagttgggagcgtgaggaggacaggaggtcaggaacatcaggcccttatctcggaattcttcctaaatattttattttatactgttgttgtttactagtgttttttgtttgtgttttgtttattagcagcttttaaaagggctgagaagcaacccaaattttgtgactggaggatagtcctagaatcctccttgtttataatttttaaagtaagactttttccccctttcatagaaagacttactgtttgggggaagaaagaggctttgttacagaggtgatccctgtgcctcatcatcagtgccaatgcaaggcactgcatctactctcatcagtgtcattcttcttttaaaatgttttctttgtgttttattttagatcgaagcacatttggacacacttataaatgagcaagcctcttatgttttaactagggtaggcttgagttacatctataacactgtacagcaacataaacctgaacaggtaagtgcatagatgttccttcctaattctaagaacatgccagtttagagtatgtcttctagagctgcactctggattcttggctctaccacatattagctgtgttctcctgggaaagtgacttatttttctgtatctgtttccttacctgtggattgggggtaataatagtatctgtgtcataggattgttcttaagacataatacatgcatagttcttagatgacttcctaaaatatggtagagtgccccacagtattaacaatcctttttattaaaaatagtttttgttaaaagtaatgaaaatatacaaaaattagtattataaaatgtctaaagaatattcatactggtaagtttttcagattcctatatcactattagttaattgaatgcatagattactgtataaatagcagtcatcttctttttaatttagcaaattgttgcccattactttgagaaggtagtcacttctggggccagcatatgatcttattaaattatagaaccctagtagaaataaaggagtggtgggaaccttagaaaaccatgtaagccatctttcttaagaaagcaaagaactcattcaaacagcattaacatgaagactgtgttatggcccagaaactcttaaatgaagctcttaaaacacaacttttcaattctttctttgctgaagtggtaagcaaatttctaccagtaggaaccaattttactgcctttctgtactttctaaaagtatcaaagtgaaactgttcaagcctccatgtgtcactggcatcttccagtgcttcattgccttcattttcttgggtatgcgtaaacttgaagtatcatgatatttctgttgttaataaacttgagcacgtcttgctctctccaacaaatcatagtccctgatcttattgaggttgaagaaattacacttgagttctttggaaataagctaaatgattttccaaatttgggcagtgcactaatgaactatattcagtaagtgaaatgaaatgtatatctccttttttacatcttggatctgcttttttttttttttttttaaatagggctctttagctaatatgcccaacctagattctgtgacactgaaggctgcaatggtaagtgtataataaaacattttaatttagatttccttatggatcgatagtcttcattttttgctgtgtgataatttcattctgggtgacactttttatctcttgacatgctgtattaacgttgggtccaataataatgactgagcctgtattactttaattgaacagttctggccaagtcttacattcatagtagtgttccactatgctctgatagtctcatcattactgtttaggattactgtttactctatttttagagttttgttcctaatttaagtgagaaacaggaatgacagatatgaagaaattaggctgtatatcattataaacttattactaccttgatccttcgtttaaagttcctgacgtgaaaatcgaaattagattccactcttaaaacagtttattactctttagtttgagactcactgaatttccactttattaccttccttcttttcaggtgaagatcttgtaccttcctttttgcatgatcactactttttgtagtgtgtttctgtgtcttaaatacatatactttcctcatatgtatagtgttcatatgcatagccattcattgtatgatatttaagtcatatagctctatccctcataggaatgatcccttttggaagttttatgatagtactactagtaatagtaataataatatggaagaacaacagccattaacattagcatagcaagtgttttccctgtattaactctttaatcctcatgacaaccccattcaatccaggaagttggcctacagagcttgtgggtttaactactgtactaaactagtgatcctaagtatttaaaatactcacgtatactcactaccacaatggcctgactttcatagatagtcctgtaggaaggtttttaaattttccaacaatttttgatgccaaggctttcctatatattatcttccagaactcagtttaactgaaaacaaaaggataggctcataagatacctaacaaatgcaaagaagaaggtggagctatctatatgattattagataaagtagaatttaaaaagactaaatgagacaaataagaaacattatgtcgtgataaaagacactatatagaagcaacagttataacttctatatatgaaacaaaaacatagtagcaaaaattagaaatgcaaagaaaattcgatattaaaaagtttaaataaaaatagatgaaaatgaattttagattcattaaaagatatgtttttagaaagttatatatacacttaccatactatccagtacaattccacttcaagatatttaccccccaaaaatgaagatctatgctcacacttagatctgtaacattagttagtaccaaatatatgttcccttcctctgtttctccttctctcttgacacatatccagtctgtaatacaactcataaaatatttgaaatgccattaaaaattcttcatgttcctggtgttaattttcagaacaattaaggtgaatatgaatatacgatgtctctggagaaacaaatcttgcttgagttttgtatttaatacgtgattatatacaaccatttgttgtctccatttaggggtttctaaggcacttcaattcagcatgtccaaaactaactctgcacattccaccctaaacctaagtcctcttccaggcattattaactcagaaaattgtaagaccttctatccatttatcatttaaatagttattaaccgagtttctgctattttctaggcatcatgctaagaattgggatgaaaacagatatgatctagtaagggatgcagctactacacaaataaatgaatgaagagtacagttatgtgttatgataatatggtgaattaattcatacatatccaaaatctgggagtccatcccttcattctatcagtaaccaagtcctgatggtcctcaaatatctttacgtctttcaccttgattgcccctatagtctaaaaatgctgcagtaggtacctaaggtacctaattggtgtctttgtatctattattgcaatcttccattctgtcttcctatggccagatttagcttcttaaaacttaaatcagatttctcccttacttaaattcaatggtttactaatgcttttgaaataattaaaatccttaaataagcatgccagtcctacatgatctctacttatatgttttccttcccacctcaagtcttcatgctgtctcctctccctgaacctccccacccatcaatccacttacttaatgtatattcatctttaagatttcacttcaaatgtcctttcctgagagatgcttttgccgaatccacagactaggtccttgatttatgctttatagtaccttgttttattccttaatagcatttaacaaaatttgtaattatatatttatttatattattatctgtttaacacctctcttgctaggccataagctctgtgaagctagggactatcctttttttgctcatttttatacttccattacttaatatagtaccttttcaatggtaggtattagttgaactaatgaatgcattaatgaacaaatgaacaaatatagtaaaatcaagaaacaggtagacctgaaacctgatgactttacttcttgttaatattattacttaaaagctttgtgaggaagactaaaatgaatggtttggattcaggattttgaaagtaagtattgctaatattgactatattacagatttgacagttttagggagttttagttagaatgtttagaaaatacacaatttgaacacaacaatctagttatttagagtatggaatttttctcaaggatttaattcttaaaagagatgtttatatttgagttgtttgttagcacatatatgtactttatattttgtatttctctgtttcatttaggttcagtttgatcgttatctgtcagccccagacaacctattgataccacagctgaactttcttctaagtgccacagtgaagtaagtatttttggtcccaagtagttggtaaagattcacatatttttaaatatcaagtacatttttttggaaaaaaatttattttcaagaataaatgatttaccattgaaaatctatagttctcaacctttcttctgccttggcatgccaaaggatgagatctgaacatgtctgtacttattccatgtctatatgtcactccaaaatctctaattagtacatgattgttaaaattactttgaatataattgaagctatatagctgtaataccaaattcccttacgttaacaaacatgtcagaataatgttgaatatgttatggaaaatcaataatatattcattatgcaatgcagatgaactgatttatagactattttgaatctaaggtagtgttctgtagatataaaattactcaatatcatttatcaggaatgtattcaggacaccaaatcatacattaaaatattagaatataacaattagaagaagcggagagattatatgatctttcttgattttaagaaaaatattggcaaaattgtctataggtaagaaattaggcaacattatctacacatttttttttctttctattcaaacagcagtgcagtaagtgttttctacataacaggcactaggagttaaggcttaaaagacatttgcactgttttcacggagcttataacctaataggtcagttaaacatgcgaacaaatatttacattgaaatgtacagtaaggaaagaactattgaacaaaacatttcagatatctaaaagaatgtaatgttatagaggtgatatacttattttctgttcttgagtatagaactacagcagaaaatagagcaaagaagcagctttttaactcaccatgcagaatttggtatcaattagaattggctggaaatctatggaccactttttttttttttctcagacacagagttaggaaagttccattttaggtgagtgactagagtaaatgaatttaatttttttttgtgacctttatattgtattattctaaaagatattatactatttacataaccagaattctaaagacttaagagattaccaaagaaactgttatgctgtgactcaggttgtttgtaggtgcttcttttttttttttgagacggcgtcttgctctttctcccaggctagagtgcagtgatcttggctcagtgcaatctctgcctcccaggttcaagcgattctcctgcctcagcctcctgagtaactgggagtacaggcgcccacctccacacctggctaatttttgtatttttagtagagatggggtgtcaccatattggccaggctgttcttgaactcctgacctcgtgatccacctgcctcggcctcccaaagtgctgggattacaggtgtgagccactgcgcccggccaatgtgcttcttaaattattaaatttttaactgaatacctgtaattctttttaacttaactgtgtctcagtacgtaatattagaatgttgttagccatgtcactacatgtgaaatatactgttattcttttcataatataatgattgaagagagattttaatgtactttaaaagatgacatgtagctcagatgctgtgaagcaggggtccccaaccccgggccagggaccctggtctgtggcctgttgggagcacaaaccctactgtgaactgcgcctggaaggatctaggttatgtgctccttatgagatggaacagtttcatcccaaaaccatcccccaacttcttgtccacggaaaaattgtcttccacaaaaccagtccctgctgccaaaaccactgggagctgctgctgtaaaggaaacagatggacagatttggctctgtaacattttaaggtttttacagaaaaagataatataaactaagttgaaatataaacaataatatggaaaaatgtttgcaaaatatgtaacagataaattattcttaatatattatccttaatatatagtaagatcctataaattcatacaaattgtagaaaaacaggcactgaatatttgaacaactcacagaagtaatggaaatggcaagtaaatatatgaggaaatagtaattatcaaaaaatgcaaactgaaacaacgagaacttctgtctatcagactgctgacaataaaacatttattacatactaatggaacaggtctgagaaagtgggcattttcacacttttttgaatgagagtataaattagtacaatcttttcaaagagcagtttggcaacattccacaaaatttcaaaattatacattcttaggctcttctaaaattttatttttctttcttagtcttggtaatagtttaaaaaaactgttgaaccagcagtgggattgagtattgtgtatggatctattcgagtcgtttgcctcagaaacttgtcagatttcctaagcttaaatcatttttgaaattaaatgtttgtcttccattattgaagacaatattttagtttctcctttacttttattgtcctgttgtctaacggtaacaatgtaaactttgttattttattatcagacaaatgaacaagttttggtacttttttttaaatgtgaatttttaatttagtttttaaaattattttatgatatgtgcctaacatcctattatgaattcttactatttataatgacatttaaaattgagatatgcatattatttatataagtattaatactacaaacaagagtttgaaatttcttagtacctatttacctctgttttcattcagaaatatttttaaatgttatatgcaaagtattggaaaattaaatgtgatctgcaacataattttcaatatttgtttagacgaacagaaattatggtataaatttagctacttattttcaaatcaggattgctttgaaaatatagggcattttacatatttaagatttaacgtcaggccgggcgtggtggttcactgaatgcctgtaatcccagcactttgggaggtcgaggcaggcagatcatgaggtcaggagttcaagaccagccttgccaatatggtgaaaccctgtctctactgaaaatacaaaaattagcttggtgtggtggtgtgtgcctgtattcccagctacttaggaggctgaggcaggagaatcgcttgaacccgggaggtggaggttgcagtgagccgcagtcgcaccactgccctccagcctgggcgacagagcaagactccatctcaaaaaaaaaaaaaaaaaaaaaaaaaagatttaacattaaaggagattttcttatttttatttttttgagacagagtctggcattgtcacccaggctggagtgcagtggcataatctcagctcactacagcctccatctcctgggttcaagtgattctcctgccttagcttcctgagtagttgggactacaggtgcatgccaccactcctggctgatttttgtatttttagtagagatgggggcctcaccatgttggccaggctggtctcgaactcctgacctcaaattatacacctgccttgacctcccaaagtgctggggtgacaggcttgatagcactcccggcctaaagcaaatttttaaattgcgctcctactatctgtttttggttttttcctgttctcttctcctgaactttatctatcttcatagttgcaatacctttgggacacctataacctgtgtctccctttttcttgtcttgtcttagtttgactgactttcaaaggagattttgatttagcacttcagccttggaataagctattgaatacatttaagtagctaggaaacaaggtggtataggaaatagggaaaagaatagagaaagaaaatggttttaaagaattcttccctttggagtgaatttgaagcttcttgttctattttcaatgcaaaatctccaatattcaccttatagcaatacaaaaatagagtttggactacagaaaccacagttgtgcatatataaaatgttctcaataaatctttgcttattgagtcacagttacttccataataacttaagaaataaagagaatgcagatgcttcctaaagtgagcatatgggaaaatgggtaagttttgataactcttttattcaaggtttttcctccattatagaaataatatgctagaaataaagcatgtacctataatggagtaatttttttgagagaaattgaacacttttttttcttttaactaccttcttttattcacttgtactatcaggaatatccatatagacaaaaataaagcaagtttggggtaaaattaaaaaaaaatactaccaggaagagaactactggacagctgtgaactgaatgctttagagacctcagaaagtccaaaccttaaaagcaggattaatctccaaaggctggagaacctggaattcttatgtcaaaggaaggaaaagaaagagtatcttagctgcaggagagaaaaagagcaatttgctgttcttctgcctttttgttccattcaggccttcagctgattggatggagcccgccccattgacggtgaatcttcttcactcagtcttccaacttacatgccaatctcctgtggaaacaccctcacagacacacccggaaattatgctttatcaactaactaggtatcccttatccagtcaagttaacccttaagattaactatcagagctaatttagattcatactaattaagcttaaaatcaagcctctaaattatcaacttgatctgtaattaaattaactgccttccggaacaaaacatacatacttaaagatgacagttacagacaatcaacagtgtaacatctataatgctaagcatgtgataaaatgctattgcagtgaggaagcaggaaaatatgagccaaacctagagaaaaaaatcagtcagtaaaaacatacttacaaatgctaaagtttacagaattaacagataaggtgttttaaaaagctgttaaaaatatgttcaagaatttaaaggaaaacatgacccttagagaataggggattttacaaaattagaattctagaattcagagatgcagtatataaaatgaaaaattcactggattgtcttataggccagttgaacactccagagggaaagatcagttaacttgaagagaggacaatagaaactgaagcacagatagaaaaaaaattaaaaggctggaaaatagatggagtcttagagaattgtgagataatactaagcagtctaacctgtataattagatatcatagtgtaattgaagcagaaaaatttgaataaaaggggaattttttctaaatgttatggcaaataggaaccctcagacccaagaaattaaataccaaagtataccataatcaaattattgaaaaccagtgataaagagaaaaatttttaaagacatttgcagggaacagtggcattactgacttcttgttagaaacagcgcagaccagaacacagtagaatatcatcacctttgaaaagctaagtataaaaacgtcaactttaaatgatcgatcaaaaaaaaaagtgtctttcaaactgaaagtgaaataaatgttttgaaataaacgaaagtagagaaggtttatccccagcataatgcactgtaagaaatgggtacaaaaagaaagaattcttttttttttttttttttggagacggagtcttgctgtgtcacccaggctggagtggagcggcgcgatcttggctcactgcaacctctgcgtcctgggtgcaagccactcttctgcctcggcctcctgagtaggtgggaatatggacacctgccaatgtgcccggctaatttttgtagttttagtagagacggggtttcaccatgttggcccggctgatctcaaactcctgaccttgtgatctgcccacctcgtcctcccaaagtgctgggattacaggtgtgagccactgtgcccggccaaaaaggaagaattctttaaaatcattttctatgcttttctctattattttgagaatttttacatcattgctcatcagggatattggcctgtatttttgttgtactgtttttttttttcttaatctgtctttggttttggtatcagggttaaatactggcctcatagaatgaacgtggaagtattcccttctcatctatttcttggaatagtttgagtagaattagcattagttcttccttaattatttggtaaaattcagaagtgaagccatcagttcctggctttttctttgctgagacactttttattatggctttgatctcattacttgttattggactcttcaggttttgaatttcttcatggttcagtcttggcagattgcatgtgtctaggaatttattcatttcttctaagcttatagttgctcatagtagcctataatgagcctttgaatttctggggtattggctgtgatgtctcctttttcatctctgattttatttatttggatcttctggttcttagtctagctaaaggtttgtcaattttgtctatcttttcaaaaaatcaccttttgtttcatcactcttttgtacttttgtttcaatttcatatatttctgctctgatctttattttcttctactaattttgggtttggtttcttcttgcttttctagttctttaaaatgtatcattaggttgtttatttgaagcttttctacttttttttgtaggcacttacagctacaaagtttccttttagtactgcttttgctgtatcccattggttttggtatgttgtttccattttcagttgtttcaataaattttttaatttccttcttaatttcttcattagcccactggttattcaggaacatattgttaaatttccatgtgtttgtatactttccaaaattattattgttattgatttttagttttattccattgtggtcagagaagatacttgatataatttcatttttaaaaaaattttatggacttttattgtgtcctaacatatggtctgtccttgagaatgatctatgtgctgcagagaaaatgtttattctgcagccattggatgaaatactctacaaatattgattaggtgcatttggtctgtagtgcagattaagtccaatatttcttttttaattttctctctgggaagtctgtccagtgctcaaagtagagggttgaagcctccagctattattgttttggagtctgtctctctcattatctctaataatgcttgctttgtatatctgggtgctccaatgttgggtgcatgtatatttacaattgttatatcctcttgctgaatttacccctttatcattatatactgaacttgtttgtctctttttatgtttgccttcaaatctattttttctgatataaataagtatagctactcctatttttttgtttgtttccactggcatggagtatctttttctatctctctttttttcagtctatgtctgcttttgtagatgaagtattttttttgtaggcaacagatttttgggtcttgtttttttaatccattcaaccactctgtgactttttgttggagaccatagtccatttacattgtgttattactgataaggacttactctgccatttaaaaacttgctttcttgttgttctgtgattttcacttccttctttccttccttcttgtctcttttttagtgaaggtgattttctctggtggtatattttaaatttctttttattttttgtatatctgttgtatgttttttgacttgaggttaccatgaagcttccaaataatatcttatactgcattattttaaactgacaacaacttaacattgattgtgtaaacaaacaagccaagagaaaactaataaaaactctttaccctttaacttcattgccctgctaatatttgttttttctacttatatcttattatactgtctgtcacttgaaatgttactgtagttatttttgctaggttcatctttttattctgtctactcaagatatgagtagtttacacaccatggttacagtttacaacattctgtgtttttctgtgtacctagtattaccagtgtgtttagttccttcagatgatttcttattgctcattaatgtccttttctttcagattgaagaactctctttagcatttcttgtaggacagatgtggtgttgatgaagtcctttttttttttttttttttggtctgggaaagcctttatttgtccttcatgtttataagatcttttcactggatatggtattctaggataaaagtttttttttccttcagcactttaaatgtgtcatgccactctctcctgtcctgtaaggtttccactgaaaagtctgctgccagaattattggagctcctttgtaggttgtttcttttctcttgctgcttttacgttctttttctttggcctttgggagtttgattattaaaggtcttgaggtagccttatttggattacatctgcttagtggtctgtaaccttcttctacttgaatattgatatctttctctaggttcggaaagttctctgttatcccgtcaaataaactttctacactaatctctctctgcctcctctttaaggccaacaactcttggatttgctccttggaggctattttctagatcttgtatgtgtgcttcatttttttttttattcctttttcttttgtctcctcttactgtgtattttcaaatatcctgtcttcaagctcagtagttctttcttctgtttgattagttctgcagctaagagactctgatgcattctttagcatgtcacttgtatttttcagcttcggactttctgcctgattctttttgactatttcaagctctttgttaaagttacctgataaggttctgaattttggccaggcgcagtgtctcacgcctgtaatcccaacactttgggaggccgagacacttggattacctgaggtcaggagttcaagaccagcctaaccaacatggagaaaccctgtctctataaaaatacaaaattagccaggcatagtggtgcatgcctgtaatcccagctactcaggagactgaggcaggagaatcgcttgaacctgggaggcggaggttacggtgagccgagatcgtgccattgcactccagcttgggcaagaagagcaaaactccatttcaaaaaaacaaaaaacaagattctgaatttcttctttgtgttatcttgaatttctttgcacttcctcggcacaactattttgatttctctgtctgaaaggtcacatatgtctgtcactctagggttggtcactggtgccttgtttaatttgtttggggaagtcatgttttcctggatggtcttgatgcttgtagatgttcatcagtgtctgggcatcgaagaggtgggtgttatagtcttcatagtctgggccttgtacctgtccttcttatgaaggctttccaagtattcaaggggacttgtgaattaagtctttggtcactgcagccatatctacattagggaacacctcaagccctgtggctcttgcagactcaatgagggtactacattggtggtgttgggtgagatccaggagaacttcctggattaccaggtgtagactcttgttctcttcccttactttcccccaggcaaatagagtctccctctctgtactgagctgcctcggagctgggggagtggtgatacatgcctcttcgtggcaccaccactggtactgcgctgggtgagatccaaagcaagcatagcattgggtcttgcccaaggcccacagggatcactgcatgactactgcctatgttccctcaaggtccaagggctctgcagtccgcaagtgatgaatcagtgaggcttgtgtccttcccttcagggcagtgagtttcccttgtctccgagtgggtccagagaagctgtctgggatgcagggcctggagtcaggaaccttaggaatctattatatgtggtgttctgttctgaggtggctgagctggcatccaagatacagaacaaagtccttcccatgcttctgtctcaagcagaaggaaggagtcttacccggagctacaagctgcatcacctggggttgcgggaggagtgatgcaagtactcccgtggctgccctagctggtgtctcactaggtcacgtgcaccccaagtccactggctctaagcccagcacagcacagaagcttgcccaggaattagagcccttatggcccaaaacttgcccttcagtttatttcagatcccagagcaccttatcccatggtggtggggcttgccagaactctggttctgaccgctgggatggaggcttcccttctgactagtgctggtctaaatgctccctctgtggatgctggctgagttctgcctggtgttgctttctgctgtgacagggcagcactaaattccagtgctacgtcccacaatcactcttttttctcccttccacaagcacataaattctctctccgcgccatgctgccagtgccagggattaggggaaggatggtgtaggcaattcaagactatctttcttatcctctttagtgcctctttccttaatatgatgttaaaaccaagtactatgattgctcacctaatttttggttcttaggaaggtgattttttgtgtggatagatttggcgttcctgcttgggggacgatctctggaggcttctatttgctcatctttctcctaattgtggaattttaaacacataaaacatacgacaacaaaagtgcaaaagatgcagtgggagggaagtggaagtttggtgttttaatattgtaaggatattaagttatccatgaaatatataatattgattggaggtagactgtaaaccttcccacaaccattgaaacaaataaagttatttagcataccaatagataagaacaaatagaatttttaaaaagtaattgtatcaaaagaaggtgaaaaaggagggtaaaagaacaaatgagacaagtatgaaacaagtagcaggaagatagacttaattgcagcctaataagtaactgtactaaatgtgaaagtactacagatttgaactaaaagacaaaattgttagactggatgaaaaagcatggtacaactatctgctatctataaaaagtccattttaaatataaaggtggagatagtttaaaaggatgacaaaagatataccatgcaagcactaatcctaaagctggagtagctatattactataagaaaaattagactacagacagataataataccagagataaaacgtgacattttataataggattaatacatgaagtaaatatagtagtatatctgtgcatttaatagcagagctgcaaataacatgaaatataagcttacaggattgatgaggagtagctgtatcaagaaatacagttagatatttctgcatagtcctctcagtaattgatacaaaaaaataggaaattaacatgatgcttcatagttgaacagtactaccaatctttacctaatagaaatatttaaaatactacacacaaactatagaaaatacacattgtttttaagtacggataaaacattcatgaaactaatgtaagaatgagcaaaaaaggaaataagaaatcctaagtagatgaacgtaagaactcaaactagatgattctagttctagaaagttcctagcaagaactagaaaagtcatagcaagtttttctttataaattccaagctaaatcagtttttacaatgaatgtggataacttaagctaccctattttaacatacaagagtgtcagtttagatttcaaaaaaaagcaaaccgcagttcacctatatgccctttacaagagaccatttacaacaaagtggcatacaaagaaagaaagagttgcaatattaacaggcaaaattgaattcagggtgtaagtcaataaaaggtcaaagggaaatgttttatattgataaaagtcatgcttaagtaggtcttaggtaaaaatcctgaaagatataaaaaatcatttaaaaaaatcaaacattccattgcatcaagagaggaaacactatagccaaagcatacaaagaaaaatcttacttgaatttactacataaaccagttagagaagagtaccatgacactatgttggaatattgaaaatctacagcaaacataatacttaatgatgaaacattagaaaccttttcattacagttcaaaacaatatatgcatagttactgtcacatctgtttaccttggagcttctagccattgtaatgaattgagtcataaatattgaaaagaattaataaaacttattaattttaaatgtctgtaccaaaaacaaaaaaggcaagcaattaacaaactaatagaactaaaatagagttgttacttggccagattcaaaattaacatactaaaattagtacctcttctgtataccagaaatatctaattataacaatgaaaagtaaaagactttattataatagtcacaggattgtttcctagaaataaatttgataatatacgtggaaaattatataatgaaacttataaaaatttattgaaaattctaaaagatctgactaaataggcatactctgttcatagactgaaaaattcactagtgtaacaggttaatctgtaaataactccaactttaatcaaaattctcatggaatcatttcattaaatatgtatctaagaagtatatgagagaggactcatacttctgaacatctccataattagcactctggcccaaggtggcatcatctgtgcctggtttatcacattaacctctgaacttttccattttcacacttgccctctccaccaccatccacccaagccctgcagcctaaactgaacactcagagtgatcctttaatagattacttagttcaattctttcgatgaatttaaaagaggatattgtttagaaagactaagtaattgaatcaaggtcaaaaaatttgtaagaagtagagccatgatttgtatccaacatttctgattctagaccctattctcttcaacactagactatactgtattttattagctctttctgtgttgagattattttattatttttaaagaatgctcgtagacgtctggcatatatgatgatagatgacacttatctgaaatatgtagcttggcctcataaaaaatatgctttaatttcatttatagacacatagctgacctaggatgaaaaattgtcttgacccattgtgacatttcttatatttatatggtaatgaagaaaaatcaaaattttaactaatctgtttttcataaggatattatcgtcttttcttcttgggcttttaggcttaacgcctttttttctcctgtggcacatttgattgcactcttaactgcggtgctaaaataaaactcaattttagtgatcacagaatctgatgttgaaatagtctatttctggaaatgctgggtttatggtaatgatgaaagttgtatcatgttgttatggcaaccaaaatcctaaagtacagattaatgacaagctcactgatttttggaagtaagcagttcatttcttatctcagttcagttttaaataattatttagaatacagtaaatttctttgaacatattttaaaatgagaataatatctccatttagttacatatctagagattctcttcttcaaaggatcacagctcctcgccagcaatggaacaaagctggatagagaatgactttgacaagctgacagaagtaggcttcagaaagtcgataataacaaacttctctgagctaaaggaggatgttcgaacccattgcaaggaagctaaaaaccttgaaaaaagattagatgaatgtctaactagaattaacagtgtagagaagaccttaaatgacctgatggagctgaaaaccatggcacgagaactatgtgacgcatgcacaagcttcaatagtcgatttgatcaagtggaagaaagggtatcagtgattgaagatcaaattaatgaaatcaagaagagaagtttagagaaaaaagagtaaaaagaaacaaacaaagcctccaagaaatatgggactatgtgaaaagaccaaatctacgtttgattggtgtacctgaaagtgacagggagagtggaaccaagttggaaaacactcttcaggatgttatccaggagaacttccccaacctagcaaggcaggccaacattcaaattcaggaaatgcaaagaacaccaccaagatactcctcgagaaaagcaaccccaagacatataattgtcagattcaccaagattgaaatgaaggaaaaaatgttaagagcagccagagagaaaggtcgggttacccacaaagggaagcccatcagactaaccgcatatctgtcagcagaaactctacaagccagaagacagtggggtcaatattcaacattcttaaataaaagaattttcaacctagaatttcatatccagacaaactaagcttcataagtgaaggagaaataaaatcctttacagacaagcaaatgctgagagattttgttactaccaggcctgccttataagagctcctgaaggaagcactaaacatggaaaggaacagccggtaccagccactgcaaaaacatgccgaactgtaaagaccattgatgctgggaagaaacagcatcaactaacgggcaaaataaccagctaacatcataatgacaggatcagattcacacataacaatattaaccttaaatgtaaatgggctaaatgccccaattaaaagacacagactggcaaattggataaagagtcaagacacatcagtgtgctgtattcaggagacccatctcacatgcagagacacacataggctcaaaataaagggatggaggaagatctaccaagcaaatggaaaacaaaaaaaggcaggggttgcaatcctagtctctgatagaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagaggcttagactcccacacaataataatgggagattttaacaccccactgtcaacattagacagatcaacgagacagaaagttaacaaggatatccaggacttgaactcacctctacagcaagcagacctaatagacatctacagaactctccaccccaaatcaacagaatatacattcttctcagcaccacatcgcacttattccaaaattgaccacatagttcgaagtaaagcactcctcagcaaatataaaagaacagaaatcacaacaaactgtctctcagaccacagtgcaatcaaactagaactcaggattaagaaactcactcaaaactgcacaactacatggaaactgaacaacctgctcctgaatgactactgggtacataacgaaatcaaggcagaaataaagatgttctctgaaactaatgagaacaaagacacaacataccagaatctctgggacacatttaaagcagtgtgtgagggaaatttatagcactaaatgcccaaaagagaaagcaggaaagatctaaaatcgacaccctaacatcacaattaaaagaactagagaagcaagagcaaacaaattgaaaagctagcagaaggcaagaaatgactaagatcagagcagaactgaaggacatagagacacaaaaaacccttaaaaaaatcaatgaatccaggagctggttttttgaaaggatcaacaaaattgatagacggctagcaagactaataaagaagaaaagagagaagaatcaaatagatgcaataaaaaatgataaagggaatatcaccactgataccacagacatacaaactaccatcagagaatactataaacacctctatgcaaataatctagaaaacctagaagaaatggataaattccttgacacatacaccctcccaagactaaaccaagaagaagttgaatctctgaatagaccaataacaggctctgaaattgaggcaataattaatagcctaccaaccaaaaaaaagtccaggaccagatggattcacaggtgaattctaccagaggtacaaagaggagctggtaccatccattctgaaacttccaatcaatagaaaaagagggaatcctccctaactcatgttatgaggccagcatcatcctgataccaaagcctggcagagacacaacaaaaaaagagaattttagaccaatatccctgatgaacatcgatgcaaaaatcctcaataaaatactggcaaactgaatccagcagcacatcaaaaaacttacccaccaagatcaaattggcttcatccctgggatgcaaggctggtttaacctatgcaaatcaataaacataacctatcatataaacagaaccagtgacaaaaaccacatgattatctcaataaacgcagaaagggccttcgacaaaattccacagcccttcatgctaaaaactctcaataaactaggtattgatggaatgtgtcttaaaataataagagctatttatgacaaacccacagccaatatcatactgaacaggcaaaaactggaagcattccctttgaaaactggcacaagacagggatgccctctctcaccactcctattcaacatagtgttggaagttctggccagggcaatcaggcaagagagagaaataaaggatatttaattaggaaaagaggaagtcaaatcatccctgtttgcagatgacatgattgcatatttagaaaaccccattttcccagcccaaaatctccttacgctgacaagcaacttcagcaaagtctcaggatacaaaatcaatgtgcaaaaatcacaagcattcctatacaccaataacagacaaacagagagccaaatcatgagtgaactcccattcacaattgctacaaagagaataaaataacctaggaatccaacttacaagggatgtgaaggacctcttcaaggagaactacaaaccactgctcaacaaaataaaagaggacacaaacaaatggaagaacatttcatgctcatagatgggaagaatcagtattgtgaaaatggccatactacccaagataatttggagattcaatgccatccccatcaaggtaccaatgactttcgaattggaaaaaaaactactttaaagttcatatggaaccaaaaaagagcccacattgccaagacaatcctaagccaaaagaacaaagctggaggcatcacgctacctgacttcaaactatactacaaggctacagtaaccaaaacatcatggtactggtatcaaaacagagatatagaccaatggaacagaacagaggcctcagaaataacaccacacatctacaaccatctgatctttgacaaacctgacaaggggtaaggattccctatttaataaatggtactgggaaaactggctagccaaatgtagaaagctgaacctggatcccttccttacaccttatacaaaaattatttcaagatggattaaagacttaaacgttagacctaaaaccataaaaaccctagaagaaaacttagccaataccattcagggcataggcatgggcaaggacttcatgacgaaaacaccaaaagcaatggcaacaaaagccaaagtaggaaaataggatctaattaaactaaagagcttctgcacagcaaaagaaactaccatcagagtgaacaggcaacctacagaatgggaaaaaatgtttgcaatctacccatctgacaaagggctaatatccagaatctacaaagaacttaaacaaatttacaagaaaaaaaaccatcaaaaagtgggcaaaggatatgaacagatacttctcaaaagaagacatttatgcagccaacagacacatgaaaaaatgctcatcatcactcactggtcatcagagaaatgcaaatcaaaaccacaatgagataccatctcacgccagttagaatagtgatcattaaaaagtcaggaaacaacggatgctggagaggatgtggagaaataggaatgctttttcactgttggtgggagtgtaaactagttcaaccattgtggaagacagtgtggcaaatcctcaaggatctagaactagttttttgacccggtgaatccattactgggtatatacccaaaggattataaatcatgctactataaagacacatgcacacgtatgtttattgaggcactattcacaatagcaaagacttggaaccaacccaaatgtccatcaatgatagactggattaagaaaatgtggcacatatacaccatagaatactatgcagccataaaaaaggatgagttcatgtcctttgtagggacatggatactgctggaaaccatcattctaagcacactgtcccaaggacagaaaaccaaacaccacgtgttctcactcataggtgggaactgaacaatgagaacacttgaacacagggcggggaacatcacaccctggggcctgtcatggggtggggagtaggggagggatagcattaggagaaatacctaatgtaaatgatgagtaaatggggtgcagcaaaccaacatggcacgtgtatacctatgtaacgaactggcatgttgtgcacatgtaccctagaacttaaagtatcattaaaaaaaaaaaaagttacttccccctttcaactggtctttttgcatatcttttggtgttgtgaaaagcaagaggacagaaacagtcctgaaagtacttcccgtcagctatggactaggctgtgattgatcaaaatagtaagtaagtaaaatcaagtgcatgcccatgctagaaccagtgttcagcatgcactgctaacaacaacaacaaaaaaattcactgttttcactgcctgtacatagggtgtttagttgataaggacattcccaactttcagaagcatatgactgaactgagatgatttgttggtcattttggatttagtcatagaatccttgaaacttttacattttggacattgattatttgttactataatgattcattattgtttgagactgtgtatttcatatgtgatattagtaattagtgaataatttgggctaagaccaggcagacaatatagacagatagatcagttgattgatagacagatacttaatatactttttaagataaaggatgaatttacatagtaattattactgtaaataaaaatatagtaaactggcaagagaataaaatggttttaacactatagaaacattcatttatatacaaataactgatacgcttttataaatcatattttgggaaacttagttccctaaaataatgtatgtgtatgtatatgtgatgtatttattcatgtaggtagtttttttaaaacaataactcattaaaatactcttaactctcagtggaataatatagcttaaaagcttaaagtaccttataaagattaaccagttcaatatttggtttatagtggagaaagcagtcttggagaggttaaattacttgttcaaggcaacaataagtggcagagcttcaactagaatgtaagccttctaacagtaatttactcgtctataccattttatctgtactgtaccatatagaactgattagaaaatacttaataaaagtgagtgtaggaacctgttgctttggtagtgataaatgaactcatatttgttcagaaatgtggaatcacactgtcagccagagttcttggtctttataatttaagtttgactcagactcgcttcagagaatctcccttttcattttatttctatcctgttggctttagcaggcagttagcaggccaggaggagcagttccttattctttgctttttttccttcctccttcattcatgtaatacatgaagatttctttttatccagcggctttgctttcttcatcttctccaccatatgcatattctttttttaaccccttccatatctcagtggctttttaagctgaggcggagattgaagacatactataccatctaacaccaaaatttaaaatgaattttaaacactcgtttagttttaactggcttgattttatttaattatctgtgtttatgtggtactgctttattttatctattgcagacttacagtggattttcagctgtattgttagttacagacattcgtgagctaatttatatagcttagaaacaaatgtgtcaagttacaactaaatttcagtaaattttaaattttttatcactgttacttgaaaatgaaatttaaatttcactactttagaagtttcaacaatactacatttacaagttaaatactacatttacaagttactctgaacttttaaaaatcatattcaatatttataattgtacattattcttattttatactttttatgagaaggaatagccttatttttgtgtactccttatatacgatcaaatatatgctgtattgagattgagtatagacttgagtatgaggcatgagtaatgaatgctttacacacttctcagaaatctatgttattgcgcttagaaaagaactaagaacactgtttctaaaatccagtatctgacttgttgcaaaagtggatatcaaatgtatgttatatctaacaaagttttaaaatactagtttctagtagtttttaatgaaaaataatttttgcattattttgttacattcattgtcaagcaaatttaattacaggaaagaccactaatcaatagatcaaaaaatatctccaggctgggcacagtggctcatgcctgtaatcccagcactttgggaggccacagtgggcggatcacctgaggtcaggattttgagaccagccttgccaacatgatgaaaccccgtctctactaaaaatacaaaaattaggcaggcatggtggtgcatgcctgtaatcccagctactcgggaggctgaggcaggagaatcacttgaaccgggaaggcagaggttgcagtgagccaagatcatgccactgcactccagcctgggtgacaaagaagtgagactgtctcgaaaaagaaaaaaaaaaaatccccaagcctcatttagttaagcagttttctaaaccagtttctaccatcatcccttccctttcagcagaaaggtagtacaaccagtagcaccagtctactctgctcagaaaatttactcagcatgtctttcttctactcactgtcattttggaagctttagcaatttttggaaaatgtcaagttactccaactcgtcaagagtttggaccccattagaacagtgtacagatgttccaagatcttaagtggacttctttccttattccatccaactattttcttttctagaccacagatgcatatatttccacagatagtcttaaaaatgtattattctatccattattatcaaaaaagaacataattcctagaaaaacaaagaatgtgttctgttgatgatgacttcatgacattgacctgtgtgacaacttaacacaatattactattactgctataactattacgttaatctagctagtcacagtcatgtactcttgactatgtgaagaaacagttttcctgaaatagccactgattcagcatttatggaaaacagtggtggctcaagagcccagaataggactctgtaaataaggaaaaagttctttttctccatcaagcattcagtgaacatgtatttattgagcatccatcatattcaaaatatactgggttttaagggacatgtgaacataaacagtgtcaagttagttgaaattttgtaggacaggtaagacatgaacaacatgtatttctgtaattctaaacaattttttaagtacattttggaaattgggttatattgcagtcatatccatttgatgcagaactaaccccttcctaatacaaagctgttgggatctgaacatcaagaaaatgtagaagctttattgtaagttaggagtggtaaaagctatatgaaaggaacagaaaaagtgccatggacattccacaaaggaagtaattatttctagctctaaagatcagacaagacttcatggataagagagaacatttttgttgaacattaagagcatttacaagtggtgaaagaggcactctaggaaaatgaagtaggagcaaaggaactgagatcagcaaaccagagcccagagaacagtcaagggttgcactggaattagaatagtgatagggaaagtgttagataatttttgaatggtagaaggaatttgggcttctctgaaaccaaaagaggctactgaagctctttgaaagccccaggtaagagagagatgtgatagaaagtatgcctcagcaagattgatctaacaacagtgcctaggatggattgaatattgaagagactgaaagagggaagaatagataggagtttgtgtgtactccaggcaagaggtcattttagaacctgagctgaagtgatacaacattgttatgccattaacagaagtaggaaactacaagaaaaggaggtgtggaagcaaagctttaaacacacatttttattttagtttttgtaaaaatcagaaaattagtaccagtgttctcatggccagtaccatgagtaccatgagaaccatgagtaccgttagtaccatcttctcatggtgatacatgaatagtatgagtagctagggatgacaggaagttaatgtcatggaactatgcagagagttgttgcacatttaatgaaccaatactgttttttctagctggataattttgtaaacatttgcaggactcattctttatgtgcttttgtagaaatgtatatttgtgagaaagctgtgatttgctgcaggcaagtgtcacattttagcttggggtgatatagagagatgaagagaaagctaggagatgtggttgttagtgtaaaagctgtaaggtgaaagagcagtttactttaagttttcctgagagataaaagtgttgataaattgaaacaattgtaagcatctttctttaatgtgttaccacttttgcaaaatcaatacattgacattgggtcacagtttttgtttcttatttagcagtcctgtatatcaggcacaaatatatagcagtccaatatatatcaggaacaaaacacagtccatgccctctgcaacctatatagtaatggagaaagatttaataaataatgaatacaaaattatattttatcccaaaattaggattaactgtgtagccatatagtgattattaaatagtgtatgtgtgatgataatgaaaatgaaatgtgttgattgaagtgtcaagctgtcttacaattcttagtaaatatatttttttcaaatgatgtgtttacattttgtttgcttatcaatagagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatttctagagcagcaattattgcagctgtcctgtagatatatatcctattgatgtgtttttagaaaatgcactaatggaaaaggaaatacaacatagggcaaaactgaggtaatcagtgaaagactcacaggaaaaatgtggtatatatgatcttgagagctaaggcaaaataaaacattgtaagtaataatctattaatataacacctaaatttgctattactccatagtttgcattttgaactattttcatttggcataagtataacctggaaaaggcatgtctgcccttctttcagagaggaaaggtgtttgaatggcaaaacccttatgtggttgaacttttccatttctttctctgtgccttcatttgagcaggtggatattacctgaggaaaaagatgacacaaatggactaattggctttactcgaaattcatgattacagtgttcaaatgggcactgctgtagttggaatgtttatgtttccccaaattcatgttgaaatcctcacccctcaggggatggtattaggaggtgggtcctttgagaggtgattagattgtcaggatgaagtcctcattaatggaattagtacccttactcaagaggctcaagagatccctgtcccttctaccatgtgacgttacagtgagaagacagccatcagtgaggaagtgggccctcactagacaccaaatcttttggtgccttgattttgggcttcgagcctccagaactgggagaaataaatgtctgttgtttttataagccagctagtttatggtattttggtacagcagtctaaatgaactaagacagacattcaatattgctttgtaattctactcttaacttgccatgtttccagaggacttttacacccacattctcagttaatatccttcataattcaccaagaatagaaactattagattaatcttcctcattttcctattctcaaacatcacacccatctcctctccttccttgttttgtacttgagatgttatctctctttctatgacaggatattccctccattatgctctggctcgcatctctcatcttcttattagatccttctgtctctgggttatcccttcattttgcttcagcaacaactggcctctctgtaggattattctcaatgtcataaataatgttgtaatgttcatagtatttttaaaaactctctactcagatcctaacacttccatttctctgcttcctttcctggtttagacatgctgtcgtctacttccttatttctcattctgtctttaaagtatcccaatatagtttcagtctctcactactacaccgaaactaacctgataagcttttcatcagtgctatatgttgtcagatctagcagattcttctgtatctctatttgttgaactctcagtgtcattctacacatttctgtttgaaattctatcctttccagtcttccatggcaccactttctcctaattttcctcccatttcattaacccaacccccttttgaccttcttccctggctcttttgcctctatatgatttctaaaagttggcatactctagggcttgatcctggatacttttttgttttaatccttcctttagggatttgttacttcaaccttttctatccagaataatgttagcttaaatgtctttagatatatccatatgatggagtacagcagtgagaaaatgaatggttttcaagtacataatgttgagaaagaaatcagaataatataatactaattttatagaatgtggatacatgtaaaggtgtaaggaaaatataggaaatgattaatacaatttaagattatggagagggaaacacaggatgtgttgaagttactgataatgttttattcttatgctaggttgttagtactcttaaatattctttaaaatttttcatatatgttacataaacttctgttcatatattttacaattttaaaaaatagtttagaaatttgcttggcatagggcctgggctaaagttagaactcaatatatgagagctattttttttcattagtcttatcattaaacacatttcttaagtacctactaggtagtaggctttgtgataagcatttaaaaatataaccaaattatgtgtttcccgttgaggaattccctgtcttgcacaatgatagttacatgtattgtaaataaacatcatgaaatttggtagagtgcttgtgcatgttggcaagaagaaaaaatgaactaatatcatcctttataattcagccggatgtccttggtataagaggttgagagcacagaaaacaaagtttcaaaccacaactgtacattgttcagtctgagattatcataatgattgggttctattaactatttggttaagatgtaaaattatgtaatagtgtggtgagaggaaaaatggtggattaaggaacttaaaaattttgtcccttcataaaggtagcaataaaactggccttcaaaaaatgatcaaagtcaactttttcaggactcgagaaactaatcaaaagatcacagtaacctgagttacttaaaaaaagagaaaaaaaagccaaatgttagtaataacagcaagcattttggtgtttaacttatgccgtttccataccttgctccctagttcagcagtagtgttgaaaagaacacgccacattcatggtatgggaaagagcagaatggaccttatttgcagattatccttatttgatctgtctgatagctcccaggaaaacccatttaaaaaaccggcctttatcttgcctgttatggaactcaccctctactggggtgggggtggggaatttatttaaaacatttacctgtcattgctacatgaagcaatgggtaaaagttggagcaaacaataaactaaccagaaagctttggaagaaaggttgggaatgagatgttcataaggactttgaaaagctcttacgtatttctgggaatctagaaggctctgtgcatgtttaggactgtgtgcatgttcatgaatgaacagagagaccgtaatctctcacctctgcctgaccttgaggatctgagcaagcagggaatgaaggcagaagcaaagttagaagctgcctagctgagtgtccaagacatgtcccaacagacacacagagtccttcagcaaagactgagcaattttttggtttaggcattcaaggaactcttcatctaatcattagttgacaattaagctaatgaatcggacacataagtggttacacatgacaaagaatgtagattttacagaatgagttcatgaaagtcactaaaatataatcacagctataaaaggcagcaacaacaaacggggtggggcaagagaatctaatctgatttccaacagatagcccagatattgaacttattagacaaagattttaactattttaaatatgttcaaggatttaaggaaaccaagtctgaagaactaaagtatgagaagagtgtctcaccaaatacagaatataataaagagatacaattataaaaaggaagtttttaatacatttataattttaaaagtttaaagttacactttataaaaattatgaaaaacttatttggacatgagaattagtacacagaataaataatacactataggggataaaagcaattttgagcaggcaggagaaaaaactcagaaaacttgaaggtgggtcagttgagatgttccagtttgaggaaaaggaagaaaaaaaaatgaatgaaagaaaatagcctcagaggcctgtggagcaccgtcaacaatacacaaacaataggagtctcagagaaaaagagaaagagtctgaaagaatatttgaagaaatattgtcaggatactagaaatttggtgtaaaacattacacatccaagaagttcactgagctccaagtcggatgaactaaaaatatgtacactgggacacatcacaatcaaactgttataagccaaaggctaagagggaatcttgaaaacaccaagagagaggtaattcatcacgtacaagtgatcctccataagatgaatatcctaatttctcatcagaaactgtagaaaccaaaaggcattagctggtatattcaaagagctctgggcggggcggggggcggcagtggcgggggaacatatctgtatctggcaaaactgtgaaaacataggagaaattaagacattcccagatgaacaaaaactgagaattcattgttggccaacctgccctaagtgattgctcaacggagtacttggagctgaaatgaaaggacgctagacaaaaaaatcaccaaaagacttaaagaataacaaggaaatcgaacactcagtagctattctaaatcacctagatcccatagacatcagtggaacaatccacccaacaacaacagaatacacattcctctcaaatacacagggaacactctccaagatagaccatatgttaggccacaatacaagtctcaataaattttaaaagattgaaattatacaaagtatgttttcaaccacaatgacattgtaaattaataacaaaaggaaatttttaaaatatactaacatgtggaaattaaacaagatgctcttaacccagtggaacaaggaagaaatcacgaaggaaactagaaaatactctgagatgaaagtttgtaatgaaacaccataccaaatcttatgaaatgcagcaaaaatagttctgagagaaatttatagcctaccttaaagagaaagaaataaattaacctaatcaataaccttaagaaacataaaagaagagcaaactaaacctaatgcaagaaaaaaggaaataataaagattataacagagacaaagaaaatggagactagaaaaatgatatagaagattaataaaaccaaaagttaattctctgaaaggatagaaacattgactaatctttagctgactgaacaataaaaaaaaaaagactcaaattactaaagtatgaaacgggacattactgaacttacagaaataaggataacagaattctattaataattatatgcaaaccagtggaagtggacaaatgaaaaacacaaagtaccaaaatcaactcaagaagaaatataaaatctgaatagaactatggcaacaagatggagtcagtaatcaaaaaactcccaacaagaacaaagcccagtgaattgcttccctggtgaattcactggtggtttcacatccatgtataagtggacccacgcagttcaaacccgtattgctcaaggatcggctgtgtatccaaaataaactcttgcaattcaacaataaaaagacaaccgagggctggcacagtggctcatgcctgtaatcccagcactttgggaggccgaggcaggcagatcatgaagtcaagagatcgagaccatcctgtccaacatggtgaaaccccgtctctactaaaaatacaaaaattagctgggcgtggtggcggatgcctgtagtcccagctactcgggaggctgaggcaggagaatcacttgaacctgggaggtgaaggtttcggtgagtcgagattgtgccactgcacttcggcctggcgacagagcgagatgccttctcaaaaaaaaaaaaaaaaaaaaaaaatgacgagctggacgcggtggctcatgcctgtgatcccagcactaggtgagaagattgctggaggccaggaattcaagagcagcctgagaaacatagcaagaccccatctctgcaaaataataattttggggcatcaagttcttccttgaaaaacaaaacaaaagacaactaaattttaaagtgtgccaagtatttgaataggtaaagaagatgcacagatagctaaccctaaccctaacatgaaaaaatgatcagcatcattagtcattagggaaatgcaagtcagaatcacaatgagattctactttgcacatactaaggtggctataatgttagtaattttagaagctggtatgatgtggagaaattggaactcccatatgttgctggtggggatataaagtggtacagctgatgtggaaaacagtttaacaaacagttcctcaaaagagttatgatatgacctagcaattctatgcctaggcttttacccaagataattgaaaatttatgtctaccaagacttttacatgaatattcatggcagcacttataataactgaaaattagaaataactgaaatatccatcagctaatgaatggataaacaaaatgtggtatatccatacaatgaaatattattcatttataaaaaggaatggactactgaaacatgctacaacatggatgaatcttgaaaacattattctaattagaagccaagcacaaaaggctatatataatttgattctattttaatgaaatctccagaataggcaaatccacagagacatataagtagattagcagtttccaggggacagggagaggaactgatcgggaagagacagctaacaggtactttttggagtgatagaaatgtcctggaactacacagtgatgatgattgcacagcattgaatatactaaaagccactggattgtgctctttttaaaatggtaaattttatgttatatgaattttttcttaaagtaaattgcaaatataatggaattaaaacaggcctgttctcatgtcttaattgtgatcttttgtgtttttgtgatctgatggcctcttttgaaaaccaaaaattgaggaatattttccttgaacctggtgatagtactgatatataattgtccagtcttggaatatttaccagtttttttatacactatggactttaaaataaatatgtaagtaaaatgcagagtcatataataatattgaatacttgcaggtcagttaatctttcctaatttagttaaatatgctgtttagaataataaataggcctacatatggttactttggggctataattatattaagcacaattacctatcatcttgaatttgcatacttacttcacctctgagagaatgtgctttggaagatagataatataattatgtatttttgcaggtccaaatatgaaatttctataaactagctgagaaatgaatgtaatagtaataattagattaataacagcatattagtctatcaaatccaactacccttaatgccagtgaatgttaaaagtaaaactttcttagcactgacaatttaataagtaaaaataaatggtactaagcttacaaaaattagctgaattggggaaattgttgataaggccacaagtattaacatgttatacttgcttgctttgagggtatatagcatcttttggcaaagtgttacattattgtgaatttaacagtgaaagtttaagccagtctaggatttcaaagtttataactttactaccaggaaattaatttacttaaatatgttctttgtttccatcaatgtcaacatctgaaattccactggagaagtattagctttggcctactaaaagcaaaatgacaagaagcaagaatgcaagccagcatcaaaaattggtctcctgttttgagattgccccgagtctttctgggggtatcatttatataagtctaattttcgggattcaggcaagagctggccattgttgtgctagctgggcctccagtggaatgtaaaatgataatgaagattgaactgaggtagaaaaatgaatttaccttagaaaggacaccaaagatttgattagtattccacatagttgccatacgtatttaattgcagactaggaatttttcttgctttaaactattagattcttttacagacaaagatataagcaagccaagcattaaaaagccaaaaaggtgctgctaaaaaagaaaataaaccacaaaaacagaaagaacatctcaatgtaccctgcctttattctaaatcttacaaaaaagaaaataatttctccactgaactattaataggttaatataatgaatcatacaataacaaaccataatagaatttgcattaaccaaaaaatgtgcaaacacactactatgatttaccaaaagactctctgcaagtggtaaatcattagctctagtgttgctctttgtaacctcaggtctttggggaatggtgcagaattagtattgcttccttctttctgtgtgtgataatggtgggggaaggctagtaccatctctgtcatacatcaaattcccatatgtgaataaatttatgtatttttactgcactctttttataggtttattcattcctgcaccaacaacgaatgccattattataactttatagaaagtctcaatatatggcacagtgcttcattttctttttttcatctagagtgccttagccattcttggctttctgctgttccacaaatagcaatgtaaatttgtcagtataatagagaatccacttatatttcttcaacagctattgggaatatggttgggattacttcaactctatgtatcaatttgaggagaattgatatctttataagattaatccaaatcacagcatgtcaaaatttccttattagggtagttttaatgtccttcaaaaacactgtaattttcttcatatagatctaagaaaactttggtgtttattcctaagaaatttatagttcttgttttgtaaatgatatctattcttaagttacacttaaacttatttgttgctgtatatagaaatggaattgacttctatgtacagcagttgcaaactgatattcatatgcagaaagtgaaactagacccctaatggataaaagacttaaatgtaagacctgaaagtatgaaactactagaagaaaacatatgggaaacacttcagtaccctggcctgggtgaagattttatggagaaaacctcaaaagcataggcaacaaaagcaaaaatggacaaataggattatatcaaactaaaaagattcagcacagtaaaagaaataatcaatagagtgaagagacaaccttcagaagatatttgcaaactattcatctgacaagggattaatatttagaacatacaaggacctcaaacaactgagcaacaacaacaaaaatatccaattttaaaaatgggcgaaagagccaaataaacatctctgaaaaccagacgcaagtggccaacaggtatatgaaaaaaaaaaaaatgctgaacaccgctaatcatcagggaaatgcaaaccaataccacaatgagatattatctcattttggctattatcaaaaagagaaaaaataacaaatgttgacaagaatgcacagaaatgggaatgcatatgctgttgtaaattagtccagccactatggaaaacagtatagagattcctctaaaaactaaaaatagaactaccatatgatccagcaatctcactactgggtatatatctaaagggaattatggatatgttgaagagacattttatttttactccaatgtttattgcagcactattcacaatagccaagatatggaatcaacttgtgtcctttaacagatgagtagataaagaaaatgtggcatatatacgcagtggaatactatttagccataaaaaataacaaaattatctcatttgtgccaacatggataacttggaggacattgtatatttagtgaaataagccaggcacagaaatataaatactgcatgttctcactcaggtgaaagataaaaacattgatctcatagaagtagaaagtagaataattgatactagaggcagggacatgtaaggagatgggagtggggatagtcagaggttggttaatggatacaaaagtacagctaaatagtagaaataagttctagtgttctatagcactgtagggtgactgtaattaacaacaatctattgtatattttcaagtagctagaagattttgaatgtgtcttacagaaatgataaacatttgaggtgatggacatgctgattaccctgttagatcattacacatggatacatgtatcaaaatatcacactgtaccccataaataagtacaattaaaaaataagtggaattgattttatatgttgattataatagatcgaggcaccttcataatattattttccgtgatttttctttgagttttctctatatagatctatttgagacaaaataagagttttttttttttttttctttgaagcctatgtaccctttatttctttttcttttcttttatgctggctagaacctccagcagaatgttaactaatagcaatgataatggttacttttcttaattcagatttcagtatctcaccataaagaattatacttgctctaagttttcagcagataatctttatcagagaggaagttattttgtattctcacatgctgttattaattatgaatggacgttgaattttaagtgactttcagaatctattgagatgatcacttggcttttctcctttatttgttaatgtgatgaattatatttataattttcctggcattaaatcactcttgcattcccaaaataagcctaagttgatcatattattttccctttctgtataaatcactggatttagttttgtatgtttttgtatatttagtagcaaccttgctaaatttacttattaattgtaagcgttatttgtgtattattttgtattttctaaattggcaagcacacaatctatataattagtgacagttttctttctacctttttatcgtttcttgctatgtggcactacataatgtttaaccatttacagtgttacaaagttgaatagaaatggtaattgcggtcacccttgtctttttccaaaatgtggggaaggagaggaagctttcaattgttagataggtattttgtagataagctttatcaaattaagaaagttcctttctgttcctggtgtgtcatgattattttaaataacaaataagtattgaattttatcaattttttttctgtatctatttagagatcaatacagaaaaataatagagaatccacctatatttcttcaacaactgttgggaatgtggttgggattactttgactctaagtatcaatttggggagaattgatatctgtgcctccccccttttacttacttaatatggagaatttcaaacatcagccttgcatttctgaaataaacccagtggtcataatgtactatcctttttatatatctttttattttatatgataacacttcatttaggatttttacatctttgttcatgagaaagattgccctgtaattttcctttgtttaaaggtctttgtcaggttttgataacaggataatactggcctcataaaacaaattggtacatattctctctgttatctggaagaatgtaagattgttattacttctttcttaaatgtttagaagagtttcaagtagagccaactaaacctggagatgcctttgtgggaaggtttttaattaaaaatcccattttctaaatagacgtaaaactgtttggttgttctatttcttcttgtgtcagttttggtaaattttattttgcaaggtatatgtccatttcatctaaccgtttttgtcataatgttctatcattttagttttttaaggtctgtagacctaatattggtaatttgtgttttctttctttctttttttccttggttagtcttggaagaattatgaattttatttatcctttcaaagaacctatgttttacttggttgattttttttttattgtatatttgttttctatttcatttatttttgctctatatttttccttccttttactttcttggtattttattttctcctctttttcttttcttgaaatggaagcttatattattgattttcagacctttttctgttgtaatgtattcatttaaatatatttaatgtgttcatctgtgtttccatctaagcacaggtttagctatatccataagcttttatatgtcatattttcattaccttttacttcagaagtatttgctaatttccattgtgatttattgtttgactcatagattacttagaaatatattttcaaacatatgaatgttttctggttatttttatattactgatttcaagcttaattccgctataaccagaaaatgtattcctagtatcatccttttgatatttattcatacgtactttatggtccaacatatgatttgttttagtaaattgttctttctagatttagaaatgttttctgtagtattgggtgcagtgctctgcatatggtaaaaggataaattttgttaatcttgtttaaatcatctatagcctttctgatttttaatctgcatagtgtatcagctactgagagatacttgttaaataactatgattgtggatttttctgtatttttagttttgtcagtttttgctttatatgtttttacgctatttctagatatataaattctatctattatgatttcttctttgaactatgtgttacttagaagtatgttatttgcatttttgctattaaagtttttagcaaggaaataaggcaatcaaatttgttccttaaaaaagagtcgctaagagacttccttctgccatgccctctgatatctctctctttctgtctcctattccacagtttataaaaattaactgtagacttaccaattaagccaatcacggatatatgaattactggcagttccatttgctttgatcccatggtaaattaagcaaatcctcacagcatattgaggccctattcatattgttcacttatccttctctcccagaccctggattgggtgagtgggattctgttggttctagctgatttttgaatactagcatatgactttaatctctgaaagatctagatatctcatatactagaaataatcttatttcactcactgaaatgaccttaatcccaaaatgtgttatggtactcaatcacattaacaagtttaagcaagtatgtcagattgatttccagcttttggtgttttaagataaaatgtgaatcctttttttaactgtatgttgcaactttccttctaggtggtttcttgaacaaaataaagcagttttcttactgggtagacatcctgctttaaaaattattcataatctggagcctaaacttaatgtaaaactctgagtttggtttatatccaatagcctaaggtttcatagaattttggtggtcggcaaaggaattactggaataaaaatatcacagcttctgtgctgtgtgcagatacttactgagtgtaatgaaggaattactctctaaccgagcacatattctgagcaattaggccaagtgccaaaaccattaaggctcaaatgccaagtgcctgtagggagggttctgttacaggatttagcaacccaacccttggctcacttaccagagggtggcactccaggcttcctgataactgtgccagcctggctgagactcagcagctgccatccagccacttctggcttctggaccctctccccagtactgcctctgtctccacccttctcgcccatctgcccctccatctgcctgtcagttgagcagtggctacacagttggggacaccttacatgttgagtcatgactcccagctaacacattgcattcaccttccctgttcctccaccacctaccaatacttctcccacttggcaacttgaaaggaaagggttgccaatttctgtttcataacatttcaggggcttccattcagaggcttctggagtatcctggcactcaaggaaactgggcatggaggtggagtagggagagccactcagaggattctgggcatccagtcacccctggcccattcccaaaaaaacctgggggaacaagagtagcctttgtaactccaaatttcatcaagatgagctgaaatctggttctgtcatttccccatcctaccccatcccatactccctcctaaccccatcccatactccctcctaaccccatcccaaaaccagagcagtggaatatcttaacaatttgacttttatccagaactgaggctctttatttgttagaactaagcatttggtccaagattttctaattctttctgtgggaacttgaatcagcaccccctccccaagctcccacagaagaagcagatggggatcttggcaaggtttggaagtccaggacttggacaggttgagagttctatttgccaggctgaattgcttgtaattaaaaagcttatcctcctacttttttgcgcttctgaacttatctgaagaatcaacagagtatttaatcatgcatagaaacaaatctgtgcatataagtgaaaatctgcatttaaaggcaggtgcttaccaggagagatgagtcacgtaagctggttagggtgaagttaagctctctaatgttgacttgacatgtcttgttttaaagggtgatagggtatgatcagtgttttgtgtacaggttagggctggggtatggaactctacccccttccttctctatttgtttccttcatctccttgcctaaaaagtgcctacaataagcactctgcatattttgggtcttcttagtgacacttactgacaccagattgttaacgtttatctgctttctacaacagaaaagaaaataactcattagtcttgacattttaatgtgtgagggttttgagacaaaaaataatttggctccttccggactaagttgtgctaattgccagattgtactcatgttaggaaattgagaacaaagtgaagcatgaccacttgaggctcttgggataatgagagttttaggttattgtcagaaattacggatttttttcttgaaaatattttaaaggaggtgagtaggtgacatttttcccccttcaggagttcttactgggggcattgatgattttcggagtggaagtggaggtggcaatggcaggaaacattgtagtttatgtaccacatgttagcaaagaagggcgttctctctgtgtgtgttagtggtgggagcatttactaaatctaaccaaagcctgattgtgtacagactttcagggaaggagcagaagatgttacttttatgggctcccttacagggtgataaagacttgtgcggctgcttggaagtatttcacccctgcagtcatgttcctttcactcaggccaacagcctcaactccagctctgaatctgccacgaaggcaactagacatgaaaagtcccaattttacagcttgctctggtagccatgccaaggtgagctagagacagcaaagggatagaaaagcattgctaaactggagctttgattttaaaaatggagacctgctggcaaaagatgagacttggttacatttagtcagtcccaactctgagctgtcattgcacaagagcagccacaagccgggggtttccacatgctgtccattaggaaccagggtctcttctatctaggtggcactgccaggcactctcagatcttacctgctcacattcatttatgtaacttctctttcttgcagtttaacacacatgtctgtctatctctttcacactcacacacaatgagatttagtaacccattttaatgaggcaattatattttaactctattatgtgcaattatgcactcttttaaattgcctcagctggagtgccctggtgttggtatctcactggcacttacttgctggtccctggggaccagctgggcagctgaacccggaacactgccactcctcctggcccctactgccactccacaggtggcttagcactgccacagggcgggacaattgcaatttcctggcccacccagtggagctcttgattgctgtgtgggtggcctagatctttctcatctgctttgctgtaccagcaggattgtttatccagggctcagagccccaggtagtcctctagcttggaggggccagaaaaacaaacctggataatcatagccatgcccttaatctgatgttttttctttttagtcatctaggctctaggttcctgggggtgggagtcagaagcagagactcctaatacactcatcttcatactacctttgcagtcaaggctcagtggtaacttttcataagaaagttgtaattacgtgatatctgcttcatttaaaataatatatgatactattatatatcataatatatataatatgcaggcacctatagacttcactactcaactcaataactggaatgtttcaaatactcttgcatctgcctgtgcatatgtatcccaccccccgcctaccatcagagggaagcatttgcttgaattttgccctgacctttcacttgatttttttaaggttttatcacatatgtatgtatccctattcattattttttagttttgcatattaaggtaaaattattctgtaggtagccttctgtaatgttttttccccacttaacataatgttaagattcatctctgcacctctgtggagttgtagttcatttatcttcattgctgtataatccactgtgacaagttagtcaccctcctgtcaacagaatgtctggagcttttctaaagtcttttgtttctttagcattgtgaacaatgcttccataacactcctatgtacacatactagtgttatgcatgagaatttccctaccttggagtgaaattcctaggttacagaatatgagaatgttcaagattataagagagtgccaaattgtttttcagagtggttgaaccaacttatactttctccagccaggcagttgcaatattccagattaccatgttctgtgtcccatgtgatattaagagtacatttagaaatgaattccagctgttggccgtgggacctgggaaagattacttgctctctctaagcctgttttctcatctgcaaagtaggaattataaattgcattaaggtataggtttattgtgagaactaaaataatctgtgcaaagccaggtaatctagtacagagctagatacacaatagtgtccaacaattattagaaattattattttatgttaaaactgaagagtagagggaaatagtcgaatacagtactgctatagtctgaaagtttctgtctcccctgaaattcatatgttgaaacctaacccccaaggtaatggtattaagagagcggggccttcggttggtgattaggtcatgtggctggatccctcatgaaagggttttgtgcccttataaaataggcatgagagagcttgtttgcctcttccaccacgtggaaggtcccatctttgaagcagagaacaagccctcaccagactctgaatctgctgatgcctttgatcttggacttcccagctcctagaactgtgagcaatacatttctgtttataaattacccagtcgaaggtattttgttaagcagcccgaactaactaaaacaagtagctaacatctagcagtcatgctgttgaactctttaccttatagtaccacacacaatttaaatctgtcctgcaaagaaaattagaaatcaatatcgggaagtgaaaatattctccagttcatatcacaagtggtaggcagtttggtaatttatctaattaacacccacgactactgctattgtcttacacatattagttaggttttctttttgggctgcagtggaatgccactgacctcagcactccagaagacaacacatgccacacaaagactccctcacattgacggaggtgtccttagagacagctaacagggatgctaagagcagccaacatttccacagggctttcacaaagcgcattcatgtatggcctctcattagcctcctcactgaggtcctcaaagttacatgttatttctcattcaatttttacagataaagcagcaacagtaagagacaattaagtgatttgtcttatatgacagaagcttgactgaagcccaggtcttctgtcactggatccagtatttttttccactgcctcaccctgccccctgtattatgctccatagtacgtgtttatcgtgtttattcatttttcctttcagtgctatttaatttaatccatttgattaaaaagagaaagaaatccatttgtgtctccagaggtggctatagccattagtcagaatactgaacaaagttcactgtcaaatttgcttaaagaggaatggtgcaagaattaattgtgaaaggcttatttgaaatgaaaaaggcctaagatcacgggctttcatttctcccaatcaagttttaattactgaaaagtttagtaacagctgaagcgtgtagttaccgcactctttattgccaagaggttttttcaaaaggacttccaccgcctcattgccttctcttcttgtttctacaagacctcacttgataacattaattgtctttttagttcactttcattaaagaaaatcctacattctctggggctcaagcattagctgctcctcattagctgctcctcatgtcatgtaagtagctgcagatcaggtccatgcagacacgtgtggcactgctgagcactgccaccccctcccacatcagcaggaagaaagcctgccactgcttagggtcattccatacaaggttgatgggcagggccaccaattcccaacaacttaaggcctgtcctctgcgtatcactcagcaggtaacagatccaaccatctttctggcttgtttcccgcaggtactgaaaggcatttgctgtgtttaagtcatcctgtaagatttccaagcacttcttcgtccatcgtctccacactggacaagaatagccaggtgtgtgtcccagagacacctggagggagttatagtgaggggtaactggtggctcacccgctgcccagcgctccccagggagacccggccctgctgctcagtcctgccacttggtcttcacagtaagctttgtgactgggccctggagtcagagtcaaggaagtgcattggcacagaaggatggtcctctgcaggaggacagtcttggttccatctctcatttgggctgctgccttggcaaagtacatttaactccactggccttttcttacttgcctgaggaagataatacaaatatatagtctacccacctcaccaaattgttttgagcatccctgaaagtaatgacttgaaagcttaattgtataaagtaactgaaaagcacatatgatcttatggttattaaaaatgaccacgggcccttctcatctcatccccctgcctgattcactttttcatttatccattcaacacctttttctaatgcttgccaggttcctggcgctatacttggtgctggggggaaaagcactgaacaagatacataccttccaagggtgcaaggtaggggtgagaaggctgaagcctggcacagagtagaaataaaactaccgctgtctcattcaaaaacttcctcccaaattaagtacaaaggcctcagcctcctttccaggtcttccccagcaaggccctgtcctgctggtccagttctggtgctggtcctcacagcaagcttggtgtgattagaacccagagcatgtatcggaagatatgtgttctctgaacacatcttgtgtttcatctctgctcacattgtttcctgaaatgtcttcccttgctccagttttgcttaacctcttacagtagttgtcaaacttttcctgatttcctctcctgacccactgatgactctcctacctctgagcctccagaatatattgtacctgcttcacatcataattctttgcatattttattcaataaacatctcttgagtcctatcgtgtgtcaggcatttggctcagcactaagcattctattttaagccaaacagacatgattcctgccctcagggagcttgtagtctttatttcttcagctctccattgtttgagggttgagggctggatctttctcatctttgtgttctttataggacaccagcctctgaacatcagttgaactggtcttttaaagttagaggagctgtcaataaacacctgacataggctttcctaaagttccctggcaccatggagtcacatcacgtatcatctgtttcctggcctaggggctcttctcagactcactgtgctggcctgagaactcagttcttgacctcttaaggatggtccaggtagccaagtacttgattttccttatggtctttttaggaaacagacatccttcttccaattaccttgggctctcctgcccccattgaggaactgaaggcttttacagagcctccaaatgttccagccagaggctctagttgcaaagcagttgctagctggtgaagacctgccctcctgccactgtctctggggactatcttctttcggaacatttgccattttggatcaccaatttggggccaggagctttgtatattttatgtctcctcctaacatcaaactgacaaggtagacctgggtctctgtttattagtcgagaatcggaagggctttagagatggagggacttgccccagtggcacagcaagatcaaagccatttctatccacccccactcctcttacctctccaccttccctccatcctaatgccaggaagggaaaaatagcctgtctgtcttcaaggcagccagagggaggagatgacttccaagggtgcaggtcatttgggatatttacaaacacttatttcttaggaagaggcttaggcctaaatggaagccacaataggcactttccaaatcaacttccttggtagtgtgaggggaaagatctttacatgatcttaagcactggagattgtctatttctgagactcctgacaaagagaaagataatttatgccatttttacatttttccactaacagccaaacaggcagggacaccataattctcaattattagaagctgcgtatgttttacctctgcttcaattagaacaagaggaaaacaaaagccctgaactgaagagtgaatgattttagattggcggcacccatttaataaaagagctgggccactatcacttaggagttactctatttagagagaataatcactggaatgtagaaactctgttccagcctgactccaatcaggattcttttaaagctagtagttttgaggaaataggttaattattttttattacttaagttctatccacctcacaatcagctacttattgcttaaaagtcaatgcattccttagaataagaaatgctttggatagcacatgtaaaacctatcatggtgtactctaattggtccagatggaaatggaaattacaaacctattgacatttttgcttttttttttttttacccaatcatgtctaaatactgaccaaaataaacctagaaattaatcatacaagggaatgtgaaggttggcagacgtttggttagaaatccataggagtatgtggtgtgggctgactgtacaggcttcgaaactgccccacagtcacagatcaggatggtcaaattgcaggaaatgaccggctgactgcttccctgactatgtttaaagggcaaatgagagcatgctatttataggatgctcatcaataagctccaagttcatagctgccgaaggaaaccttagtcttgactttcaaagtcttccacattattctttcccaaaccacatatcattttaaaactttatgaaggtaatacacattttgaagtcttctttttgccagtgaaaaatcatttttcccctaaatgttaggccagttgtttctggtatttacagaagaatataagatatttattaaacattgttttaaaaaacaaatatgagaactatatttagtatttgttacaactgatgctcaaaaactctttggtggtgttggatatttaaaaatttcttttcacttctgtggacttttatgctggttcttttgtaagtctttttgtttataatttacttttatcagtggtttggagcagaattttaaatatttttacatctaggaagttcacaaagttggaaaaaaatttcttttttctttttttttttgagacagagtctcgctctgtcacgcaggctggagtgcagtggtgccatctcagctcactgcaacctccacctcccgggttcaagcgattcttctgcctcagcctcccgagtagctaggattacaggtgcatgccaccatgcccaggtaatttttgtatttttagtagagacagggtttcaccatattggccaggcaggtctcaaaatcctgacctcatgatctgcccacctcatccttccaaagtgctgggattacaggtgtgagccaccgcgcctggctggaaaaaaatttcaaagtttatattttcacaccattgcaaaatcagtgtgattgtattcagataattccgagagattgcaaatttattattaatagttacattaaaagaggctataaaaatgcaaagctacaaaaatgacaatgaaatatcaacactcaggcaggggaatgggcatttccattgctcattgctctcccagccttggaggaagttctgcttttgctgggaggccgtcaggcatcatgggtgggtgtgtctgctcgggagccaggcctggcctggaggttccatttcgtttgtcatctgttacctaaggtaagttactctgggaaagtaacataacctagtttgtctcagtttcctcattggtcagatgaggctaatgatgttgtgactcaaataagttaagacaggtaaaaagtgtagaacagtggagggcacaaaatcagcattcactggatgttagctcttcttattttcattatagttatgtttctaggattagatttgagaaaaagaaaaagtatacaacagctcagttttctccacacactctacccacttggtataatgggaaaagttctagatgaagaacgaggacatctgggatccagtcctgactttgactttcactagcctttgaccttactatacatcctgggttttggtttcctcatcactaaaactgaggggggttgtacagaaggctccctgctcccattcacccctcacatcctgtgaccttgcttgagtggctcacaaagccctaataatgtagttctttttcatgtagttttacattttaatacaataccgaaacaaattaaagcatctggaatccagctacagtaaaagctggaaatatcctaaaataatctttcagagatacatctgaaattttttttttttttttgagacggagttttgctcttgttgcctaggctggagtgcaatggtgcgatctcggctcactgcgacctctgcctcccaggttcaagtgattctcctacctcagcctcccaagtagctgggattacaggcatgtgccaccacgcctggctaatttcatatttttaatagagatggggtttctccatgttggtcagtctggtctcgaactccccacctcaggtgatccacccgccttggtctcccaaagtgctgggattacagctgtgagccactgcacccggtcgaaagttttgttttaggcaaacttctgatcagcaaaaagctggaaaaacgtaactatattttaaaagataaagaaaacaactacaaaagaatagtagtatcagcactttccttccagtgtttggctttgtttctaggaactctgaggtgaaaaaaaagaggcagaggagggaggaggagtaggcagaaggggagcaagaggatacaacttgtgtgctatgtgtggttgttattttaaggaagtttattctgaccaattttatccaaagaataaatcaacaaacacccagaagcaatctgccctaagttttttatttccaatatagacctaatcagaataatcaggttttgtcaaaaaagtttccagtaaaatagctgtctctgtcttctccattgttattgttagatattagcccttctgatcttgcacagtccccttgcctggtaacgttaactaagtaaatattaatactgtacacttttcctttggaaaatgaaggagaacaaatgggaaaagatgtaacaaatgttctgcagccctgttataaatattttatgaatgaatcagagaaattgaagatgaaaaaagcccactaattcagccagtaccctgatgtctactgctgtattctttcaagcggtttgtctggtctggtctttagtgactcaggttatagggaatttaccacttctgtcgaagctgcttttgtagtggggactatctagctgctaggaaagtttgtcaaattccccttgcttttgtttagttttctcattagtctcatttgattttgtttatttaattgcttatttttagtgtctttagattcttaattgatttctacgtgtcttttctattgctttcttttttgttcattcagcttttctctctttagttgttaccaggaagaaaccaaaacagctttttggcttgtagataggtgagaagtaacaattggttccatcaccaaattaacaacaacacttgctacatcaagtgttaggctaactactttgcatacattatctaatttattaagcaccttctttttgccagacactgagaaggcaaggttaaatatgaccctgccactgttggcagggccttataatgtagtaggggagataagcattcaaatagatagtgtcaacacagcatattcagtgtgtggggctattttcagagtcatcctggagcacagaggggggtgtccactccagcagtgaagagcaaggaacgagggcagaggtcaggtggcatgggagagagataccccaggtgagttgacccataacctgattcctgtaagaataagagttaactaggttagaagggggtgtggagctggagaggatagctacttgggaaactacataaagtttaatgttattaggttgaaaaatgtgagagttgttggaagatgaggtaggccaggagaagaaaccggccaggtttgtattacttggtggaaaacttgaactttgctttggattttaagaacagaaataaggctgccatgtgaagaacacacaggaggggcagcagagagactggcatctttcctggtgagggatcaccagtgttgcaatcgcagagtcaggttagctcttcttggttggagtatctttaaggccatctggtctgactctaaatgactaggaaattactcatcatgtgccttctaactctctgagtagttatttccatttccttgatactgaaaaaagggtagtagggaatgtatgtttgctgcggccagtggggttatgtcaaataatggttacttactgacagcagtctaacagtttctgggaagactaatgtgctcctaactgcatatgtgggagagaaacaagaactacccatttactgaatatccactctgtgcaaagcccagtgccatgggcattaacattcatggtatcagcaaggtggcagcaaagagtcaatcttctgagagttaagcagtcctaatcaacacattataggaaataactatgtgcagaagttatcctgtctaagagatgagttacttatattttcctcccagcctaaaaggaatagtttataaaaaatagttaatacttgaggttgatagatttaatacatatccaatttgggtaaagtgactatggtgtattctcaggacaggaaggaccctaaaggatgctataatctgactaattataattgtaacaggcttctctgaagtaatgtgtaatggaaaggtagtgtctgcctagagcctagaaaaggcagcatagggcaaaaggccttgaccagcattaattcataacaaccaatgaaagaagggactatgtagctcatgtgcattattgatttctaagtgtctaaaaacacatcagaatttgctgcagcttagataaaacatttactgaacatgtattgccagaatgtgagcttattgataatctccttagtatcaggagaggatatagcagtaacgtgtagattctgccttcagacccccctggattggtatcttgactttgccacttagaagctgtattagttatctgtgaaaacagaacaaattattcaaacttagttatttaaaacaatattatttcacagtttctctaagtcagagattcagaagtggcatagttgggcagttttgcctcaggggctatcatggttgttgtcatctgaaggcttgactggggcaggaggggagccactgccagggtggcttatccacatggctgacacgttggtctggttttggtcctccccttgtgggcctccacacaggctgcctgagagtcttcaccacatgatgcctggcttccttgaaagtgagaaatccatgagaatgccaggtagaaggagtagtgtcttacatcctagcctaagaagcatatgccctcacttccaccatatgctttttattagaattgagtctctaagtctggttcaaatcaagggagaaggaaaattatactccactttttgaagagaggagtgtcaaaaaatttgcatgctactgtaaactgtcacactgcgtgaccttgagcaatctatttaaaagctttatgctccaattttttcaccagtaaaatagaaatgacattagtatctgctttatagagttgtaaggataaaataaatcaatgtaaagagcttaaaacagtgcagggtgtatggtaagtgctttcagtaagattagcaatgatgctgattactaattctattctaagtctgtttgacctgtgatagagctaatccagagacaagaacaaaagatgctggcatcagtcacgtgtgtctcttaaatcgatcattcctataagcaacggtgttatctccacatcatcctattgggctttgcagaacctggatactgttttgcctaggctgcagatccaggacaggcagcatgcattcttctgtgtcacaaagccttgtttttcttttctcatcagaggaagtggtctggaaaagtgccagccaggctatgtgacttctcaggttcaacatcatggagatgagaaagaccaaatggcacccagggtcctgctgaaatcagaggcataaatctcagctgcaggcatgaggagcaattcaggaacccttgaatagatcctttcagattcttaacgtggcttcattgaacgaagacctctccagggttctgtcctaaagtcacctcagaaagctgtgtctctgacatcacaggaaggggacccagggccagaaatcacttcagcatcattcacctcaatttcacctctgagaattgaggtatcatgaacaaacgttacaagaatgctcaagaatctggctaccaaatagtccatagagatattatcctagattaaataaaattaagaaacatttattaggcacctactctaggcaagtcacagtatttcttaaattggaagaaacttgctgatggatgaagaatgaatagaattttaacccatgcaggacttaaagaaaataattgctatctgctccagtcaaagtccacagtgacattccaagaacatgtgtcaggaaattgactgagaaaagagttttgaatttttgacttacaaatgcattgagttcgaactagaaaccaaaatctacttttttgcctacttttctcaagtacagccgtcacaccaacaagcttgctttcaaaaagggaaaagaagatgtttgataggatcagaatatcccaactcctgatatctgaccaaattaaatttaaatgttcagaactttgcttttgaatatataaagcaacatgatggctggcaccaaggaaggcaagaccaccagtagtctaaatgttaccctcaggcatgcatgccctggcagctgacccttccctgaaagaaatgtcccttctattcaaagacaatgtctggggtgaagtaatttattaatttattaatacaagaagtaaaaaatactatttttggcctaatatccataataatatggaagaaatgacaaaagaaaccccatgggttctcaacgtattacactttcagccaacttaatagaagacttggctttaggataaatgcttgtatgttttataaacactcctattatttagggaggtctgagggcatctggacatagaatattattttcaagttatagcacataatttttcaggcaaaacttacccttcagaatggaatatgagccatttaatttccccttgtgtttagtcatatgaaaaaatgccacacaaggacccgggcagagaaacaaagataagagctagtcttttccttgcacaaaaatctgcacgaggaaaggcgatggctctcgttactgtgcacagatgcgtggctgtgaactgcatagctttcttttcttcttggaaaatggcctcaaattagtctaggacattggatgaactgttgctaactaagtaaaaagttcattactctctgcaactctttgcatgaatgccattgagttatatcaacggttctgaattcttttttctccaagagccccatttggcctctaaatctctttcacaactcctctccccttcttaaagatgtttcctattcactgtgagactctcatccaaggaaaataaatggaggtgaagggcctgggggtggggacaaggatgcagaggggagctgttttagagaagagaaggggaggtgagagctgctacccacataatacatgggcgcttattagagggctggaggactcttttttggcaaacatcaaattaggtccaagcattcatcccaattcactggaacatgcaaaatcagttgacaggttagagaagagaggtttttaaaagttaacatttgtttttcccctgaaaatatgaaatgactgtgggctgcagaaaaaagtaggagcaaatgcggagggttttttttttttttttagtatgagaaactaaatggctggaatggaactatttcatattttagatgcaggctgtgatcgctgaataaccttcttattttgactcacagcttgacacaatgcaggctttcattgcatgaagagccacagcaaagagttttgggccactttctctttttattcattttctaagccccatccttctcccaccccaattcccccatttcctctgtctgggtttgaatagctgaagtgtgcccacaatatgtatgcactagacacattgttacctcccttttaccaaaagcacctggcagggtcaccagtcccaagtccctccatggtgcctggcttaactctttgagtgacaaacatccaaatatatttttcaaataattttaacaaatattagaaataatctaacaaatgattttaattaatactttatgggaagaaaattaaacctgttatatttggttgttttataattttctttctaatttcctctcttctcgaacccttttcccttgggttcttaacttacaatgtgaacttgttctttcccagctgaatcagtgggagatgatagcattcattgattttaaatctaaatctgaaaatatctacagactttgtggtcacagaacaagcaaccacacatattgggtaaaggggaaaacattacccattgtgcagaaaagcctaggaatcatcagatgctttgtatttctagaaacctcgctcttttcaagaggccagagggccatcagaggataactcttcagctttctgcttccagccaatatggagtaacagggactagaggtacccttctatctgaaacaaccgaaaatctgaaaaaactatgaaataatcatttcaagacactggacaacaggtagcttaagataacctaaagcagatgcagatctattttagttagaagttgtagtttgggcaatcagcaaaagagtttaatttcttccttggtggaggtgtagaatgttggacatgctgcttgtagtaacctgtgggaggcccccctcttgtccaggtcagacaggagtcctccctaaatactgtgtgccatggatcttcaagaagtgcaccagaaatgggttttgatgagtagaaaacctcaatctctcctcattttcatccagactgaggatgaaatgaaaatgagagctacacctgtccttgaacatgagcacaagctgattgtgtttggagccacagtagaagacaggagccataggaagtcaggggctgcctccccccatcacaacaggggctagcaatggccttcttaggggcagcacctagaccacggtgctcaggggggaacagcatgtctggagtctgtggctcacgtgcccataagatgccttcttcccatgggatgtgactggtgaataggttaaaaactaggactttgaatcctgatttgaaaagtaagtgtgattcttgagggagcttctagggtgctgcgaatgtcctgttccttgatctggatgatggttagacaagtatgtttattttgtgatcattcatcaagctgtatattgatgactgtgaacttttctatacatatattatagttcagcaaaaagttaaacaggcatagtggctcacattaattatgtcttttttacaattacttcattatagaagaatgtattagtaaagctcgagtattgatttcacctcatatttttaatgatgatcctagaggtcttacatattttcaaataacaaataataattcattctctttattcctgcaggtggagacaaagctatatcattcaatcctatgccctttgttaggaaatatttactttttaaatggaaataaatattgtccttgacaagagtgtggcagccattgggcaagtaggatggtattatttagaaaatgttgatgcttaacaacacaaaagcctggattttttagttaccagatgactaatatttgtttgttcatttttgttctgttttgttttgttttgtttttttcattcctaatgtcataaacacaatgccttattttaaaattgttctctctgtttgatgttaaattcttagagtcaagcactgtatcttttttattttaaaatgatggtacagttggcagtattactaatgtgcttgtgagattgaaaaggacaatacttcccagaggcctgttagactacacaccaatccaaactaaccttaagtgaccagatattcaatattataaaatacagtcactaatttggactctgaccccaaaccaacaaatgacctagaatctgtctcagtttaatctcagcacacctgaacatcatttatctataggcagctcctcaagctaagtggccatccaaatacaactgtaacacaattttcatgtagaagtccaacttgagtttaccgagggcattttccattcctcttttgttgaaggtcttctgataaacatataacctgaaggcaagtgagatcatttttcattctagcctacaggaagtggaagctaggctggaagtggccccaaacagcatggattctggggggagaaagtgtggtaagaagggaagcaagctggttgctgcaaagtttgatgcagggccggctccatctggtcacataacacggtccactccacacagcccatttaatacattaagaagggataaggagaaggctgtgcctggaaaagctgtcatcaccttcattgatgagccaagagcttctattcatggaacacttagaatatacctatttgtcagagtacagcacacctgacatcacctgcaaagaatagctcaggtgcagaacccgtcaggagaacatcctatgagggtaatggcatggcctagaatagctgtgagcaatgagtggtggattctagattagttggtaaactccagcagagacttggaggagaccaccactacctagaagaggcaggagctctgggcttcagatccgtccaactagtatttgctgaacagtgttctgcaccaggggcagtaagcattggatatagaagtcaacaagacctgaagttcacaaggagttcatagtttagaacacagtagacagttcactgagttggaatttgttagaaactgtaaataaccagagcttttagtttactgtaaaggagtgaataattcatgtggcaattgtccagatgtctacaaggagatttccagctcctgttctcttagattcaaagttaaggaaacctgttttgatgaagataatgtccttaaccaaggcccaggaacaggggagaacagtgaagtccttcaaataaagttttcaagagaatagaaagagaggaacctctgggctcccactctgaaggctggtggttcaggagctcccagagtatgggtgctgagatgagcatgcatcctggggacagtctggtagcctgaaaaaaatgtgtctgagggctaacatgttcaactcagtgtcatttggttgtgggaactcctaaatgagcaatgtattagggaagagcaagtctaacttgatgaactgccagggactaggcaggaattggagtgaaggcccagtctcaggtccttggccttgatcatggccaaccgcaatatgcttcagccttgtggctatggcatagtcaacagagaacctttttgaatgcctggaattcagctagctctacctttggaagaaggatacttgctttgcaacagcaatgaaggtcatcaaaagaggtgcatctgagtccctgctccagaaataaaactggaaaactgagaatttgttgaaattctagtaaactccttggcattctgggctatatcagggtatatagtgaggatgtcggaaaactgaaggtagtaaggcagggattaaaggggttggatttcttgttatctggccatgtgagaaattaagtattttactttgggtcttcactggtaaatactaccttctcatatttatttagtttttctagccagtcaaatttagcagttgggggttttataccaactttggtgacactaatgttaataaattctgataacccactaccatcagaccagcccttctcagattgaaaattaacttatgtctatggtcattttctagttactattcaggagttctctcgtacacacaattcatcctttaaattgttaacagtgtctacttacactcctccatcagaaacaaaaaggatcagagaatttaccctaacaggtatttctgctaatccttttatttttgaattatttaatatttttgatagggcattcagaagagacctcagctggaagattacacctcatacaacatcttgcttttctagtttatcttgtatttaaactaaatccttcagatgagaaattgaagcagaaggaccactcccaaatcaaaacggagagagtaggggttaagagtacttggaggatggaggattttccactttgctcagctttggggagtgaaggaaatgatatatcaaagtagggacagaactcaatgccctgggatacaaatgtgatgtacagagagtaggatgatctctataaggtacagtcaggatagagcccagcagtgcctcaaccgtatacatccctggctcaggaaatcctgcactccaacagcaggaaacataggagcactctgaaatcctagggcttaaaactcctcactggtggagaagggttagcaggctagcaaaggaagctatatgaaccctagtgagaagagaggaggaaatcagtgacccaaaacaaccaggcttgggaggccaggctaaagggagaaatttccctctccaggagattacaggaagctggtccagacctctgcggcagcatgaatagccagaggaaggaatggggaggcagataaagagggcagctgaacactggctcggccccttttaatccagctgacagtgagtggaaggagaatagtggatgcccggacaagggcatgtggttctaggtgatcgtgggatcctgcagagtttgttgtcaatgggcagggagtggagaggagatgcacagttgttaggactggacagtttggaaatcacatttcaagaaaatgacaaccccagtagggtaagtgatattgaaacaaggtttgcagagagaaaatggtactcacttatatttgcacttttaagattcaactttacaaaggtggcatttcagacaaatatgaaattgataatcattttttatagggctcccaggaagagccactctgtgatgtgaattctatctagccctgctgatttgaggtctctggattccagaggggacacttggatttgacccacagcaaccctattaactcattgctgaaatgaagcaaaacttttacttgttggttgactgattgattcgtgtaagccccctcagattctagcatgcatgagaagaggaagaagcctgatcaaactgtctcccatccataatacaataactatacattattaagaaagatttgcatctgaaatgctcaagacaactgagacacttaatactattaatcacattatgagccccaagagattgcttactggaagggattttgagaaatttacagatgggaaatggaaggcaccacaagtctgctggttctctgcccattttttttctcaaaggtaggaaatgtccctcttcattgtgagattggctcatcatgctgtgaactataatgagcagactgggtcaagggtcaggggagtggagtgaaaaagagagtgtgggtggtcactgcacaaaaagccagttccaggcaagatggtcaaatttagtttcagcaaagtgttcttgcactgcctgccaagaagatggggttaattggtaggaaagtgtgggaggaaactgatgttagtggaacatttaactgcatgctttagcatttaactggattctgtatcaagtgatgtgtgtgtgcgtgtggtgtgtgtggtgtgtgtgtgtattaactcaccctacaaccctaagaaatgagaattagtttcaccattttacagatgagaaacagattaactaatcttgcctggctgcatagagttactaagaggcatagtgaggctcagaacaaataactgactgagtcctatgtgtttgctgttttaatatgattcaccttatttgttaagtgttaactatatatatatttatgcacatacacacatatacatatatacacatacaacacacacacacaatcagttctctatttgtgcaggttctgcattcacagattcaaccaacagttagttgaaaatatttgggaaaaaaacaacaatacgacattaaaacattttttaaaatacagcataacaactaagcacattgtattaggtattgtaagtaatctagagattatttaaagtattcgggaagatgtgtgtaggttatatagaaatactataccattttatatcagtgacttgggcatctgtggattttggtatctgtggggatcctggaaccaatcccccatggatagtgagggaaaactgtatatatttcattttattttcattttaaaaagttgcagttggcagacagaaggcaactatgcttccttgctatggaatttcagccacttaggatagaggtgtggagcaattacattttggcatggaattttctcgaaatgccatgcttagagcttttcctgtgtgacaactgttaccactataaaataataaacggtaagcagagtgcttaattgccctttccatcttcacacgtactccaccacatggtaatcagtatatggtcctggatgaatatttatttcagccctccctgtgaatatgcaggaatgtgaggtattcaaagcaggaaactgcaccatcagcaacattgtctttgattgttggcatttgctcacaggcgtccacccaacggcccatgatcatcttgtaaccagtgcaggaccttgtgcttctggagccattccagttgtgggaggtgatgtctcggaaaactctgccttggggactggctatagaaatgtggccagatggctttgtcatcttcccctgtctactctgtgactcttcatctggtggaaatgctgtgagggatgaaccaaatggaaactcagatttactcttcagaataatgcggatcataatacgcacacacacagcatgtagagttgctgtgtggcttaaataagtaaatgtatgcaaagcactaaaatggtgtctgtctaagtgtaaacaccaattgtgttggctattatcactattgttgttcttatctcaaatatgtgttactttctaaataactttagtgttcatagattgttaaaagacaagatgacctgaagaaaagtaagccctaaaaatccattattaacttttttctccaccactcttttcttctaaacttcactattctttgtgttttcacaaaagttgcttacttcacctggcagagatagcattacgcaggggatgattaaaatatactcacttgtacttgttggttttaaattttattatttatgaataggtaatagcatgtacactgtaaaaatctcaaaaggcaaaaaaggatatacagtaaacattaagttcctcttaccctggaccttagccatcaagttctcttccccataggcaatccctgttgcctaatttccaattcccctgcatactttaaagatcatctgtgcatctgcactcagaccactcacacgtctaaaacaaatgatagcacactacacacaaagttctgttcctttttatgctcaatgatatgttttgcatcatatttcactgccgtataaataatgctgcctcgatttttaaaataactgaacagtaatacacagtatgaatttactccaatttataatccaatccttagttaatggatattttgattttgttgttaagaatcatgcagcaatgatgtacctgttagacatgagttattaatttctcttcgaagaatcaatatgtcactacgttcaattctttgccttctacttttaaacttcacttcctcataaagcaaccttttgcgatcatctgctccaccctgactcattccaatcacctgctccaccctgactcattctgatcacctgctctgcccagactcattcccatcacctgctccaccctgacttattccaattacctgctccaccctgtctcattctccaccctgactcattccataaccatttttcccaccaaaccagtcaccccctcaccctctttaaattagctaatcggaattagtttagcttgtgtggtctaacctagccaatagatgaatgacacagcagcaggagccacgttcgtcagggataagaacaccttccccttccttgtccaggggtgtactcaccattgctccatctgtgagggcgcacccttctatagaagtaaattgccttgctgagaagaaaaaaagaaaattttatatttgagtgctatttattttgtggcaccaaaactatttataacatacctgatctttattttaaatttttgtttatttaaatattaaatatattatccacctggtattaatttgtttaaataaatgtgaggtagggttccattgctattttttaaccaggtaggttatattgactaaccttcactttgaaagtgatttgaaatacacttttcatttattaaattctcccttgtgtttaggcagtaaggcataatatttgagagtgtgggctctgcagtccagctatctgggtttgaagtttatctcctttatttgcgagtggtacaaacttgaacaaattatgtaatttgtttttctcaattccctcatgcactaagtgaggataaaaatagcaataacaccatgagattgctgataacaaaatgcaaggtaaaaattgtgtaaggcttaaaattgtgtagcctggtatacaagaggctctaaataacataagctattattgcttttctacttattattatttctggcttttgtagtctttttcccattgttgatctttctactattcacaaagcatgagtctagtatctgtagatttataaactaattaatgtaacttttcaatatgttttaatatctcatagatactgttcttcctcattacttttctattttataaatttctatttcatctgcttcataaattttgcattctcataaactaagaatcatctcctgtagttaaaaaatattgtttgtatttttgttgggagtagagtgaattaaaatatattgacttaaggagaactgacatctttataatattgaatcttcctgtttgagattggactttatgtccatattttaaagtctttgtttatgaccctaagtataattttaacgtttttatattaggcttatttctagatactttttgttaatatatcatctaactggttgttcttcatatatataatgactatgaattttttctcagtcttttttctgaattctcacatcatttgtgttatatttttaagttgattctcttgagtttttcaggtaaacaattatatcacctataaaaataatgttgccaccttaaattaagaaaatgtttttctattgtctaattgcatggactgttgcctcaggaacagtataagattgcttacaaaagccttgctttcttgttccagattttaaaaacaaggctttcaatgacaatctcgctagcaagaagctggtatacttacatacatacatacaaacagacagacacccactttctatatgtatatctagatagatttagatagacatatatgtgtgattcctgttaagatgaatctatttttggtatttaagattttaaaaatctagaatgggtattattatattgtattgaagctcttaagcatctatggaaatgaaagtatgattcttctctttcgactaattaatatgtgatccatagtattttagtaacagatttcctaatatcgaatgatctaggcattgattctagcagattatgtctatgggtattttatttaagattttgcatcagtattaataaatgaccatggtctatgggtttgcttttttgtgtgctatgtttgcagagtgtttgtagtttacaagagatttttgcaaacttctatttatgacaatatggtagattatatatctgaaaaaaaaaccttctcattacagaacatatacaaaactgctgaataaaacgaggcaaccaacattttaaatatatggttaataaggtttt

SEQ ID NO: 1636 - DNA, 97002 bp, Homo sapiens
  source 1..97002: mol_type = genomic DNA
gatgcgcatgcgcggccgatttgcacatgcgcaatactcgcgctgcctccgtggtccctgcctggctgaggtggcagcagggggcgggacgcgcagcgctatggcagagggcagcggggaagtggtcgcagtgtctgcgaccggggctgccaacggcctcaacaatggggcaggcgggacctcggcgacgacctgcaacccgctgtcgcgcaagctgcataagatcctggagacgcggctggacaacgacaaggtaaccggggctggcggggccggagtcacaggttcctgcggggctgagccgggccaggggcggcgtctgtcagggacccaccgcggtctccctcgtcccggcagcagagggaccgcgagtgaccccagacctgcgggctccgctgctctgcgggcgccgggggcggtgagaagggggagccccagcaacctccggaaaagcgaaggggtttcctgggtgttctctccacctgaaaaggtgccttcaaggctctctggatgggattggtgaacggtggtgcctcgagaagtgtcctccaaacacccctggaggcgtttggctgtgtgagctgggagagtggaggagagcacaagactggatatgaaacagatgcaaaagagcagattccaagataaggtagcgcaaatgggggtcgggagaccaagagagcagtggtagggataagggtgcatttccacggacaagtgacaacaattgcaataatttgcagcgcgaaagaactacctttgcccgtggctgaaatgaactcatatctactagtttttgttgagccaagcgctatgatttgtgggctcaggctgtatttctttagaagataaactgacagcatgctctcacaagtacctcctgaaacttaagttggactttacagctcctcacatacccagccatctcttctgtctctgtgggtcgctaggtaaattggtcatgacagtgtaacataaagaagaacatatgtcaaagttagagagttttataggtgaatatgtaggtaactgaaaataagctgtcgataacaatttgattccgatatgtaaaaaaataacattgcaatgtaatgaataagaaattagggctctggagactaccacttattagatagaaccactaaatgtgtgcatcatgatttgagtaagtcccttcactaatctcagcttctgtttaggaattaggaatcctgctgttaagtttctcatggttgttatttgaggactcagtgagagactccaggtaaagtcctttgcaaagagcctggcacttactctttcttaacaaatattaattttatcataaaatttatgaagtgtttaatgtgtctcatattgatatttattatatcatttaagactgctacttgctctgatatagataacatggccttcttttttggacagagttttgctctttttgcccaagctggagtgcaatgggcgcagtctcggctcactgcaacctctgcctcccgggttcaagcgattctcctgcctcagcctcccaagtagctgggattacaggcatgtgccaccacgcctggctaattttgtatttttattagagacggggtttctccatgttggtcaggctggtcttgaactcctgacctcaggtgatctgcccgcctcagcctcccaaagtgctgggattacaaggcgtgaaccactgcgcccggccacataaccttctttttaccatgaggaaaataaagcatggagagagtgcagctaggttgtcatataactagtaactggtggaactgtaatttgcatctgagtctgtgatttcattcgttcaacattactgattacttctttgaaccagaccttaggacatttcaaggctatagtctaaagaaactgcttcacttcatgggttttttttttctgtacagtaagtatttatagttgtaaacatatttttgcttcctctgaaatattaaattgaatttatataaatagttttactgtttttgtcaatccagccaatatttcaaaataacaaatagaaacatgaaagggtaagcctactagaatatacagtagtggaggtgtagaaatgtatatctgcagaatttagtgtacaatggggatgtcctgggcttggttctctgctctctcttccattcatgttttctctgtaagaaaaatcttgtactttcatggttttaagtagcaaaaagcatgattactctcaaatttataactctgtttctgacatctactgagctccagatttgtagaattagttgtctatactatacctccaattggatactgattgacgtcatagaacttaacatgggcggaactcttgatttttccctaaactggttccgctctcactaaagaacgtcaccatttacccagtcaagcaagaagcatatgaataattttggattcttgtcacttttttttttttttttttacatctcctgcaaatccacaaacatatcttataggttctactttgaagaatatttttggaatatcttttttttttttttgagaccaagtctcactctgtcgcccaggctggagtccaatggagagaacatggccttactgtagccttgatcttgctggctcaagcgatcctcctgccacagcctcccaggtagctgggtctacaggcacatgccaccatacctggctaattttttgatttttttatagagataggggtcttactatgttatgcaggctggtcttgaactggcatcaaactatcctcccaacttgacctcccaaactgctgggattacaggtgtaagccaccgtgccatattttggaatatctctttttcatttgtactactgccatcttggtctaagccactatcaaaccatactgggattatttttgttttttctcttacctacctcctttcttgtacccctttaccattcattttccttacaaagttggaataaacttttataaatataaatcgtattacattactcccctgcctaaaatcgtaataatttctcataacttcagtcatagtggccttccttctaccactttagggtctttgtactcattgtttgctctgtctgtggaaggctttgtccccatgactggctgttgcctacactgaggcctcagttcaaagtcacctcagagaggccttcccctttaagtttctccaagttctacttccagttattcagtttctagcctggaggattccagtacttattcttaaatagatcattccagagatagttaatgtgcacattatatatgtgtcaactaggtatacacaagtaagtatgcatgtatatattccttttaagtttttaactgttggtattacaactgtttctatgccttgatgtttcacttaacatatctcaaagcttatactacgtaagtgcataaagattttttttttgtgaatgagtatatcataatttatttaaccaatcccttttagatggacatttatattatttctagtctttgcaattcccaacaattctgcagtgaataatcttgtatatataacactatacacaagtaagtatacccttcttgtgttctggaaataagcatgcttcagtaatttgaaggtcattcaatatttttcggattggttaatgaaaataaatcatttgaaaatgatttcattacattttgtcttgagatttgaaaccatttaaaaattagttccagtaactgtcttctgttaccaattgtataggagatgttagaagctctcaaggcactttcaaccttttttgttgaaaatagtctgcggactcgaagaaatttacgtggagatattgaacgtaaaagtttagccatcaatgaagaatttgtaagcattttcaaggaagtgaaggaggtatgtaaactcttttcatttagcatatattgagaacttactattacgcctggctctgtgctaagtatttttttgaattaggttgatatgtttgctatttgtatactatgcccaaatagaaagcttagctaatttctcttgctgcatctagatctttatttgtattaatgtgatttatgaatctgtgacttccacaaatattaattcttagaaagttaacattgttctagaagattatcttaggaattttagcttttttaacaaaaaaattaacatttccctgaatggctttccaatagaaatatcccctcattgcataaacctctcttggataacaacttctctactggagattaattagaattgagttacttttactatatcctaaaatatgaaaatttcagattaagatcagtaacttcaatgtattaataatgattcatcatacttgagagtgtagtccactcaccacagagtgaaaataaattttatgttattatatctttattatgtaatattttattagctgttttaatacattgtaatactaatatatttctatgtgagttatggaagtgttgcacatggtttcaatgagtgttcaataaaaataggttgtttttgacaccttggtaggtttttattgactgaagactaatactttggaaaggatttttttaaaaaaaattacattagagatggactcttgctatgttgcctgggctggagtgtagtggctgttcccaggtatgatcatagtacactacagcatcgaactcctgggctcacgcaattctcccacctcagtttcccaagtaactgggactacaggtgcctgccaccatgcctggctcttttaaacatcatttcctactaaaaggaacaatcttaccagtatcagaaagcaaagatgctatctgagactattggatacatgtcaaaaggactttggagctaatgtgaagaggattcttctactggccaaacataagactatttgaacatcaataagagtaactgcaattgaataacactagcaataaagggatattcagttttataaagcatttgctgttttcctgcggtcatattctctaaaaggaatggactattttctttacattttttctaacactagatgttattctttttaatcatttccaattttaaatatgggatctcttgtcatgccttgaccaaaaaaataaaaaattatgtaactaaaataaggatttagctaacagaagagaatcttcttcttgctgtatatatgatgtttgatgttacttttcttcttttcaggaacttgaaagcataagcgaagatgttcaagcaatgagcaactgttgtcaagatatgacaagtcgcctacaggtattatataatggctagattttggcatagttcctgatataaacttacaaaaattattattgacaaaatgtgtagatatctaatccataatgccctgtaggaaatttgggtataaatataatccttatttttaaaaattgtagctatctttgtgtttctttggataatgatttattaatattgttcaattaactttagagcatttatattttggtctagccagtacagagctaactacgtagaattttgataaacctttcaattccgtaatattctagaaatctaggagtaatgattttttttagtaagaagccttaggaataatttcacactaaagctgtgcctgataaagacctagcttaattctgatttatgcataaccttaaaaaattctgggaaaatatgtatacttttaggtcttttaatgaaagcagtcctaaacttatagtttggtagcagaatcagcatttgacttaattaacctcattcatctaattttggaatagtacatagaacggtttcctcctaagggccaatcatgattatgtctactgccttcacattttaacagcgaatttatatctctaagtgtctcttggaacgattgacatcaacagtgattctaggaagaatcattaatgcatattctacagattaatcacaggctacttgcatcatcagtttgcaggatgagttaatttcttgtttctctaaaattttatcttttctggtcttgtctaaattttgatattcttactaatctatcagatattattggcatgtttattgtctcttagtccaatatttagatatttgttaatttgacaatatttaaataattatataatatatactaattattaatggccatttcacatttttggcatatatttactttattcctcagtggttgattttgtttgacccttctttttctttaactttatttccttttctcctcttttagcttccatgacgtaatgccttttctcaaattatactttataaggttttctatattgtacttttgtgttttttaaataacattatgctttgttatattagactactcagtttctgatctttagtgatagtatctcttattttttaatttgtatccttaattatgtttttatacttttcatcatagagagatttaaatataaaaagatcatagtatttttatttgtgctatttttcaaacagtttataaatattttaaattacaaccaaagtgtctctttctgttttgtcctttgtattttttttttttttttttgagacagagtctcgctgtatccttagtggcgtgatctcggctcatagcaacttccaccttctgagttcaaacaattctgcctcagcctcccaagtagctaggattacaggcgcctgacaccatgcctggctgatttttgtgtttttagtagacacaggatttcgccaggttgtccagggtggtctcgaactcctgacctcaagtgattcacctacctcggccttccaaagtgctgggattacagacatgagccaccatgcccggccagtcctttatattttctttgcacccacctcacatcctgttttttcttctgcagtggcatgggcctattttctttctttattcagatcaactttattgaggaataatttatgaatggtaataaactgcatccattcaaagtgttcaaattgataggcttggcatttttatatgcctgtgaaacaacaactataatcaagatacagaacatttttatcacatataaaagattgcctcatagctttctgattgaatatttaaaaatatttaatactgcctattgtttacatttgtttttgatccacatatcatttttaatagtaggaggtccatgattttgaaagttttgtttattccttaaaattttgcttaaagctaatttatttggatatagcactattggaattctaatagtatacattcataatatcaactctaatgtttttaagttattcataaagaaaagtgtttcttagagtatcctcactttccctttttcttatagaatgttgttataatgattcatttaattatttaatattttctgaaatgctttgactatggtaccttttagaaattattagaaaacatttaaaaatgtaatcagtcattttatatatgttaatatttattcctttgtggttttccttgcatatgtttaaataataaacatgcatttagatgcatatgtttattattaactcaaaaataatcatctttaacatttaagataaatggagattgaggttaatcttcattaatattattaaatattactttggaattcttaccatagtttataaatgaaaaaatcaggaaatatgcaaaaaaattagcaaattcttattatataacattgtgctaaattatcatatttcattgattaataaatggtgttgattgtaaggtgcaccctcaataacgactagcctaaaaagctagtaaaggttttttgatgttgattttgtgaagcattctttttttcagaaatattaaaatgtaaacatatctttgacttgaggggatactatattttaaaaattgcacaaggcaagactgtacaagggtggaaatggaactttagcatttaagaagtatgagcatttgaagaacttattggcagtctaataattctaaaagaatattttgggagctatcatgttgagctccattccttaaaagtcagtgaaatggctgggcgtggtggctcacacctgtaatctcagcattttgggaggctgaggcagaatgatcctttgtgaccagcctgggcaacatagcaagaccccatctctaccaaaaacttttaataagttagccaggcatggtggcacatgcctatagtcccagctattctagaggcttaggtgggaggattgcttgggcccaggaggtcaaggctgcagtgactcaagattgcaccaccatactccaggctgggtgacagagtgagaccctgcctctttaaaaaaaaaaaaaaaagataagggatatgcaaaattatctaggttcaaattgttttcttaaaaaatctatttcctgggaacatacactcaaaatagcttcatttgaggtggcaatcaggctctgttattgacagcatacctagaaagcaataagacagagaatttccctcacagtctgaaaactgagtttgtagaggattaggcctctaagaacccagaactggaggtgtctaggtctaaggcagctctagaaagaaaccgcagtagcagaagcttgactctttattgtggtattccaacatgaaaatgacccagtgtcttcaggtgtttgctctggtattttctctttaacagactgattcaccttctattttatgtgtttttctccactttactaatgacttaatttatgcatctttctggctcatttaatatttcttcaaggcacagaccttgtttctctacgtgcctcatgactacttctcttcttattgtttattgccttatttttgtaaatattccctagttcagatatttgagagagaatctcattgtcttttgtttaaagccacttcatgaatgttttctaatcttggataagatgcttttttaattgactttccacttttgatcaactctggcttagggaagggagaattgcttagaatgaaagttgattaggaacagccttgtgtcctttagatggggctagctctgatcctcaccaaaaacttatatggcaggtagtttgtatattacaactttcaaacttttacctccatcttatacatttctattgagctccacactagcatttcagtgacttagttaacaaccccatgtaaaggttgcatggtatctcagttcaacacgtccatacctgaagtcatgttcttcattcttaacttgtttttccagtgcttctgttgcactaaaaagcatcatgaactattaagttcctttgtcagtatctggatacctttttctttcttgtaagccttagcattatgtgtatattaagaactgagtgtgttcctccagtggatgagccttgaaacatctacgtatttcattttattgtgcttttgagttccatagagtgatctcatttgttttaagtctaaattgcagtaagtggtagtatttgttttctgaaatataataaaattggaatttacttatattagatatgtttataattttaggcagcaaaggaacagactcaagatttaatagtaaaaaccactaagcttcaatctgaaaggtaagtttttcttcatacaaccaccttttcaataatttggagattggagtcaaagaaaattatatataactccaaatcagaattaaagcagaataataaaaaacatggttcataaggtcctaaactattatattacccaatagtaacttaagcataaagacagtagtttaggagcaataaacttgacattgaggttgagagattattccttctttggaagagaggtgatgatgtatcgttattgtttgctgtggagttcagaaatgatgctttttaaaatgtaaatgttttcagatttttaatagttttattacttttttttcacaatcattgtcttttatttttaagctatgatatatcctctctggtataattaagagttaattgtataaattctccttgtagtttatacaataggtatactattggttgattgaatgaatgagtgagtgagtgaataaaggtgagtacagtctggatttgtgtaatgtgtggtgttcagtattgctaaaactcatagcaattatgctaaaactcattaactgcatctctcatgtgtggagtagtatagggggggagaagcattatattatgatgcagtatacttgtctcctgctcagtagttgggtacatcacttaaaccttttagtattctaggtatttcatcagtaatatggagatattaccactttaactgctgattttggggtaggtcagtatactatagtatagaccacaggttatcaaactatggccacaggccaaatccagctcaacacctgcttttgtaaatgcagctttattggaacacagctatggttgtgtttacatactgtctatggctgcttttaccctactgcagtagagtcgtgtggttacaacagagaccatatgtggcctacaaagcctaaaatatgtactatcaagatttttacagaaaaagtctgtgacttctgatccaactagtgtttttttgtagttcaggtcaagatcaatgggttgtaaattatgatttatcaatcattactactatttaaatcgatcatagctagccttaaaaaataaattagaatgaaataaaatagaaaatagtttgggtagctgggcatggtggtgcacacctgaagtcccagctattctggaggttgaggtgggaagatcatttgagcccaggagttcaaggttgcagtgggctatgatagtgccactgcactccagcctgggtgacagaaggagatcctgtctctaaaaaataaataagtaaaaatagtttgagtgaatattattttgtgaagcctttctttcagtttcagtaatggttttaaatggtttaatattatgggtcataatcaagagtttgaaaaacactgccctagaccaaaaatggcaagtacatgacccccaactccttagttttacatccactgatcttgacattcttttattttgagcccttaatccttcttaacacaattctcttcagactaagattgatgaatgggaaattataaagagtgcagaggtgtaaagttacttgtgtaaaaggatatcatgggtcttagggctacaaaggactcagagatcaactggaatgatccattgcagttaaaatggtaaccaatgtaacttacttttctgtcttataaaaacattgagaaaatgtgacaaaattagcaaaataaaatatatgtaccaatatcatctaaaaaatactatctttaatagcacaaaacaaagaaaacattttctttacacgtataggaagtacattattggatattggaacatgtaccttatcttagacctgtggctttcaaaccatagttcattgaacctcagggtttctttgcaagacgtagaaggataatggagttttggaggtcagattctctcaccctaattttagtgagagcagtttcacttttacttgtttaatatattaggattccatgtaagattttgtttgaaaaaagagtttgacagcaggaaaatataaaaatattgcacaattttaagactagttgaaaggtagaataccaaataaaatagtcttttgattttattcctcatgccagagaaaaatctttaaaaacaactaagtatcaaagctttataaaagcttaatcataatttcatgcatttaatcccctttttgtttactaactaccttctctttcactaaaaatccacttttacccgttgtgtgttttctacaagccaaaatgagagcaagttgatgttgtcctcagatttatagaattgcaaattgcctggatagaaattaaatttaggaagtctggccttaaattcccttttatcttgttgatattgtcattctgtattttatagctggataaatgatcatatcccccacattggtggttaattacttgatgttgacctataagtcagttttctagtacttttcagagcatcttcaatccaatccttttgtgtttaacatttaatcaaagactttagtgtatatatagacaacttacttggaaaattgtgaatgacacaaagtatggaatgttaagtgtaaggtatcaacagaatcaagcttttaagaaaaagtggggctgggcaagaggtgaataggatgataaagggtctcaaaaaatgatgtagggttgaaaaaaacagaattgtttatttagaagtataggactaagaaggacatgatggctgtcttcaaatatttgatgatctttcctgttttaaaaaaggctaaattttattatatattgctgctgagtttggaactgagttttaaaggagaaatttaggcaaattttgacttaacgataagcaagaattttctatcccttacaatttgaacaattcttcaaagctttttttttaaaatcactggaaatatttagtcttatgttaggtgtcattggagccatcttttatttcagttttcctttctggtcttttacattacgattcatgtatccacaccttatcacagtaaacataagagccaccaaggagcttgataaaatggcaagttttggcctccatcctcagagaatctgactgaaaaaagtaagcaactgtgtttttttgattaatgactcagtaaatcttgatttgggctcaggattcggcccttttaacaatatcccaggtatttttatgcagtggtccagagactataatttgaaacacctggccttagacaaaatattacttatatttttaattttttgtggaatgtccctctcccctaccttaattctctcatctcctaactggtaaactttgaaaaaacattttaactttttaaatgttaaactttatattttgagataattatagattcacatgcagttgtaagaaacaaggccgggcgccgtagctcacacctgtaatcccagcactttgggaggccgaggtgggcggatcacgaggtcaggagatcgagaccatcctggctaatgcggtgaaaccccatctctattaaaaatacaaaaaattagccgggcgtggtggcgggcacctgtagtcccagctactcaggaggctgaggcaggagaatggcatgaaccagggaggcagagcttgcagtgagctgagaacgcgccactgcactccagcctgggcgacagagcgagactccgtctcaaaaaaaaaaaaaaagaaaagaaaagaaacaatacagagatccaaggtagcctttaccttgtttctgccaaaggtaacattttacagaactatagtatggtaccacaactaggataatgaccttgatactatctacctgtcttattcagattttgcagttttactcgttggtgtatttatttttatacattttatcatttgtagattcctgaatgcgccaccatagtcacgatatagtacacagttccatcaccacaaatagtgtcctgttggtgggtggacagtgtgagaaaagttgcagactaagcccatgtgggagatggttgactctgcaaagcagccagctctgtgaggaaaggcagtgttaaatttctttatcagaattaagcctgtgccttcaccataaaattagattgcattttataacagttcttttgaaagaaaagtttcctagaaaaacacattccctgttagagaccttgacattaatttttctctaagttaatgctgaacacaaaaacaagcattactttaattgaaaattgtgattaaaactaagaggataacagatcaataatcctgtatgcaaagcctttttaaacttttcctgttctcagttaaatctttttgttttaatttttagtgtaataggtattacagttgtttgcaactaatcgttgatttgattgtctctgtttctcctaaactgtgagctccttgagaaaaatgacaatttcttattctcctttttgtatttgcagtgcctgctattttacagattcaataaataatttttgagtaaatgaatatggaaagcaactataatgttaggaaaggaacataaaactgaaaaataagcattgtattggagcttgtaatatggggctctaaataatgtatataggagacaatattagaacattgtgcttctgttcatgtgttctcaaaactatttaagcaaggtttatgtttattattttagtaagcctgtggaagtgttttggcctgatatgcttttgggaagtgaaaatttatgacattctggtatcccaagagctatagatatgatgtgccaagtgaacgtttgtgtgaatgtattttaggaaaattgcaaggcagaaattatgataacaggtctctgggggctggcagggagttgttttttcattttaaaatatctttttaacaagaaactttgttaaacaagcagttagctttagaaatagaaatctgtttctatatgggattatttgaataatacgatacttttattcagacaaatgtatgaatgatatgaatatttttccaactgagtgagaaggaagtcagtcgtcaggacagctgagatgctctaatagataaagcttaatgtagaattttattcacaggactgcaggttagcatttccccttaatagttcattggtagtcagacgatgggcttcactgataatcaggaaagactatatgtacatgaacatacctttgtatttttaaaatactactaaaatcactattatatttttattatctcttataaaggcccaccagccagaattctctctggactcagaaaaataatctctggagaatgtttatgtgtgtgtatttttttaagttcagtatgttaaaatggaaagaatataggacttaagacaaaaatctgaatcttaatcgaaaccttgggtaagagattattagatttttgattttgtacagttatttcttaacctcccttaacctaagtttctatgtctgaaagaaggaaggggaaaatatctatgtcatggggtttttgagataactaaattatttacgtaagttgctgaagacactgcatggcatacattaaagactgttgcccctccctagtcctccccttttattagacaaagaaatctatgtcactcatcttatttctatttttgctctgtcatctaggaagcttagagctattttgtgcttaattgcaatagctttcctcagatgtatgatttactttctcagcctttccctttatttcttactattttagtttttaatagttttaatttatttttattgcattgtaaactactttaactcaggttttgaaattggtagcataaaaatataaaactttatcttgcataaatggttttatattgcatgtaaaagtatattacagaagcgtatgtggcacattttctttcattacctaataaaaggttaggggaaaacaggggagcatcacatctcctttcttctttcttcttgtctcatttgtacatagtagcagctatccaaaaggaaatattgccagtgacatgcaggagcctgactgagataagctataacaactttatttcagtcacacatattggactggaaataaaaatttgggggtaaggcacagtatggcttatccatttcttgtgattatgatcatgctgtaagggaaatagtatgaggaaaaatttagaaataatctttggtttaagtattttaaaagttgggtttggagatggtatggatttttttaaatgaaaattttgtctgatcaaattttccccaccaatgaaaaagagcttttttttgcgtaacattttttccccaccaatacaaaagagcttttttttttcttcctttttttttgtgggcacgcttcatttaaagtggctattgctgtttatttcctgatttaactacatttatcaaccaggtagactttttctatattcttattcattctacctggaattccatttcccaaaattaatttgttgaaaactcatttgtcattttaggttccctgttgtttatgcccatcatatatttcaaaatattttacaaaacttaagaattttaggctatcatgtatgtgtatgtttgtgtcacacatgcatgtacatgttccttgagaatgtatatatgtatgtacctatatatgtttcaaagaaagtcttgcttactttaaaaaatacttcagcttataggaaatttatttcacctttgtactttacagttttattatatattttccatgttcagccaggaacctttactcagtcaccagaaaaaaaaataattagttccttctttgtactcccacaacacattattcttctagcacttattttctgccctatgatttctcaacagtgctggacgttatggtctttgactattttaactggatagcaaaggcagtgtattaatgctctttgtacccactcctttctacacagaaaacttttcaactgaatatgtctacatggttactttaacattttaaatagttacagctgacattgcctgttaatatttgagactcttactttataagagtaatagcaagtgtgcatatatacttaactaaatgttattaaggagtggaaagtatcaagctggaagaatgtattagatgccttttaagctgtattttgtacagttataataatacatgtaattgtaattcaaaaggtagatccttttttgtttattataaaaacatctttgttgagatataattcacatatcataaaattaaagtatatagtttattggttttagtatattcagagttgtgcaatcatcattatgatctgaattacaacattttcaccatcccagaaagaaaactcctgaccattagtagttatccagccttagtgaaccattaacctactttctgcctctctaaatttgcctattctgaatctttcatgcaaataagatcatacagtatgtggccctttttgactagctttttccacatagataaacacttttaagattcatccatgttactttaaccttttttatggctgaatagtattccattgtatagcaacaccacattttgttcacccgctcactagttgatagacatttgggttatttccactatttgactattgcaaataatgctggctgtaaatatttgtttacaagtttttgtgtgggcatgttttattcctcttaggtatatatttaggggtagaattgctgaatcatatatgataactctttaagtgtttgaggaactgccacactgttttccgaagaagctgcacagttttacatttccaaaagcagcatatgaggattccagtttctgtacatctttgtttttaatctgtcattttgatgatagccatgctactgggtgtgaagtactactcattgtggtttagatttgcattttcctaatgactaatgatgtcaagcatcttttttttgcttattggtatttgcatattttctttggagaaatgtctatttacgtcctttacccattttttaatttaggttatttgtgtttttatttattggttgtaaaagttctttatatgttctggatataggtttgttaacagatacattatttgcagccattttctcccattttttgggttatcttcacattcgtgatatcatttatagcacattttaaattttgatgtagctcgttttatcttttttgtcatttgtatgtgctttatttttcaatgtatttttgtattgaagttattttatctatttgttttaaaatactaagataaaaatttagaaatttatcaggttttgaaatcatggcatggtactggaaatgctgacaagaaaacaacctcattacaggattttatctctattgagttttaaccagtctttcaaaaacgtttaactttcagtttgatactttataaaaacttaaaatgaaaagtttcttctttttttctattttagaaccaaaaaaaattatagaaatactttttcttaaggattgtaaatgataagcagattctttaagatcctgtcaaacaggttatttcacttatctttccatcatatgaattaggtaaaaggaatcttttaagtgtaaaaaactgccttttctttcttaaatttttttgacataatgttaatataaatctattgtataaaatttaaggaaaactaaaatcatatataactctaccactcagatagaaccacaattaatattttggtatatttccttccagagtgagtatgtgtgtgtattgttaatattttacttttttcccttaatattttatgttcattttcctatgattttttatatcaagaggatcatttttggaagtgtcctgaaatataatgcctaaatttttctcaaaaaagattatcacaatttctacttccattctgtctattttattaaacccttatcagcattagatatcatctttaaaaactttgccaatgtagatgaaaaatattatcacaccattttattttttatttttatttttaattttttttaaattatactttaagttctagggtacatgtgtacaacgtgcaggtttgttacatatgtatacacgtgccatgttggtgtgctgcacccattaactcgtcatttacattaggtatatctccaaatgctatccctcccccctccccctaccccacgacaggccccggtatcacaccatttaatttacatatcatcgaatagtgatgaatcgacatgtttctcattttgttttgccatttatatttctttactttttttgttttggtttatatcttatgtccatttaaaaaattatttcgaaattatttggtgtaggtgaacctagaggtagaattaagatacgacagagataagttttcaagaaaaagaaaagtaccacaggattcataaatcatgttctgggctgatttgaaggaatcatgaaaattaagtagtccgtttattttaaatacttaggcagtatacgactggacatactgaaaattgatgtacatgtgtttatatacagtaattcccaaccttgtctatggttttgctttgtgtggtttccattacttatggtcaactgcagtctgaaagtaataaatggagaatttcagaaataagcaatttgtaagctttaaattatgtaccattttgagtagcatgatgaaatctcaagtggttggctcccactttggtgggacatcagtcatccctttttctaatgtgtgatgctatatacaccaccactcagtagtcacttagtagccgtctcagttatcagattgaaaaacagtacgtgtaggatttggtaccgtcagcagtttcaggcatccactggagggtcttggactatatcccccgaggataaggggggaccattgtaattacttcttaaaaataagtggggattcctatacatactttctcgcaactttttatacctataaaatgccttatggatcattttgttagtacatatagatctacctcagtttgatctattatgtatttttccatagtgtatatttcacatattattatttatttatataatatacagtgattgcacaaacataatcttaaatacgctagaagttataatttatatgttatgttaatatttatctcctatactttttacttagacattgaaagccctctaaaagttccatatgttgatgtaaagtaaggacaaggtctgtgtcataagtgccttttatcacactcgtctctggcataggccttatacattgtgagtctccaataatgttatttgaatgagtgaatattcccaaaccaaatcactggaccatctaacaataacttcctgtcagaatggttgtgaaaatttacctggaaagaatacatgtggtaaaactagagtaatatgataataaaaaatatattagaatttattgtcactacttttaaagttaccatcttgatatattaaactcttgttttagtactgtgcccattataaaaatatttttgcaccatctcttttgtagctatatatagagcctgtgtttctgtctttatctcatgattgatttttagatccacattatttggaatgaattgtaatgattaaggggtatgatcaaggtgggtagcatttgttttggttacaacaaaatgaaactataaactaaagagacaaattttcctttgtgcctaataaattgattctaaagatagatccaaaaaagctcccaaaaacattttatttcacatggttaatttgcatagtctcaaggaatttgatgaaattttataattactttaaattcttaatgataatgactggaacttttaaaaatataaaacaaaacctgttaaggtaactctttaagcttttaaaaattcatttttaatttataattgacatataatgattatatatatttatggggtacaatgtaatgtttcaaggtaattaccatatctatcactttaaacatttatcatttctttgtggtgacaatattcaaactcttcgctatcttgaaataccactgcattgttatttgctgtagtcaccctagtttgtaatagaacagtagaacttactcttcctaactgtaactttgtactcgttgaccaatctcttcctgtccccttctccccactatcttccccaacctctgataaccatgatctctcaccatacataaaaataaactctaaatggattaaagagtaaactatacgaccccaagttgtataactaccagaaaaaaaataggagaattgtttcatgaaattggactgggcaagaattttttgaataagacctcaaaagcacaggcaacaaagcaaaaataagataaatattaagataacttttagatatcaataataagatgattaagaacatgacatttaaatctgtgtatattcaattaggtgatttatcatttgaaataaacagatctttgctgccacctggaggatttttgcttgtaaatttctttattcagtaggagcattagcattcaactttgaatttaaaacctccatcccaaaggtgcaaataaaacagaggtggcagatgcattgtaccatctatacaaatagtgtttatgtttatctttgttcattcttatttgaattttgtttaattgtggaatattactattctctgaatattgctagtgaaatacttttataactttatttatatattttcagttctgagatacagaaaccaggaatgttgagtttctgttcaagtagtttgtgttcctaacttgcctgtgggtattgattcttctcagtcccataggtccttgagtgtgcctttttccgtcagctagtttagataggttgcactcatataatttaaaaggttgtttttattactatattttgtagaaaaagtggggaagaccaaagtggataagtgactagcaatttatggagaattaataaaggagttcttctataacataaaataaactaataaatttgatttttgatatgtacgtcatgtgaaaacttaaaaggcttaggaattgttttagtgactgaaaagaaattggttgaaaacaggaacatatttctctcttataaaagcatctagcaaactgcaaggtgaactatttaagtacttgtaagtggctgcaaatttgtaatgcagggaccatgcatggacttatttgttcttttgcgtaatgatcaactccatttattgtgtgcaagtatctgaaatagaacaatattagctaattttatcacctacatgtctgataaaattctaatatttgaggcagaaacaagacttttgaaaatattgagaacttttcatacctttgttttaaaaatttattatgtctgagatagaatttgttttaaagctatgcaactgtgtaagatgcttgatttttattgcttgttttgaaaattacagccaaaaattagagataagagctcaagttgcagatgccttcttatccaagttccaactgacttctgatgaaatgagtcttctccgaggtacaagagaaggacccattactgaggtatcctggctttctgttataatcatttaaagtttagtagttacagatattagagagaaattgcttttttgaagctttattttcccattaaaaaaagtttcatctgagaatatttttatgtttggaaatttaagatgtgtattttaattatatttttcaaagtaatacatgtactttttaaaaagagtcaaagttataaaaagaaaatctatgtcacctattttactcttcctcacctctaggtcttttgtcaaccattttcaatgttattaattgcttcttttgtaaattctatattctagatctatagttaaaaagaatatgctttgattatctatgttaactattttctattgattctctattgtgaaatgtgaggatttagccttctacccactctgtctcctcccccaacacagatagtacacacatatgttctctttatctccttcatacatcatagtacagttagaccacattttctattttcttttcctttttttttgagacagggtctcgctctgtcaacctggctggagtgcagtagcacgaacacagctcactgcagcctcaacctcccaggctcaagtgatcctctcatctcagcctcccaggtagctagggtatccaggcatgcaccaccactcctggctgattttttaattttaatttttagtagagataggatctcactgtgttgcccaggctggtcttaaactcctgagctcaagcgatgtgcctacctcggcctcccaaagtgctgggactataggtctgagccatagtacctacccacacatttttcattttcattacagtgacattacagtgattgcatgttctttcttttataactttgtgtctttccttgggttagaaatcacttgttttttcatctaattaattttttaagctattccattttttccaaactggctgacagaattatataacctctcaaaatgttaaataacaagaaaaagtttcgtttctttttttttccttgaagacattcaatttttccagaaaggaatcttttggtcttctcgctgggaagaactgtaaacttaagcctatcgtcatcattgtgggatcagagggcaagaagggttcttgaggtggggaagggttctcactgagtgtctctgagtaggtatcacttttactggcttggctaaaatggaaccagtcatttgggtgtagagaggtaaataggtgagagaattaatagagatattatgtattagtatgtactgccctcatgttttgaggaactttgcacatatgaaatatttgacatatcattttttctccccttggtagaaattagaaaatgagggttattattattattattattttaagttttattcatcaaagaaaaataacacatccgttatttttcgtgggtggaacactatttgtggcactctgaaacctaagcctccagtacatttaaatatcaatcaacagtttggcatctgtcacctcctatatatttaactttgcattctactcttggacgagggagcaataatgagtatacaacagatacataaaacatcatcttcagcaataagaatgccaggcttaagtaataaggtgtgtaatacacaatactttttttcatgtagtaatttttagttttgcatttctcactagactacgtacacttcttgaggacagggatttttgtctttataaattttattttcctggcaactgtcaacactatttggcacatagtagaaactgaattaatatattaatatgtcttaaaatgtgaataaataccagttacaccgtctatgaaaacttagagaaagttgagatcagtataggaaggcttccctaaaataggtgaaagagtttgtttgcccttggtagtgacctttcagttttaaataatgcaattttgcctgaagcatggacataaagtcacattcttaattttaaaggattttttcaaggcactgggaagagtaaaacagattcataatgatgtcaaagttctcttgcgtacaaatcaacaaacggcagggtgagtaactgctcactgaactaattgcattgctgcttatgtttccaaaattttaaagatattctagattgtttgtgaactatatagcattttgtgaaatagaagtttaatctttatttatctttagagaatggtgaagttatactctgacaggtttaggctaaaacagcagttgataaataagtgatggttaaaatgtgacatttatttaattgtagaaaattattgaaaaatcatcccataaaatgataaaaagttaatatgctgtaatatgtaatatgcaaacaaaataattaggtgcttagatgtatctgttgactaaagtttaaattataatcattaatttttttttagtttagaaattatggaacagatggccttacttcaagaaacggcttatgaaagactttaccgatgggctcaaagtaagtgatttcttttatgttgtctagattcatgaacatttgtagttgttttttaaaattttacttggtctttatttgatatattttgattttagtaatcaaacattttttaaaaataaaaatagtatttgtatttggtttttaaatttttacttggtctttgatgcattttgatttagtaatcaaaaatattttaaaaaagaaaaacaaacttcacatttgagcacactgttttttgtgtttgtatcatgagcaccagctatcagccaagcagtatgcttgattaagtgtgagaataaaacaatgaagacagtttctgccctagattattttaaagcagattaggtatctcttgttgtttacataactgtaaagttgtaagtggtaaactgattttctgctgttgctgtaacaaattattacaaactgagtggcttaaaacaacacatatttgttgccttacacttctgtaggtcagaaatcagatgtggttctcactatgctaaaatctaaatgttggtagacctgcatttgtttctgtaggctttaagggataatgtttccttgctcattcagttagttggcagaattcagttccttgtgtttgcagcactgaggtctgtgtttccttgctggctgtcactgagggtttttcccagtttctagaggctgcctgcattcttcggcttgcggccccttcctccatcttccaagccagcaatgtcaggtcattttctcatgttgattctaccctgcctcatcttctatctcatatctctaacttttctgccagccacttccattgtgaggcctgtgtgattaccttggacccacttgggtaatctgagaaaatctctccattttgaggtctactgccttaatttcatttacaaagtcccttttgccatgtaaggtaacatattcacagtttccagggattaggatgcagacatctttggagggccattattttgcctaccaggaatgctttatttgctttagttttgtttgaaaatgtttcaatagattttttgcagaatagcctgttaaaaccagagaagatatttaaaacaagcaagcatggaacaggagcacatattttaataggtgttaccaactgactgttggaaggggttggaattaaatttggttaaccagctactcctgtactatgctgcgcaaatggaattctctgatctggttggttaagtctttatctctaaaacctgtttgtttttctacctctctccttctttacattgtttgcttccatctggagtgttgtctgcctttctctcattgcatctcattgtatttttttcatgtatgtcttatctcactagttttctacttcctcaaaggcatggacattgactcaaatttttttgtgctcccgcaacatcttacatagtggttcccaactgtgggctctgtcttgtggagactatgaagtcattttaaggtgtcttcaattctctatgcatattttgttttcagtcagtgcatgctagaaagtatactgctagtgtgaagtccttgtgtaccaaaggttgggaatttctgagaagttctaaattctttgaatatactaggcacttgtgagcattttatagataaaattagaataataaagaaaagttggtgtagaaatttttaagagtttaaaattcaaactcttttgaaattatatcactatatattagttaaccacattaacaattttagcaaactgtttaaagattgcttcccagcgaaggaactgataatatctttttagtactcctccctgcctccctaatactgtcatgtatatggcagttattaggaaatacttgttcactggttggtttcttcaggactctatagtgttttataataataaaatacagctttggggcatacctgatagcatatgtggtcatttaaagttatataactacttaagcttaactttttagtttggttgacagcataaattcatttttgattggtgtattctctaggtttttctgaggatttttttttatggggtgtttgccatagaatttagactcctggaatgcaacagacataataaacatctaagctgaatttaacaaaagttataatgttaattatttttcaggtgaatgcagaacattgacacaagaatcatgtgacgtatctccagtattgacacaggcaatggaagccctgcaggacagacctgtcttatataagttggtgactttttcttaattaaaaatgaaagcctacttttcttttgatatcttactttaaattttagtattatcaaaagcgtatataatagtttgagtaatatttataataatttacaacaatactgttcaccttaacttgaatttgtttcatggggtatcagcttatttgaattttacatactatagaatacaatatggaaagagaaaccaaagtgtctctgtatctagactacctcttacttatatagaggttcagtgacttttcccctgtcgtctcattaactcccttagaattgtaagtaactaaaactcctgtatgaatacttccctacagagactgaagtcatatcagtactgagaaatatggttatgcagagatgaaaaaagaatatttaatatcaaggtaatctgttaataggatttaggaggagagggcccaggtctttgatcctgtaattgatgccaaacaagagctatgtggtaatgttttggataagaatttaatgcattttgtatttgttgatatgttttttattattttatattttaattttattcttttaatttttataaaataaaaggtaaatactttctttaatgcctggagtagtattagcataagctttaggtagatgtaggggttgatgatattaataattctgaaaacaggaaacgaggggactcttaccaaggtagtgcatcctgctttgaatcatccctttcagaatctgtttatactatttttagaggacctccccattactttctgattggaacactacttatcctatcatcaggtcacagaacacaaatgctgaacagctgtgtaaaataataacaccccagtgttacttactgagtactatgtgttaagcaccattttaaattctagaaacacaacgtcagtaaagcactgccctcaaactgctttattttatggaaccagagataaacaaacgcattttaattgaatacactaattgatagtctagaagtcatgtgccagatgctgtgtggctcaagtattctggtgtaggggaaagagatgagcatcagtgaaagtttcctaaggaattaggtataaagtgagttctgaaggctgaataggcattttcctagaagtaaaggaagaacagtttgcaggttgagggaacagtaatgcaaagatatacattgagagataatgcacctttgggaaattaattgtaaaagcttgcactggctattgaattaggagcaacagctggatcataatagccctgaatgttgtgcatatacataagataagttaatgtttaccattgatcagcagcttaacagtttattcctgctttaaaatttctttcccaactttttcactttaacatattgacattaattatgagtcttttagcacttaaaacatttggcgtttgattttaacagctgttgcattgtctacagattaatatttattcacaaggttaatcttttatgtattaaaaaaaaaaagcctttctgtgttttgggcacctttgtttgttttcaacagctgacttctgccatgcaaataaattttcactgagttatagttctttatcaaaacttggaaaggagcaatattaaatggctataaggtgggttcttgagtcaaatttctttgagaagtccgtgtacctttataagcttgtttccttagctgtaaaatgaggataataatagtgcctattttacagggttgatgtgaagattaagttagattgttcacttaaggcacttagtgtaatgcttggtacatcactaaattttagatattatttttattttgagaggagatgactagaaagttttcaactaaggagggatgtatctgagggctacatggcaatctgggaaaaagcttgaaagataaagaatggaactataataggcaaagaaggtttatctgtgaagggcatatgctaagaagcagggggcagtaatggcaatttggaagatttttttttttttttttttttttttgagacggagtctagctgtcgcccaggctggagtgcagtgacgcaatctcggctcactgcaggctccgccccctggggttcacgccattctcctgcctcagcctcccgagtagctgggactacaggcgcccgccacctcgcccggctaattttttgtattttttagtagagacggggtttcaccgtgttagccaggatggtctcgatctcctgacctcgtgatccacccgcctcggcctcccaaagtgctgggattacaggcgtgagccaccgcgcctggccaatttggaagattttaagacacatttagaagttgagtaggaaagtaagtttttaagaccagatgattagaacaagatgaatgctaaaaaagagaaaattggcctttcattaagtaattattttcaaagtggtagtttccttacatttagggaaaacttaataatgtatcatgttaaccaccagatggcactatatgaacttaataagtaatgtataaaagtttcactgtccattattgtgtctcaaataatgtaagtattatatacaagaaaaatgtcaattattgaaatccgtggggaaagttgccatactcagtgtttcttatgtggtgtataactggaatgctaatgcattattgacttttaataataaatcatgtacaattataaatgaagtgaaaaaatttgataatttattttctttggtaagcctttagaatataagttattttaaaatgtagtaatacatacaatgctgatttttcttccttctttatgtatttgttgtgtttcaaagaggcacttctttactattatcttttaatttgctttttgataaaaatttttcttcttttaatttgctttttgaccagaatttctttaactgtagctaaacacaatttttaaaatgagacttttaattttaacttgaggtatttgagaatatttacataatttgaacattcactctgaaaaagctccattttgatttttgattattgttggaagaatgtctgattttggtcaaagactttttcttctgtctctgggaaggatgtttcatgtctaaagatattgaaggttcacgtggcttatgctgtttttgctttaaattatatttgttctataggaggattgacattaatattaatgtttattgatattttatagtattgaacagatgaaattccagtgtttgccaggcttggtaatttaccccctatttaaaatacactggattttaagattcactggattctgttacagctgtcgtcccagtggacagtcctagaaacaaattatgctgtttatttttaatatagttagtagggtcttgggaatgaggattagctatatatacttaaaaagttaaacgtttgtgaattttatgctgtgataagcagtcataagttcattatttcagagaatcaggtgatcatttaaaagaaggcattcttcacactaaatggattaataatttaagagcatgagggaaaaaatagcaatgagcattttggttctaatttgtttaaaaaatagtaaatgcaaggcaattatgcaatttagcaaaacttagctggatattgcacttccccttttctgtagtatgtcaccacagggaatctcaaaaccatttctttttaatggaagacaaacccacaaagaaccatagtctggttaatagtaaacagtcctcaaaaaaggttcatattcctaaatatttatagctatttgccagttctacagactttctctttgatttggaaataaaccgtctttcacatgtttaccaaaatgtggatttttcatccaattaacagcatatgaaagaaagctatgtagcctaagatattaattattttgggtatcttgggaagttttggtaatttttgtttatatataggttattgacataattcttaaaatttagtatggtagaatactgtttagagatttaaaagttagtctagaatctgctgacatcaagactgctaaaatatattttgtttttctttatacttttaaaatggaaagaactttcaattgagggatggatgtcaggaatggtggtgataatggaaaacaaggctgagtcaagtcaaagaaatgggcactccagagagctccaggccatttttataaattgaatcccaaattgtcctattccccagttaaaagctttccttccctaccagttccttcaccttagaaagcctttccatgccttttcaattataataggtgacttcttaatacatgttttttaaaaaggtatttgcttgtatatgtgtttggtcagtaaatttaaggaacatctgttatgtctaatattggagtcaaaataagcttttaaagatggatagcaatttttggagcaaattttggtgatagattgtgatagtatgtgtaaagaagacttttttaatgtagaagagaaaaatgtcaattttgggattgcagaattcttttattttttctgagacagggtcttgctctgtggctcaggctggagtatagtggagcagtcactgctaactgcagcctgaacctcacgggctcaagtgatccccctacctcagccttccgagtagctgggactataggcatgcaccaccatgcctggctattttttttttttaataatgagaaagggtttcattattttgcccaggctggtctcaaactcctgggctccagtgaccaccttcctcggcctcctaaagtgctaggattgcaggtgtgaaccaccgcacccagccttggatttgcagagttctaattataatcagtttttgagaactgttatggctttacgtaaaacagtagagcatcatgttttagactgcaaatatgtatactgaaatataccgaaacctagtatagtgaatatactgaaacctaaaaagttaagtcttcccaccttggcttgattttcctacttttactaagtccattgctttatcccttattactgctgcctctgctttagtcccaaatcccagcattgtttcttaggaggggtaaaagtttttactttttgattgaattttcaatgagctgaagttatctcttaaatatttttttcttgtttgaaagcaatgttgcttgaccgaatatctaaaggagctttaagtgctttttaagtacttggttgtctcagaaattgcgtgaatagtctgatatagccactagaaacaaccccaaccattttttatataacttgtttcttctagatataccttagatgaatttggaacagccagaagaagtacagttgttcgtggatttattgatgcgctcacaagagggggccccggaggtacacctagaccaattgaaatgcattctcatgaccctttgaggtatagtaatcagacagcagaagaggagttgatgtttttccaaaggaaatcttcattaacatttagttttcattaggtatgtaggagatatgttggcttggctccatcaagctactgcttctgaaaaggaacaccttgaagctctcttaaagcatgtaactacacaaggtgggtccaccaattgtattgctaatgcctaaatatagaaaataacacaagcatctctgtttctgttcttgttgccatcttcttcacttagataaacaccttgatggtacaataagcatcctgattactctttctcttctctagattctccctcattctgctaatagactttctcttccatcacctttgtcctgtcactcaactgttcagttttatagtgaaacctagtgacctttcatatcaaacctagactcctctgtgtcacttttaagaaatttctggaatatttagcatacattttctcaaatcctctgcatgacactttaaaggtacagggtgatattatcttaattttatctgtgtgtaaacaggctgagtgacttgttttaggtctttaagctactaattctttcatttctgctacccagcctcttttttcattctcatggcactgttttaaaattttaagacaattatcatatctgttagtatgtttctgcattgctataaaggaacacctgaagattggtaacctataaagaggtttaatttgactcacggttctgcaggcagtagaggaagcatgatgccaacatctgcttctggtgaaggcctcaggaagcatagagtcatggtggaaggcaaaaggggaagagccagcatgtcacatggtgattgagggagcaagacagagagatgggagagatggggaggtgccacacacttttaagcaacgctgactattgtgaggacagcaccaagccattcatgagagatgcactcccatagcccaaacatctcccacaggcccccacctccgacattggggattacatttcaacttgaatttagaggggacaaacatccaaactacatcaccatatgtactaaatgtacttaaaatttttgtcttgatgtcaaggaagaaaaataactgtagttgagagttgctgatgtcttgtttacagaattccaaatcttcttagttgtgattacctaaagaggcctgttttagagtttgagggtttagtgtatgattttaaagtgttctatttttggtaggaagttaagagagacactgtggcttggtatcacttgactattttacatagctcagccacacatctctgtggttcacattatctgcaagatgagtcagtgttacaaattggtggtaatactaactttatagcttctaactcttcagtatcaagattagactcagcatatatgttagattggcacaaagtgtgcatcgttaggttctctttctgttattattctccttacccagtttaaataaatgtgtttccttaaagatgttttagaaaagtataaggcagtattaaggaagtaaatagactgtagttagttgaagtaggttattctacatgaatgacttcaatcttctgggcctcagtttttccatctgtgaaaatgaaggtgattacaagcagtaaatgtcaaatacccagtacagagtttgataaatagttggtgttttgaaaataccagtttttctgaaagatttcaaggtatatttttcatctttataccctcagtgtatgtgctaagcagcactgcctggaacaagatgtttgtaaaacaaatgctaatacatcttggcatcacttcattcaattaatacatttcaccctctttttttcctctgtcttataactttaatctttttcacaaagaaatatttattttattaactcaaagtcagatgaattaacaaggctttctagacacattaggtattatcacaattaatatgttaacacaattagtaatgtcccaagagatatcaaacttactaaaatattgttatggttattttaaaagtcattagtgccattaattatatgtattatatattatttgttagttttttgaacttatatgaagcaaagtataatatggaaacaaatattaattatgtagtcattaattttaggtgttgaagaaaatattcaagaagttgttgggcatatcactgaaggtgtgtgcaggcctctaaaggtaaaatattttgtttttacatatgctatatggtacctgcttaaattattaccttatttatagaaacttaagaaactgataccagctcaaatacaatctataattttttcaaattagcacactaatgtagactaataagaaacattttaaaataataattgccagttttctctctgagaaagaaaattggaaatatttgtagtttgcatatattgacctattttttacagattatatttcctgtagtaatttttcttattcaattgagaaaaaaatctattaaatttaaacagcgaatctatgaactcttaacagagagatttactaagaatattttgtttacttgattgcttcaagcatagaagagtttttgcttgtcatagcaataaataatgattaatccaaggataaaataatgtgtattggtattatcatcaatactgtttatagtgcaaggaacagaatttggaatcaaatttgagttagaattcccatattgccacttaattgtgtttacttattgcatccgcttaactcttctgcacctgaattatgctctggtgggacctgtatattaaaacacctatcatccagggttgttgtgaggatgactgtgtagatgaagtacatagtttatgacactaagtatttagcagatggtaaatacctttattttcctttattaatatttagagaatacttggcaattgttggtttacttttccttgtaaaccaacttcattgattgactttaatttcatacatagaaattgaaatccagaagtttagtaattaatttttcaagaaatgaactttaaaattaattttattttatttctaaggtttttgtttttttggtatatgcttcaggcaaggaaatctcagatgacacacttggtgacaattgattatattgacaaatttaactgttactctaacttgatctcataggacctaactgtatattcagtaaataaatggctaagtatcttgaaattattttacttatttctcccaaatgaaatatttacttgtcatagtttgatgtagacatatataacttatataaatgttgtttattttgtatactggcagttactggaaaggtagaagaagaggaggaataaaatgaaatttattttgctatgcttttatacctttttataacttcatatagttaaattaaactcctagtcactttgataagtaaattttactttatctgccttaccttccccccttccttgcttatgtaattatgtttctttttacaatttttctaatttttgtgggtacatagtaggtgtatgcttttccttttctttttaaaaagtaattttataaatactataattttagaatctaagggttataatggacttttcagtttcctgtcctggtttgagtaagaattattatattaaaaatgtttaaactaatccagccacttgtataaagactttatatactgaagtctgcctttgttttaaaatgtacttagaaattctcacttcatcttcctttaatgtacatacccagaaagatctttatggcaattgtaggacattattgtgatctgctggcaaatttaaatgtaagatgccaaaggtaaagaagacactagtaagcagacaagcatctttttgttgtaaaatgaagaaaaattccttttctgaaatggcagaaacttcaaatctttccatatgatgataatatgtattgcatccagagaatatttagcaggtgttcacaatagttacgtatcaaattagcttgatagtgatatgtaatccagcaactctcataccttcccttccttatatactgatagacagtgttacagtattttaagaattttttttctgtatgaccttatttgagtatcttatgttttcagtgagatagttgttagttgaggaaaaaaatttcgactttaattatttttttttgcaattataattctgaaattttctagtgatcaatctgctcttgtaatcccactcatacaaaatttcttcttcctaattgataagcaactaaactttttctaatgacatatgatattggatgttatggctacttttctgtccatcattattctttgtagatatgaattttttttggaataagagattttgatttttagaaacataaaaggttatagtggtaatgggagataatccttgagaaactatatatttgatttattctaccttgtttaatcttttctttgtcttagtaaagtgaaacatcataggtagtagattaaatatttgtaaatgtatgcattaagataagatctgtaaacctattgccagtttaaagaatctgtgctctaagtttaagattgcatatgttgtgtagggggtaccgtggctcatcagcatcaaccctattactttgtacatgtctttattccaaaactgtagctagaaagaccagaactaatatattaaattttttttttaagcccatgggtataaaatccttcttttatgtgaatgttttagattgctgagagattaccagctatcatttgaattttctcttttaataaaaactttagtgtagtgtatgctacagaccttagattatggtgggttctatgaaagcaggtatatgtaaaagatcaatgacatggaaaataaagctgaatattgtacacaatatagtcattggaccctcagattgaggtatacataggaacagatgtctaccctgagcagctgtctgtgatattaaggtaaaataggtttgtcatcatcttttttagtcctcccttcttcctgtgtccccttcatgaacacaaacccactctctttctcttgctctcgcttttgctctagctttctctctggccttggagaggagagccactgttctgtcttttagctcttccctaccttctctgctgtcagggtgcctgaagctcattttgctacttttaatatctctgcctttatggttgatgctgcttctcgtaatgcagttaggatttattgagtgcttatgatgtgccagggtctgttccaacatactttatatctgagccattattcccgttgctgctttccagctctgctaatgatttttccctccactgtcatcacagtgataatttccagtcagttgctgctaccaccactcctttaagtctctttgacctttttttactttttacttttcgtttctcttgtcctttgttgtttctcctgtgactgttgggttttgctgaaaatggttaccctcttatatagctctcataagacagagtgtttatttctgtgtggcaaacaaagcattcttggtgtattatttgtcagtctcctgattttccagcctttctctgttgtattttgtattgtagctgttgtattctttattgccactttccctcaaaacctttatattcatggagagagttggaaattgtttttgttttttcttcctttctccctcctttccctctttgcttttcctttctttctttctctcccctcttttctctctttcttaagggagtcagaactaagaatattttcttgatgcctcaaaattctggaaggcagctggccggatagctgagatgttgtttaaaatctgctagtaaagagctgtttgcctacaactaacattttttatattttgctgtaataattatattaaaattaagaaaatatcacttttattgatgtaatgtataatttaagtcactgttaaggccttgatttaaaaataaatcatggaaaaatatattttttaagttcaaatgccattcatgatccatggtattgtgttaattagatagtctatcacctataccaacagatcaatttcataaacatattaatgtaaaggtaaattgatttctgtaatctaagaggttttcatatgcagatataaaatctcattttagcaaatcacatttgttttatgacatatgccaaaatctaaatacagagaaagttcagtttttaaaagcatatattaaacatctgttgtgtgtatactgttctaccagatgctacagagatgtaaaataggcagaagacataatgtctatactgtatttgtattagaaactagttaggaaagcaagaagatagaatgtaagcagtagcttaaggacagatacaatatttaagtaagcatttatcagtgtagtttagattgtattcattaatgagataatataaaagaaggatcagtgagggatggaatttaattagaaaagattcatatttcctaaatcttgaggcaaatcaaattaatcttgaactagatctgatttttccctggtagtcttataatttggcaaatatgttggtgctaattcaagatttgcctagttttctattctttgattaatagacaaacgatataataatttatagactggaatttattttatttttttcttgaatatttagcaataaagcattatgttttcattgataatctgttttagggatgtaacagttgccttttcaatttcatattgaaccaaattccattatatactggtgataaatctcaaatgatctcaatgtattgacatttctggtaacaactgccttgaaccaaattctgcaaataatgggtcagatttttgtagagtatatctctgttaaaatgtttgttactttaccatcttctatgacttactactcagaaattatttaggaggcattttgtgatctctgcagtaataaaattttatctttgttatgctattcataccatatgttattaatgaaaaaaagttatacttttaagaaatgtttactttcctctcacatattttaataggttcgaattgagcaagtaatagttgctgaacctggggcagttttattatataaaatttctaatctcctcaaattttatcaccatacaatcaggtaagtagaatggcaaaatgtgcttgctaaatccaatgtgatatttctttcagttagagcacagtataagatttttttttatattgtgtatagtaattatacactaagtatagactaagcgtaactagtaggacttccacaccatgtaaatcattatatgcatattatacatgctatgccttaaggtctattatttcctttctccttttttctccaagcttaactacacgcacacacacacacacacacacacacacacacacaccccttatatagcaatataagtctataatgtaagtctttattgagtcttcctgcattggtaaaagacatccaaggcaactaaagcaactataccttatactcacaatagagcatagtgaatgaaatgttctattctggatgtaaataacctaccatgtactcacaatagggcatagtgaatgaaatgttctattctggatgtaaataacctaaattctttagcatttagtttactataagtgataaaatagagtcatagctttatcttctctacataacagcaactttatctgattaggaaccacttgtcttatataaaatgtgatctttgactccaaaatatgcattcatttttgctttacttacgtgttttggtggtatacccgtgagttttattataactctcactgtaagactgttatatatgtagttatgttaaaacaatgtctttccaagccatatttttgatagtttttgtatttttccattaaataattatttaaaagttatttgttatgcagtatgccagtatcaggaatagtaggccaactgttaaaaatctaagaaggatgtaactaacattaccaggaaaggttcagggagcactagtttacagagtaccaaaaaactgtggtaaggttatcacctaccccttagtgacagagagtagccacccagaacttaacagctagggaatggatttcacatcttactagtagattttcaaacaaaactaacaagtcatagtctacaaaactgatcagagataggatttggattagtcccttaatattttagatataaacttgttgtcatcattcccataattcaaaagcaatgaattagtttcagttgtaatattatagcatcctgtaataagagaatgataaatacttagaaaacacaagggcagctgaaagctagacatagcaaatgctgtgttataaaaagatgctggtaaaataatttttaaaattgtttatttaataatgtccatgatgggactacatgaaatttattatttaaagatattgatatcttagtttctaatgtagaaaatgctggaaataaaataattcagattctgaagatgataataggtttttttaggctctgagaattataatttttctatctttgaagatgatattgaagatgacaattaaaatctttttttattgattgcatgtactttgtctacttgttcacacatttcctcatttagtcaattaaacagttgactgtatacttgtcattcttctaggtggtaaggaaacagtaattaacaaaacagagcttaaacttacattgtagtaggggagacaagcaagtacaaaataataattttaggtagtggtaagggtactgaagaaaaagcaggaaaaaggaagtagaaagtataggcagtgatcatacatgagaagatatatgtgtgtgtgactgtttttgaggccattcgatagaggtgatatttgaatatggatgtgaataatatgaaggagttgggcatgaaaagatcatggagaagagtgtccaggacaaaaatacactctggtgctgaagctaggaaaagcttgcattttggaggactagaaagaaaaccaggaattggagtgtagtgaattggaaggagtagggggagatgaaatcagaaaggtagagagaggccagctcacacaggattttgaaggcgatagtggatatttcgattttatactgagtggataagattggggaaaatgtgagggttttgagtgacctgagcagatttgtgttataaggttactctggatattctgtgaatcatgtagtgtagtgagacaaaagggaaaataaggaagatatttagaaagcagtttgtgctcctgagaagagatgatgatgtttagactagggtgatggtcttagaaatggtaaacagtagttgattttggagataatttatgtcacagccaataggacatgtatacatactagatagagtgaggtatgaggagtcaaggatgaatttttggcttttggtttgaacagctgggtgaatggtattgtttgctgagatagggaatgctggaaaggaactggttgatgggagtggtgggtaatgaagagttccgttcagttttggccttgtcagatttgatgtatctgtgaatatacaggagattttgagtgatcaaataatacagagagaaatcagggctgaagctaaaaatgtcttagttttcagaaaacagatgacacaatgccatgggagtaggtaagatcacttaagaaatgagtatagataaagaatggttgctaaggactgagtcctgggaaactccaatattttgagtcaagaagaggagaaacgacaaaactgggaaggaatagtggtgaagttggggaagaagcaggacgcatgcaagatctcaaaaaatttacctctcatacattaaaactcctaacaaaaggaagatatagaatccaggaaacagggactcgagcatgcttggattatatatcctttcctgcaaaacttttctccctggaattaataaacacttggcttttgtacttgtttactttcctatgcccttatcactattttggatccaagctatttaagagaactcaacattgcattgtctcaccatgtagtccaacaagtaatccgcctctctcctgcccctatctgatacccttcttggagccctcattcccctccagtctagatgtgttgccctttaggcctactgcaagctgcttggctgtcacactgggatttatcttcttcactagcctgttcactggcttgttttgggtatccctgattctttggtcagctctgaatagtatttacatgagtgtaatgatgtaaatattgaatagttatttaccagaactctgtgcccatggctatattaggaagcctggggaaggtgaagtttgggtgtgttgtggtggaggaggagaactgtataagagagtttaactctcatcttctacatcagggaatttgtagataatacctaaaactgaaaaatcaagtaatgggagtataggcatgttggatagaaatatggaatgaaatgtcagaagaaacatctacaattatctgtaccagttactggaacataatgagtgttcaataaacgttagtaaattctagatctgaataactgcaaagtacagctgataactccatattaaaaaaaaaaatgaatgtaaatgtatgttgagttctctccaaatttttcattaaattgtttccatttgttttcatttaatttgcttcctctgttgcttgatgtacacttttattcagagaaatacttgttttcattgcatgtgcaggcatgtgtgggaattctatccagtttattttagtatttggcatacaatatttttaactaaaatacttattgtttctttaaaatataagtattatggctactggtttagtaatttgctagtattttgctgtttgctatatatatatgcactttactaataatttacattgttttcatgaactatgtaagaatttacctaatttattttggtttcggaattgtactgaaatattacatttgcaaatattagtatttgcttttataatacatgtggtatatgatttatcagtaaacttgctgtgttttagcttactgtttagtagtatttaatgccattatattcatctttaacaatctaaaattttttaggcatggaagatgttgttatgcctttagaaattataattccttactggattacagcatattttcataaccacatgaaacttttcccctagaaggttgttaaaatcacttttagtatgtgaattaggaggaaaaaaatgggaattgttttatatacatacttgtcttagatcttggcaaaaatgggaaacctccttgaatgggtctaagaaatagccttatacaatagcaaattgaggattatggaatgtactaatgtaattagccatttcaaaatgctatcagacttttcaattagtctaaatatactgctctgtaggcagctgtataaaaattgagaaactgatttataggtgtgttattgatatagtataacagttttaattaaaagaataactcagtatttatacaatttaaatattttatcaatagagctgttgattcagtgctcttcttaaaattaaaattaactgtcttagataattgagatatatatttactctaatagaggaaaaatagagatagggttttatatatcacaaatatctgttctgacccacggttttgctaaaagagattgtgaaatattgaaaacatagtagtttgtttttattttttcatcacctaactcaaaagaaaaacaaaaatcctgatttttaaaatatgaaactagagtatttttaattcacaggttatattttacataaaaacttttatttaaatctagatccttttaaagcattctactcagttaaggaactgttttgtttcagtttctgttttgcaacctgaaatattctttgcttttagtggtattgttggaaatagtgcaactgcattattgactaccattgaagaaatgcatttgctaagcaaaaaaatattcttcaatagcttgagtcttcatgcaagtaaattaatggacaaggtatgtttgaaaaatgtaattattaaattatgtgaatgtttcacattaaagatgttttagtgatttttgtattgattgataacttttcccattacattctgtgttcttttgagttcttcctgtcaccaacaactttcattttgagatggcttactggacctaagttgatagtctttgttcctgaaacagtataacattgagttataattggagatggcatctcaggctccaattttactaccatttttttctatcacagaagttgtataattaaagcaaacttactgtatttagctgggggctaagatgacatacagattggaaaaccagaactcttacaaaatattttttccaaacagcttatatttttacccctgttgttacagttttgtccttatgaaatgtatgctcctctgagttatataattatttatgaaaacaaacaaggaaaaacatcccacaaaaaaacaaacaacaaaatcctcaaagagtcctgtaagatctaatatcttaaattgagcagggtattttggcaggaccttaaggaatagacttacaatgatcaaatccttctttatttttgtttcattattgagaacatgagtttttcaaggatgtgtcacaatcaccatgctggctttttaattgtactactctatctaataggctagctatattaggcccagattttgtaatatggtataaaatagtcagtagcaatttagtccagaatacgtggtcaatcttcactttcctaagttcagtcttcactttcctaagccttaataggagtctacttcctgacccacatgcatgactcagattcatttggaaaagcaacatgaatttgtggagctggaatatctacctttatttttcttgccttgtgtatttctgtttgcatcaacagtttactaacaatcatttctggttatatttgttattatgagttcttatttagacagaactcttctaaaataatttatacatgatacacaaacattaaacatgaacaaatatgtgctagctgttgagagtacaaggatgaacactcaacatctgttggcctcattaaggttgcttttcctttagtggaaaatgaccaaataagtctggttattatagaattctatgatttatgaaagacatgtgcctagggtatatgctagcaccaaaggaggagtatatttagcaaacttatctgtactcctttacagagaggaagctttccatagagagatgtaatggagttgaactttgaagaacaggtaggctttagataggtgaggaaaggagtgcatagaggtcatcttaaatagaagaaagaaatagaatatgctagaacatgagtatgagttacctataaaagaatttttcatttattaaaaaatatcacttgtaaagtgatgtgttttatatatataagtggggaggctaggttggaaataggaaaattaaaggagtattgaaactgtttttattcatacatgatctaagggaaagactctgggaataggcaagaggggacagattcatgaagggtaaaggtaaaatcttcaaaacttgatgactgaatgtgggttagtgagagggagtcatctagaataattcctaggctaatcacaaatatctagaatgcagaaagagggtacaatttgggagataaagatggtatcatctaagttagataagttgagtttgaggtgcctatgagagatccctctggaattggtctaatctaaaagggagtgatacatttggatttagagagttttacatataagagatagttgaattcatgggtttggatgaagtcactaggaataattttttttatgagtagagctaccaggacacagtcttgggaaacactgacgtttaagagaaggaaaaacgtcaacagtatgatgctgagagaggatggccagagaggcaggacaaaaattaggataaggttttatcagaaaagccaagagaagacagtttctagaaggagggcatggttaataatgacagatgcttttaaagagttcaagtaggaggcttgttatctttggcaatatatatgtgataggtgacctaaatgggcaattttagtcctgtggtggagataggagccaggttgtagtacgtagaaaagttcatgggtaagcatattacccaaagctttaccaattagaaaacatatgggcctcaagactgaaaatagatgcattaggcgtttgtattaaaaaatttgaaacagagcaataaaatgaagatatatggaaaggatggaattaaatttccgtgacaaattagaaaacaaaagcagaattatttgttgaaaagataaacaaaattgacaaacttctagcaagtctaatcaagaaaaaaagaaaattagaagtttttagaaattagagacaatccacagatgagaattaaaacttagagagtaccatgtgcagttttgtgctaatcatctgaaaatcagaataagatgaatgctttttaaggtgacataaattggtaaaatgtgagtcaaaaggaagtggaaagtgtgaatatacctaaggaaggaagaaaagttattaaagaacgtgttgccaggcctagttcagattatatagagaacttcattcatccttaggaggaacagataattctccagaacatgaaaaaatatggaaagcttcccagtttgttttaggtagtataacaccgacataaaaccttttaaagatagtcagtagtggaaaccatagattagtcactttttaagttttaaaacttcaaaattcagcatttatatattaaaaccaagaatggtttattacatgaatataagaatgtttcagtgttaggaaatatactaaatgagtatataaaataaattttatattctcatatttgatcacattggggaaaatcttaatattaaaacaagtcattgatgaatacttccttaaccatataaagagagataaaactaacagccaacatcataattaatattgacacactagtggttcttctatttaagtgaagaacaagaatgcttgccaatacttttaaataataaccacggtagaaagatgagataaagaaatgaattgtaaatattttaaaggaggagacattagattatttatggatgttatgatagtctattttgaagacctaggagaatcaactaaaaagctatacaaccagaaaatgaattctagtgaagtcgttggtgaaaagatcaatatacaaatgtaattaattttcttatataccagctcatgaggtgctcaataaatactggtaacatgaatggttcagttcattttctgctggcctatattccatcactatcttgccattagctttaaatctcttgcacccttgccattttaccacattcactttgcaaaaccaccttgagttaattcaatttttcaatttttcctgagctctgctaaagaaaattacatcatacagacaggaatcactaaaaattgtctccaacatcaggaaagccccccaggaggtccagcaaatactgattgtcctttggcagccactcacatttacctcacttattttcacccatttcctcaaatctaccatactacctcctactgaaaaagtgccaactcttgctaaaactggataatggacattaaaaaaaaatctttaccaacatgacgagcaaaagcgacattttgttgtttttctcatttggatttctgtgattctagtgagaatgaacattttaagatatgtttttggctgtttgtgaattgcttgttcaagtcctttgccattttcctattgggttgtcttgttcatttctgatattctttatgcattaagaatattaactccatcatatatattacagacattttctccacgttatcatttgcctttaaaatttgcctgtagtattttctgacacatcaacttttaatttttttatagttcaatagaactttttttatagtttttttcccttgggagcattccatgcttgaaagtattcccacaagaaaaaacatttagaatttaatatataataaagatagcatctattagtggggaaatgatagattgtttaatacatttatttagatgtattttcttaggtgtttctatgttttcactttatttatttttttaagcaacagggtcttactgttgttgcccaggatcgtagctcactgcagccttgaagctcaagccatccttctgcctcagccttccaagtagctgggactataggtgcatgccaccatgcccagctaatttaaatttttttttttttctgtagagacatggtctcactatgttgcccaggcttgtctcaaactactggcctcaggtgatcctcctgcctcagcctcccaaagtgcaggaattacaggtgtgagccatcacacctggccctagccctggtttcacttttgcaacaaatttttaatctactgaagtttattattgttcagactgaaaacttagtatcttattctttcccaagtggttatccatttattttattttattcccctaatagtaagtttctatatattttattagtcatgtaaaagttaaaatgaaagttgcaacaaaacaggaaaacatacagttgactcctgaacaacatgggagttatgatgctgacccctgtgaagttgaaaaaatctgcgtgtgactttcgactctcaaaatctaactgctaattagctattgactggatgccttgctaataacataagcagtcaactcattttttgttgtatgtattatacactgtattcttacaataaagtaagctagtgaaaggaaaatgttattaagaaaatcataagggagagaaaatatatctactattcattaaatggaagtgaatcatcataaaggtctttatcctcattgtcttcacattgagtaggctgaggaggaggaagaagagagactggtcttgctgtctcagagagtagcagagggagaagacaatctatgtaaatgtggacctttgtggtttaaacatgtgttgtttaagggtcatctgtaatggatagtaaaaggcaactgaaggatgacatcttccaattaaaactttgaacagaataggatgaaaatgaggaaagaaagtaattgtaatctgaatttattaattaccaatcaatattgcagcttatatgagtttatagcagtgaatgggctctgatcattattgttgttgtttttgttgtcattattactaattgaaccctggatgtttttctcagatatgaactgggccatatttagagttatttttacattagattgcgaccgtgttatgattctctttacaactcatatgttgcttgtatctacaaccatttcaggttttttgcaagaatatcttcctttcatcaaattttaatgttccataattttatattagttatatcttttacttattctgcttcttgtaaatgatttcacttcctctaaaaacactgtagctttatgaagaaaacaatatttattgtagcatgttcttcattagcaaagcacccaagtggaaatttttgttaatagaattttaagtgaatagtataattgttggaaagaatagcttttaaaataaaggtatagccagagaggaatttttaaaaatatgattgcttttgtgcttttaaaaagacatacttgggagctaattctttatctagcgtgagaaaaaggaaattcaaggacataattttattgaaagatgtaccttttccctaacaaagcagtttgaagcacttgagtattcaagtaggcatactcccttccttatcaagctctcctgaaatattcataactgcaaatctagtgaagtttaaagagaatatgcatctatactgcaaaagacacaatgttgtgtcaatttaggctagactgacattttctaaaattatttctcactatagtaatagtgcagttctaattgcaaggatatagcctgtcttaaatgaaacccatatcaagttaatagtagtcaggattgatttgcccagtcctctggagaaaaaaaaacaaaccccaaatgattctttaaataaattgtcatttaaattctaggatatggttactgctttgaatctctttttactactcatagcatagtatgtggattagcagcttgggcatcatatgggaacttactagacatgcagatatctcaggtcctgctccagacctactgaattgaattatgcattttaataagattcccaggaggttcatgtgctcattatagtttgagaggtgctgttctggttgaatagtttgagttttacattattccttacagatgattctgccaggaaaaacaaacagaaaaccaaattttttttatctgaaatgctttaatatttaaaaaaataaaagtgtgtaaaataagttgtaatttgaaattatttcaaacatgttagtttgcagtcctaaatttatcttggacaattttattgacttaaaaacttaaattccacatattgtcaattactagaatgtatgtatttagagcaaaaggaatgtatatatttatatatatgtatatacacacacacttcttttatatatatactcctttatatatatatatactcctttatatatatatatactcctttatatatatatatatatatatatttaaatatatatagagagagaatgaggaaattagtttaaaaatatgagaactttgtgtttggttggctagtctttattttttgaaagcaaatgggcgaagggccttctaagaagctacacaacagaaaattataggaccttaaatggaagatagctgaaagaataaaactaaagttggtagtgggatgaagttgtaggaacagcttttggaatttttatggtgcaacctttttatttttctctagtaaaagtcagagcacctaaactacagaagggataaaaagtaaatagtcacaagaacaatgaggacttttgtgtatagctctacacatttaaaaaaagagaggttctaatatatggaatatgaagttttcaatagcttaaatgctttttttaaaaaaattattgattgattaattgattgggtcagagtctgtctctgtcgtccaggctggagttcagtggtgtgatctcggctcactgcaacctcctcctcctgggttcaagcgattctcctgcctcagcctcccgagtagctggggttacaggcatccgccaccatctccaactaatttttgtatttttagtagagacagggtttcaccatgttggccagactggccttgatttcctggtctcaagcaatccacccacctcagcctcccaaagtgctgatattacaggcatgagccaccatgcctggcctttaaatgcttttaaatgtgaaatttttctgtatacttcaactttgtcacttagaaaatattcaaattttgaaataagtatttaataataatgacttgatgtttagtatgtacaataatataaagaagaagaagaacaaatgagctcacttttttttttttttgagacagagtctcgctctgtcaccaggctggagtgtaatgcacaatctctctgctcactgcagcttctgcctcccgggttcaagtgattctcctgcctcagcctcctgagtagctgggactacaggcatgcaccaccacacccagctaatttttgtatttttagtagagacggggtttcaccatgttggccaggatggtctctatctcttgacctcatgatccgcccgcctcagccttccaaagtgctgggattacaggcatgagccactgcacccagccaagctttatttttaactgcagatatagtacccaagtctaaagtatacagttagttgaatgtttgtatttgcatatgctcattagctatcacccagataagatataaaacatttctagcccttcagaaggcatcctctttccccttcccagtcaatatctaaccccggtgtaaactgctgtctgactactgtctcttgttttgcctgctattaacttcatgtaaatagattcatacagtgtatacttttttggccctgacttaacatatctgtaagattcatatattttgcatgttcagtagttcattttttaattgttgtgtagtaatttcattatatatattcaccacaatttactcattctgttactgatggacatttgggatgtttctagttcttggatattgtaaataaagctattattaatagtcttatacatgtgttggtggacataagtttttatttctcttgtatgtatgcccagaaatggaatatctggattataagattgattagctttactagatattgctaagtatttttccaaagtaattgtcctagatcacttcaccagaaatgtgggagtttcagttgttccacattctctccagtacgtgatgttgttagtctttttaattttaggcattgtagaaagtgtgtggtggtatttcatttgcttgtagtttgcatttttctcaagattaatggtgatgaacaatttttcatgtttattggctgctggatgtactttcttttgaagttgtcttttaaagactgttgcagagagtccttactgggttgttacctttttcttattgacttataagagttttcaaacatgtgtttggatacaagtcctttatggaataataagcatcacagatattttctatcactttttgaactgtcttttcactctcttagtcatgtattagattaacagaaattctcaatttttaattcagtcttgtataacaagcttttatttcatgattagttccttttgtgtcctgtttaagaaatctttggctatctcaaggtcatgaggacattcttctgtatttttctctaagaagcttgattattttagcttccacatttaggccttcaatccatctcaaatttttgagtatggtatgaaggtaggggtcaagtttaatttgtgtgtgtgtgtgttgtttaaattactttattttccttgctttcaatttttcttgcctttggccttgatccgtgtcgtaatgtctggtaaaatataacaatacctaataccatgttctcatagtaggtcttcaacagatgtttgatagattgaaaaactagaagagccttagaagctaatcttctcagtcatctttgtccttagctacatatgtatttcttaggttacctgagacttttatgtttttttccagttaagttgatatttaataattggttgtcttagtaccagtagtgtagttgcaggtggtttttgtgctgcgatgcaggtatagcctttcttaaattaaagattcagtctgagtttgttggggatacttatctcgggtgagcaattgatggggctccgcattagaaaggcaatatatggctcaaggagaaatcctgggctttggagtctgatagagctgtactcaaattctaacttttccaatcattatgactttcagtaagttgtcactatgtaattgagtttttactaaatgtaaaacaaagaattacggcacagtcaacgtagattaacctgccctaggtcacatagtcactaagggtgaatatatatccaggtctgcctaattgctaagcctgtgcctacttcctggtggatgttccatacataatagttccttttaacattttccttttatttatttttaatttttataaatttatgagatactaatgcagtcatgttacatttatatattatgtaatggtgaagtctgggcttttagtgtaatcatcacctgagtactgtatattgcacccagtaggtaatttctcatcccccattcccctcccaccctcccaacctgtctgagtctccattgtctattattctactctgtgtccatgtgtacacattatttagctcccacttataagaacatgcaatatttgactttgtttatttcacctaagattatggcctgaagttccactcatgttgttgcaaaagaaatgatttcattctttttcatggctgaatagtattccatggtgtgagtgtatgtgtatatatatgtgtgtgtgtatatgtgtggtgtgtgtgtatatgtgatatgtaacacatatatgtgtgtgtccacaaatatatatgtgttatatgtacacacacaccacattttctttatccagtcatctgttgatgggcacttaggttgattccgtatcttcgctattgtgcatattttcatgtggatatacacttgatccagcaccatttattgtaaaggccatccattcccactgcagtgaagtggaaatggtcataaattacatgaccatgtatgtggatttgtttggtaattgtgtattccattgatttattttagattatttatttattccattgatttcattttatttagaatcaacttgtgcatttttaaaataaaaaagctttctgaggctttgattaaatctatagatcagttgaggagaaattaatatcttaatgataccaagatttccaatttatgaatatcatatatctctccatttacttaggtctttagtttctctcactaacctttcatagtgttcaggccttgcacatctttggttagatttattcccagatattgagtggtttttttgatgcttttgaaacttatttttctctttaaattttattttacacatatgtatttctagtatagagttgattttgatcgttgattctgtttccacatacctttaaggcagtttgtttttgagtgcaagagtaagccattgaagatttggtctcacatcttcatttttgaaagcattttaaaaatatcattgggactgctgtatggagaatggaaagtgggtatggaggagcaaatttggaagaaaggagaccacttaggagactcttagagtaagtaaacctggcaaaagtggcctactatagagtagtagcataggatgatttggatcatttgcatttggaatatattttaatggtttagagataattcagtaaattaaatgagggaaatgaagaaaagaaaaaaatcaacaaatacttttcggttgttgatctgattaattggatatcattaatgcttaaatacccccatttaatgtttgtaaaataaaaagtgataactattgttcctactcccttttgtatttcatacaaactctaagttctttagaagatttttcttttttaaatagggcagtgaagacattagctggttcttttctttttttttttgacattagcttttgtttttgacgaaagaaaaattttaactttaccatataatgctaatttctgtcttttaaaaaatattaacttataaaacagcatatctaattttacttttgtttaagattacattggagcccatgagtgggcttctattaatctataattgtttctgtaattttccatgtttatcttttttttttgagaaacaaatggtaaactcaatgatattcttaaagaagtctgccttcctcctccacctgtaacatgtaagaatcaccggtttgaaaagtttaaagcatatgagtcacaaggatataaaattagctagcaaaatttcaatgtagcaaaacatttaggaagaaaggatgcgttatgtaaacttgaagaaggcctcaaataggttgtaagatactggggccattagtgctcatagacttcaatgtggtcacgatcttaagaaacagctgttaatagcaccttatcatagattccctacagaagaatctaagagctacagcatcctctctgaaaaaattaactttatagaattcaagtaaaaatatcacctatgaaaatcaaaattaacacttcggtgtagtggttataagcgtgacctttggagtcaatgcttgggtgagagtctaagctctgccccttctaagaacagtgggacctttggaaggttatttaatctgtccctactttagtttcctcatatataaaatttgatattattccttcctcctccttctcatcagtcttactcatcttctgtaaaatgggaatgatatataccttaggctcattaggattaaatgaagatcacatgtaaaatacatggtacagtttttagattattttttcacattacaaaatactcattttgaagatagaaatataaagaaagtttaaacatgactataggtaacattcagcatttttaatatttcagtcttttaaaaatatgagtgtacacacacctgtacacatgatgtgcatacagttttgtctttgtttttgtttttgagattgagtctcgctctgtggcccaggctggagtacagtggtgcaatctcacctcactacaacctccacctcctgggttcaagcgattctccagcttcagcctcccgagtggctacgattacaggtatgcgccaccatgcccagctaatttttgtatttttagtagagacggggtttcgccatattggccaggttggtctcgaactcctgacctcaggcgatctgcccgcctcggcctcccagtgctgagactacaggcgtgagtcaccatgcccagccctgatgtgtatcttgcatttttcatttaacatattattggggcttaataaaatcttaattcttttttttggaaacatctttaatactgtacttatggatcccattcttccacgtagaagccagttttagatgaattattttagttcattttccctattaaatagcatttataatgccaaaatattccctcataatactgttggaacatgtctgttgtccagaggcttattaagaaatgacttactgtttagtcccttggtatttcaaaacaattgattaaatatgtagtggtatatgtatatgttttatgttgtaactatgctgcaggaacataaattgaatgtaagtgaccatagtcaacagtttttattgatatccattatgcttaaaacattgtgaaagatagagcagttaagaagatatgtgcctgaaataaggagtctaatctgtttgaagtagacgttctcacatgtcattttagtagccttgtactttggatttaaaaacaagcaaagatgtttgcttattgtccctaagggagtatgctttgaatataaccagttattttgtatccattcattcacatgaacctacttaggttagtggaacataaccatggtataggtatttggaagtaatgtggccatgtttgcaacaaagcttacctgcccgagcaagtacttgcatgcctgctgtagatactcagcgaagtgtcatgtggccaacgtcaggttacaactctagttaagatttttgagagtttaagatcatgacaaaaatagagggaaaagtcaaacatacagaataagaaagagggaaatctttatttgtaaggcaaaagttcacattttcttcaactttctgtcagtatgtaagatttctatgaatagctcaagtcctggcataagtagcagtgataatattaacacctctttctcccagtcacatcattctgaggatgcatctgccactcacttactgatgctgactggtttccaaggaagtggagtgtgaataaacttggattttctacacagcttaaagcttataggaatttctgtattatgattattgttttacatgaagttcataaattgtttgtttctaatggttgctactacctgttttaggctctctaaataacaaagcccacttaattctagtatttggcctccacagccttatatggagatatgaaagacatagtaaagagggtctcttccctaagggagattatggttagtataaagtaagtgcaagaatgcattggagggacttcaaaagaaatatagacttggccaggtgcggtggctcacgcctgtaatcccaggactttgggaggtcaaggcgggtggatcacgaggtcaagagatcaaaaccatcctggctaacaaggtgaaaccccgtctctactaaaaatacaaaaaaattagccgggcatggtggcaggcgcctgtagtcccagctactcgggaggccaaggcaggagaatggcatgaacctgggaggtggagcttgcagtgagccgagatcatgccactgcactccagcctaggcaacagagtgagactccatctcaaaaaaaaagaaaaagaaatatagacttgtctcttacaaagtttaaccattagaaatgaattttacaaaatgaaactaaagtgacaaaagtgagctatttctcctccttagattttctttctgttattctgctacaggattttatagtcacaaagtttgtttatctgaaaaactgccataattttcacttagctttagaagtgtggttcttaccttgttgccgatctaatggatgtgtgtaaaaacacctcatagaatggcagtttgttgaatgacttgagttcaagtagcactcacttgcaatgatttaccatcaactctaactgtggcaaagtgtgactttagccttaaatttaaactccttaaagaccttatttcaagggggaaaaaaatttcctttcaactttctcccatcagtgtgtaagttttacatcattggtcttctgttttgtttggcaattaaaaatctcttgtgttaatttttgaaagtttttttttttaagatttattgcttccaagtgcaacaaaaataaaaataaataaatgggatctaattaaactaaaatgcttctgtatagccaaagaaataaccatcagaggaaacacacaacccacagagaaaatatttgcaaactacgtatctgaaaaaggactgatatccagaatagaaggaacacaaacaaatcagcaagaaaaaaacaaataatcccatcaaaaagtgggcaaatgagatgaacagccatttctcaaaagaagatatacagatggctaacaaacatatgaaaaatgctcaacatcactaatcaaggaaatgcaaattaaaaccacagtgagacaccaccttactcttgtaagaatggccattattaaaaagtgaaaaaaaaaaccatattgatgtggatatggtgaaagggaatgcttatatactgctggtgggaatgtaaattagtacaacctctatggaaaacagtaggaagatttcttaaagaactaaaagatctaccattcaatccagcaatcccactactgggtatctacccaaaggaatagtagtcattatatcaaaaagacacttgcacacatgtgtttattgcagcacggttgcagttgtaaagatatggaaccagcctaagtgcccatcaactaatcagtcgataaagaaattgcaacaacttgaatggagcaggaggccattattctaagtgaagcaactcaggaataggaagccaaaaactgtatgttcttacttgtaagtgggagctaagctatgggtacacaaaggcacacagagtgatataatgtactatggagactcagaagggggagaggatgaggagtgagggatgaaaaattacatattgggcacgatatacactacttggatgatgggtgcactaaaatctcagacttcgccacagtacaatcatccatgtaactagaaaccacttgtacaccaaaagctgttaaaatttaaaaaaaaatttttaaagatttattgcttccaaaagacactatatactcctctctctctctctctatacacacacacacacacacaaacacacacatactatatattatagtttataacctagaagagaaaattacacattaaacatttaggttcttaatcatacaaggtttgtagttctactagagctgtactcctcatctagcttccctggaggatttattagatttttttttctgtttatgaaaggtattgggaactgacacataacgtgtttgctctggtttctatagctgtctatttctatattatagctattagaatgctagcagatctttctgatttgttctaagctaaagattccactgaaaaaaatttgagtatcttcagtttatatttcttatgtatatgcatgcacatatatggaatagctttatatttaaatttttggaattatgagtatgttgatttctattaaatgtatatttatttttaaaaacaaatggaaacacaagaaaataacactcatctacatcctgtcaccctgaattgactgttattaactgcttggtagttggttgtttcttttagggggcagagatcactctattaattttgtaaaactgatatgcatatatttatacataatttaaaccatggagaagagcacaaagatgaaaatttttaaaaaaccctcttcttggaaataacattagttaactttattataatcagtttaacaacagtctggatatcatttgaagtaggaatgataaatagaatacttttgtgaagaaaagatcatattctggaggttttttttaagttcacatttatttgaatctaatgaaagaaaaggagacaaaactgaagaaactgtggaacttgaaatatgtatctcttcacccaagaaatattttccttcaattttgtaagttttggctttatgtgttttggggcttttttgttgggtgcatatatgtttataattattttattttcttgatggattgacccttttatcattatcagaatcttttatttctagtaattttgttttaaagtctgttttgtctgatattagtatattagtgtagctaatttaatctagctttctttcagttattgtttgcaacgtatatctttttatatccttgtacatctaatttatttttgtcttaaaagtgtgtctcttgaagttggcatatagttggtacatggtgtggtttttcaaattaatctgctagtctctgctttttgattgtcatgtttaatccatttacacttaatttaattgagggtagagtaggatttatgtctgcaatttgcccttttgttttctgtatgtcttaagtgatttttttttctctgtgtccctgttacttcttttacactgagtagatactttctagtctactaatttaattcccttatttaaacatatatgtatgtgggtatagggttagttatatttcctgagtggtgccctgggaattacaattagcatcttaatttataacaacatactttgaatagtatacaaaaactttgctcctacatagctccattctcctcttcctttatgccgttattaatacagttaaatcttattacattgtatgcccatcaacatagacttataattattgcctcatgcagttttcttttaaattagagttatgaacaaaaaatacattaaaactgtcttttatagttatctttgttggagtcttgaccagtgctctatttctttatgtggatcgagttactttctagtgtccagttttccttagtatgtcttgtagggcaggtatgctagtgaagaatttttgcctttatttggagtgtcttaatttcccccttactcttgaagaatagttttgctgaatttgaaatacttggttgacagtttatttcagcctgtgactatgtcatccaatatgcagacttctggcctgcatgttttctggtaagaaatcagctattgatcttgtcaaaaatccttgttcatagtgagttatttctttttagttgctttcaggattatctgtcttttgacagtttgattatgatgtgtgttactgtaggtctcttgagtttatctttcttgggggtcagttagcttcttggatgttgattaatgttttttaaagtcaaaattggtaatctttctgtcattgtttcttcactgcctttttttctttgttctttccttctgggcttcccctttatacttatattgttaaatggtgtcttatctctgatgttctgttcattttttcaattctttttctttctatttctcagactcaataatctttaagttcctgtctttaagttcgctgattatttattccacctgctcaaatctgctgtaaggccaagcacagcagttcacacctgtaatgatagcattttgggaggctaaggcaggaggatcacttgagcccaggagtttgagaccagcctgggcaacatagcaagactaccatctctacaaaaaagaaaattagcgaggcttggtggcatgtgcctgtagtcctagctgttaatacttgggaaactgaggtgggatgatcactcgagcatgcagtgagctgtgattgcaccactgcactttatcctgagtgacagagaaagaccctgtcaaaaacaaaaaacaaaaacaaaaacaaaaccctatagttaatttttcatttcagttgtgtactttttgactccagaatttctctttggttgtattttattattcctgtctctttattgatattctttatttggtgagacattgttttcatactttagttcttcagacatgattttcttcagtctttgaacgtatctaaaatagcttgtttaaagtctttgtctagtaaatctaacatctggacttcagagaatgtttctgttgaggtgtttttctgtgcatgctgtgcatggactatattttcttgtttgcttgcatgttttatgatttttttgttcttgttgtttttatgaaggagagagtatttttggacatgcttactttgctattcctggtgatgtcacttatgtattaactttctacatgaaaccatcttataataaatgccgatatttgaaaattcttacacctttctgcctacctgccactaagatgtagtctcttacattgtcttctaagtgctatttttaaaaaatttacaaaatgttactttattaacattgtaagtattctgaaaatatttttaaagaaattcataggcacttctttttatgtatcatggtgccaccaaataaggatagtgaacttggcataccttctacttagtaagtgcaaggcatgttactcagccatgcaacaatctcatttaatatttacagagtccctctgaagctctgaaaacttaagtaacttgctgaagattacacaactagtaagtgatagatccaagatttgaacttaatgtgtttaactctagagcccaatatattaatggtaatgttatactgtttctgtgaagtgattttcaaaatgtgggacccatgggttaccttcttgagagactcctggggtgcttgttgaactgtcaattcctgaacccctaacctatacatattgaactaaaatctctgaaatttgggcctgagagtaggtgacgtttctcaattatattatagttggaatagtgctggtctatagactgcttttttcttatgatttgggctaaaaaataaaacagtaggccattttaaatccatattaaaatgtaattctacaattcaattgaacactaacttttcaaattaattttttgaattttagagtacaaggtgacatattctgagataatctgacaaagaacttttctctcactttgtgtgctgttaatatagttcaaagtaagctattgataaattataggtttctaatgtgtgagtctgtgctttataacttttacatttttttttactatgaacttacatttatacattaaaatttagtggaaaaaatataaggagtgggtaaatcatctcttgttttaggttgaactcccaccacctgatcttggaccaagttctgcactaaatcagacactcatgttgctgcgtgaagttttagcatctcacgattcttcagttgtaccattagatgctcgtcaagctgattttgtgcaggtatgttataaattcatttttaatgattgttttttgctcttctattgtacactgtgtttcaattctggaattttgtaattcatatactttgacagtctctttcttactgttaattttccatcaaatattaaaccagttatcataacttaaaaagcattgatttatgtttaatcttttcctacgtgcttctataaattggcttccttccaattagtttggcattaaatatcattaacccaagaccctatcagtgattgagaaataaagagttcattttatttttcatttgtaggttttatcatgtgtcttggatcctctcctacagatgtgtactgtatcagccagcaatttaggcacagctgacatggccactttcatggtcaattcactatatatgatgaagacaacattagctctatttgaattcactgacagacgtctggaaatgctacagtttcaggtaaatttttctataaaatgactattgactatgattgaatctttttctctatgtgatagctttaagttattggcttaactagttttaatgacctaattcctatagatcccttgatatcatctgatgaaaggacacacatgcatatacacaacacacgcacatacacaacacacacacacacacacacacacacacacacaaattcagtatttcagttttcagctttagaggaaccagaatgtgtaatgtttaaaatacttgattcataccataatatgtgatagtagattgaagctttctgattaatttgaacagttagtctgtatgtggattttagtttctgaactgtgaataatatgctatatttttcaagctgcatagttaatgcaaaatgtgttacagaggacagatatatttttatctatgtgtaaaccagtgttaggcaaaacattacaaattgctataccaaccacttgagttcttgagtcctataaagcaaatggttatcacttaagagagtatatgatgactaaaacaaagccagttgtaaaatttagtagatagttggattccagttttaagcagtgattattggtaaatatactgttttttaaaaaaacaactctgaatgttctgtgctatcacacatatatcaacagtttgacagtgggtataggaatgagttttgatatatctaaattcatattttctaatttttaattttttcttttaaaataaatgtatcagaattttccatatttgtggtttaaagtcaaataattctacagaacttgttacgaaaagccaccagtgtaccatcctctccacccccaacatctctttctcatttctccctcaaaagcacaatttctttcagtttttatagttgcttcttttggtatttatatttgtaattctaaacacttacgtgtattgctacttatagattttttttagttttttgtctaatgtattaaattagatatattctaatacattgtgaaatgaaatgaacaatgaaaatttagttatctactgccactcccccaacccccctggataagaatatggtcatacttaagagttttcccatcctcccaatgtagctatattataaattttggttagatcaatgttttgttaaattattattactatgtaaacattattggtgactgagccatgtaatgaagaatggttaatttacctttcttggataacttcttcattttctgtggaattaataacatttttatttaagaaatgtcacttttttatgtatttgtcactaattcaagcccaaatccctgccatttatctaaatcttaagatgttaagatatgtcaggtgtttatcaatttgctttattaccaattatctatgtttcttatgtgttccatagctattttacgcatggtaaaaattcttcttggtctatgtgctaaattaagcttattagtttattcaagttatctatgtccttgcttatttttgccaccattggatgtgtcaactggacttttacatgtgttttaacattctccagaaatctcttgagccagatctttattagtcctggcagcattttcagtaattgttctgtcagcagataattcaggttcccctttctccagactccagtagcaattttcccagtgccctttcagaccccactggcagtcccttgagtgggtattccaagtggacaaatcccagtgtggaagtgcttattggcctattcttgcattatgcttgtcagagtgctgtcagccaagactggccacatagaacagcctggattcggtgtgatagaggacaatacaaaggtgtggatatgtgaaggtgtggtttatcacgtttctccaaagtaacaatttaccttgttgggtaaaggagtcttgattttaggacctttactaccaataacctattatttttttcccactcttatatagcttcttccagtgtttcaagcaagaagtccaggctagtcagattctcttgtttttagtaatctagtcccttcatctggtaacttacagggattttccattgagtttatatgttttcccaggatatttttggtatgtctctttttaaaaattatttgcatcttggactttggagaaccatttcaatgtaaagattcaaacctttcttttgcttagtaaagagttctatttctttaatcatcacttttctatgtgttactttttatattttgaagcccctgtccttggttggttttatctcacggatctgccatctaatttctttttaaatctcttcactttaatctatttctttgatatttgctctgtattactttccttccatttttctttcagaccgctgatttgatgctttgcagtaactctttttcaccttcattgagtgtttacctttgcgcactttgtttttctttggtttctagtaaatccagcaagtaagggctctaattgtacttccttgggcatttatttaaaaaaaaaaaaaatgaaagtactttatgtctttcagtagtgttgcctcaggaaagaaaccatacttgttctgattattcacaagggctttcttttagcttcctcacctcttttaaatcagttctaagttttttagggggacgagcagagctattggagttgcttggaaaatggcaatcatttagatggtaacagataccatagttgacagtgtactatgtcattagcaagcaaactggtaaaatctgggggaacattctggtgaggaatagaaggaagacctctagactcaggattgtactggcacaaaaaaaaaaaaaaaaagaacaagattttttctcaccagggaatgtttcaacccatcaaggtagttctcttctgtggtttttatctccattagcattagttggaatcccccaaaatagcacaaagctggggagcccatactactcacatctgttagctgcatcttcttaggcagttcctgaacctgaaatctttagtcaagtttctactgggccctcagctcttccctacttgtcacagacctgccttatcctcaggagaatttactacctgagctgtagtgggatttcctctaggcttctccagatggtatatttgatttgttaagtcagtctagaaagttgggagcgtgaggaggacaggaggtcaggaacatcaggcccttatctcggaattcttcctaaatattttattttatactgttgttgtttactagtgttttttgtttgtgttttgtttattagcagcttttaaaagggctgagaagcaacccaaattttgtgactggaggatagtcctagaatcctccttgtttataatttttaaagtaagactttttccccctttcatagaaagacttactgtttgggggaagaaagaggctttgttacagaggtgatccctgtgcctcatcatcagtgccaatgcaaggcactgcatctactctcatcagtgtcattcttcttttaaaatgttttctttgtgttttattttagatcgaagcacatttggacacacttataaatgagcaagcctcttatgttttaactagggtaggcttgagttacatctataacactgtacagcaacataaacctgaacaggtaagtgcatagatgttccttcctaattctaagaacatgccagtttagagtatgtcttctagagctgcactctggattcttggctctaccacatattagctgtgttctcctgggaaagtgacttatttttctgtatctgtttccttacctgtggattgggggtaataatagtatctgtgtcataggattgttcttaagacataatacatgcatagttcttagatgacttcctaaaatatggtagagtgccccacagtattaacaatcctttttattaaaaatagtttttgttaaaagtaatgaaaatatacaaaaattagtattataaaatgtctaaagaatattcatactggtaagtttttcagattcctatatcactattagttaattgaatgcatagattactgtataaatagcagtcatcttctttttaatttagcaaattgttgcccattactttgagaaggtagtcacttctggggccagcatatgatcttattaaattatagaaccctagtagaaataaaggagtggtgggaaccttagaaaaccatgtaagccatctttcttaagaaagcaaagaactcattcaaacagcattaacatgaagactgtgttatggcccagaaactcttaaatgaagctcttaaaacacaacttttcaattctttctttgctgaagtggtaagcaaatttctaccagtaggaaccaattttactgcctttctgtactttctaaaagtatcaaagtgaaactgttcaagcctccatgtgtcactggcatcttccagtgcttcattgccttcattttcttgggtatgcgtaaacttgaagtatcatgatatttctgttgttaataaacttgagcacgtcttgctctctccaacaaatcatagtccctgatcttattgaggttgaagaaattacacttgagttctttggaaataagctaaatgattttccaaatttgggcagtgcactaatgaactatattcagtaagtgaaatgaaatgtatatctccttttttacatcttggatctgcttttttttttttttttttaaatagggctctttagctaatatgcccaacctagattctgtgacactgaaggctgcaatggtaagtgtataataaaacattttaatttagatttccttatggatcgatagtcttcattttttgctgtgtgataatttcattctgggtgacactttttatctcttgacatgctgtattaacgttgggtccaataataatgactgagcctgtattactttaattgaacagttctggccaagtcttacattcatagtagtgttccactatgctctgatagtctcatcattactgtttaggattactgtttactctatttttagagttttgttcctaatttaagtgagaaacaggaatgacagatatgaagaaattaggctgtatatcattataaacttattactaccttgatccttcgtttaaagttcctgacgtgaaaatcgaaattagattccactcttaaaacagtttattactctttagtttgagactcactgaatttccactttattaccttccttcttttcaggtgaagatcttgtaccttcctttttgcatgatcactactttttgtagtgtgtttctgtgtcttaaatacatatactttcctcatatgtatagtgttcatatgcatagccattcattgtatgatatttaagtcatatagctctatccctcataggaatgatcccttttggaagttttatgatagtactactagtaatagtaataataatatggaagaacaacagccattaacattagcatagcaagtgttttccctgtattaactctttaatcctcatgacaaccccattcaatccaggaagttggcctacagagcttgtgggtttaactactgtactaaactagtgatcctaagtatttaaaatactcacgtatactcactaccacaatggcctgactttcatagatagtcctgtaggaaggtttttaaattttccaacaatttttgatgccaaggctttcctatatattatcttccagaactcagtttaactgaaaacaaaaggataggctcataagatacctaacaaatgcaaagaagaaggtggagctatctatatgattattagataaagtagaatttaaaaagactaaatgagacaaataagaaacattatgtcgtgataaaagacactatatagaagcaacagttataacttctatatatgaaacaaaaacatagtagcaaaaattagaaatgcaaagaaaattcgatattaaaaagtttaaataaaaatagatgaaaatgaattttagattcattaaaagatatgtttttagaaagttatatatacacttaccatactatccagtacaattccacttcaagatatttaccccccaaaaatgaagatctatgctcacacttagatctgtaacattagttagtaccaaatatatgttcccttcctctgtttctccttctctcttgacacatatccagtctgtaatacaactcataaaatatttgaaatgccattaaaaattcttcatgttcctggtgttaattttcagaacaattaaggtgaatatgaatatacgatgtctctggagaaacaaatcttgcttgagttttgtatttaatacgtgattatatacaaccatttgttgtctccatttaggggtttctaaggcacttcaattcagcatgtccaaaactaactctgcacattccaccctaaacctaagtcctcttccaggcattattaactcagaaaattgtaagaccttctatccatttatcatttaaatagttattaaccgagtttctgctattttctaggcatcatgctaagaattgggatgaaaacagatatgatctagtaagggatgcagctactacacaaataaatgaatgaagagtacagttatgtgttatgataatatggtgaattaattcatacatatccaaaatctgggagtccatcccttcattctatcagtaaccaagtcctgatggtcctcaaatatctttacgtctttcaccttgattgcccctatagtctaaaaatgctgcagtaggtacctaaggtacctaattggtgtctttgtatctattattgcaatcttccattctgtcttcctatggccagatttagcttcttaaaacttaaatcagatttctcccttacttaaattcaatggtttactaatgcttttgaaataattaaaatccttaaataagcatgccagtcctacatgatctctacttatatgttttccttcccacctcaagtcttcatgctgtctcctctccctgaacctccccacccatcaatccacttacttaatgtatattcatctttaagatttcacttcaaatgtcctttcctgagagatgcttttgccgaatccacagactaggtccttgatttatgctttatagtaccttgttttattccttaatagcatttaacaaaatttgtaattatatatttatttatattattatctgtttaacacctctcttgctaggccataagctctgtgaagctagggactatcctttttttgctcatttttatacttccattacttaatatagtaccttttcaatggtaggtattagttgaactaatgaatgcattaatgaacaaatgaacaaatatagtaaaatcaagaaacaggtagacctgaaacctgatgactttacttcttgttaatattattacttaaaagctttgtgaggaagactaaaatgaatggtttggattcaggattttgaaagtaagtattgctaatattgactatattacagatttgacagttttagggagttttagttagaatgtttagaaaatacacaatttgaacacaacaatctagttatttagagtatggaatttttctcaaggatttaattcttaaaagagatgtttatatttgagttgtttgttagcacatatatgtactttatattttgtatttctctgtttcatttaggttcagtttgatcgttatctgtcagccccagacaacctattgataccacagctgaactttcttctaagtgccacagtgaagtaagtatttttggtcccaagtagttggtaaagattcacatatttttaaatatcaagtacatttttttggaaaaaaatttattttcaagaataaatgatttaccattgaaaatctatagttctcaacctttcttctgccttggcatgccaaaggatgagatctgaacatgtctgtacttattccatgtctatatgtcactccaaaatctctaattagtacatgattgttaaaattactttgaatataattgaagctatatagctgtaataccaaattcccttacgttaacaaacatgtcagaataatgttgaatatgttatggaaaatcaataatatattcattatgcaatgcagatgaactgatttatagactattttgaatctaaggtagtgttctgtagatataaaattactcaatatcatttatcaggaatgtattcaggacaccaaatcatacattaaaatattagaatataacaattagaagaagcggagagattatatgatctttcttgattttaagaaaaatattggcaaaattgtctataggtaagaaattaggcaacattatctacacatttttttttctttctattcaaacagcagtgcagtaagtgttttctacataacaggcactaggagttaaggcttaaaagacatttgcactgttttcacggagcttataacctaataggtcagttaaacatgcgaacaaatatttacattgaaatgtacagtaaggaaagaactattgaacaaaacatttcagatatctaaaagaatgtaatgttatagaggtgatatacttattttctgttcttgagtatagaactacagcagaaaatagagcaaagaagcagctttttaactcaccatgcagaatttggtatcaattagaattggctggaaatctatggaccactttttttttttttctcagacacagagttaggaaagttccattttaggtgagtgactagagtaaatgaatttaatttttttttgtgacctttatattgtattattctaaaagatattatactatttacataaccagaattctaaagacttaagagattaccaaagaaactgttatgctgtgactcaggttgtttgtaggtgcttcttttttttttttgagacggcgtcttgctctttctcccaggctagagtgcagtgatcttggctcagtgcaatctctgcctcccaggttcaagcgattctcctgcctcagcctcctgagtaactgggagtacaggcgcccacctccacacctggctaatttttgtatttttagtagagatggggtgtcaccatattggccaggctgttcttgaactcctgacctcgtgatccacctgcctcggcctcccaaagtgctgggattacaggtgtgagccactgcgcccggccaatgtgcttcttaaattattaaatttttaactgaatacctgtaattctttttaacttaactgtgtctcagtacgtaatattagaatgttgttagccatgtcactacatgtgaaatatactgttattcttttcataatataatgattgaagagagattttaatgtactttaaaagatgacatgtagctcagatgctgtgaagcaggggtccccaaccccgggccagggaccctggtctgtggcctgttgggagcacaaaccctactgtgaactgcgcctggaaggatctaggttatgtgctccttatgagatggaacagtttcatcccaaaaccatcccccaacttcttgtccacggaaaaattgtcttccacaaaaccagtccctgctgccaaaaccactgggagctgctgctgtaaaggaaacagatggacagatttggctctgtaacattttaaggtttttacagaaaaagataatataaactaagttgaaatataaacaataatatggaaaaatgtttgcaaaatatgtaacagataaattattcttaatatattatccttaatatatagtaagatcctataaattcatacaaattgtagaaaaacaggcactgaatatttgaacaactcacagaagtaatggaaatggcaagtaaatatatgaggaaatagtaattatcaaaaaatgcaaactgaaacaacgagaacttctgtctatcagactgctgacaataaaacatttattacatactaatggaacaggtctgagaaagtgggcattttcacacttttttgaatgagagtataaattagtacaatcttttcaaagagcagtttggcaacattccacaaaatttcaaaattatacattcttaggctcttctaaaattttatttttctttcttagtcttggtaatagtttaaaaaaactgttgaaccagcagtgggattgagtattgtgtatggatctattcgagtcgtttgcctcagaaacttgtcagatttcctaagcttaaatcatttttgaaattaaatgtttgtcttccattattgaagacaatattttagtttctcctttacttttattgtcctgttgtctaacggtaacaatgtaaactttgttattttattatcagacaaatgaacaagttttggtacttttttttaaatgtgaatttttaatttagtttttaaaattattttatgatatgtgcctaacatcctattatgaattcttactatttataatgacatttaaaattgagatatgcatattatttatataagtattaatactacaaacaagagtttgaaatttcttagtacctatttacctctgttttcattcagaaatatttttaaatgttatatgcaaagtattggaaaattaaatgtgatctgcaacataattttcaatatttgtttagacgaacagaaattatggtataaatttagctacttattttcaaatcaggattgctttgaaaatatagggcattttacatatttaagatttaacgtcaggccgggcgtggtggttcactgaatgcctgtaatcccagcactttgggaggtcgaggcaggcagatcatgaggtcaggagttcaagaccagccttgccaatatggtgaaaccctgtctctactgaaaatacaaaaattagcttggtgtggtggtgtgtgcctgtattcccagctacttaggaggctgaggcaggagaatcgcttgaacccgggaggtggaggttgcagtgagccgcagtcgcaccactgccctccagcctgggcgacagagcaagactccatctcaaaaaaaaaaaaaaaaaaaaaaaaaagatttaacattaaaggagattttcttatttttatttttttgagacagagtctggcattgtcacccaggctggagtgcagtggcataatctcagctcactacagcctccatctcctgggttcaagtgattctcctgccttagcttcctgagtagttgggactacaggtgcatgccaccactcctggctgatttttgtatttttagtagagatgggggcctcaccatgttggccaggctggtctcgaactcctgacctcaaattatacacctgccttgacctcccaaagtgctggggtgacaggcttgatagcactcccggcctaaagcaaatttttaaattgcgctcctactatctgtttttggttttttcctgttctcttctcctgaactttatctatcttcatagttgcaatacctttgggacacctataacctgtgtctccctttttcttgtcttgtcttagtttgactgactttcaaaggagattttgatttagcacttcagccttggaataagctattgaatacatttaagtagctaggaaacaaggtggtataggaaatagggaaaagaatagagaaagaaaatggttttaaagaattcttccctttggagtgaatttgaagcttcttgttctattttcaatgcaaaatctccaatattcaccttatagcaatacaaaaatagagtttggactacagaaaccacagttgtgcatatataaaatgttctcaataaatctttgcttattgagtcacagttacttccataataacttaagaaataaagagaatgcagatgcttcctaaagtgagcatatgggaaaatgggtaagttttgataactcttttattcaaggtttttcctccattatagaaataatatgctagaaataaagcatgtacctataatggagtaatttttttgagagaaattgaacacttttttttcttttaactaccttcttttattcacttgtactatcaggaatatccatatagacaaaaataaagcaagtttggggtaaaattaaaaaaaaatactaccaggaagagaactactggacagctgtgaactgaatgctttagagacctcagaaagtccaaaccttaaaagcaggattaatctccaaaggctggagaacctggaattcttatgtcaaaggaaggaaaagaaagagtatcttagctgcaggagagaaaaagagcaatttgctgttcttctgcctttttgttccattcaggccttcagctgattggatggagcccgccccattgacggtgaatcttcttcactcagtcttccaacttacatgccaatctcctgtggaaacaccctcacagacacacccggaaattatgctttatcaactaactaggtatcccttatccagtcaagttaacccttaagattaactatcagagctaatttagattcatactaattaagcttaaaatcaagcctctaaattatcaacttgatctgtaattaaattaactgccttccggaacaaaacatacatacttaaagatgacagttacagacaatcaacagtgtaacatctataatgctaagcatgtgataaaatgctattgcagtgaggaagcaggaaaatatgagccaaacctagagaaaaaaatcagtcagtaaaaacatacttacaaatgctaaagtttacagaattaacagataaggtgttttaaaaagctgttaaaaatatgttcaagaatttaaaggaaaacatgacccttagagaataggggattttacaaaattagaattctagaattcagagatgcagtatataaaatgaaaaattcactggattgtcttataggccagttgaacactccagagggaaagatcagttaacttgaagagaggacaatagaaactgaagcacagatagaaaaaaaattaaaaggctggaaaatagatggagtcttagagaattgtgagataatactaagcagtctaacctgtataattagatatcatagtgtaattgaagcagaaaaatttgaataaaaggggaattttttctaaatgttatggcaaataggaaccctcagacccaagaaattaaataccaaagtataccataatcaaattattgaaaaccagtgataaagagaaaaatttttaaagacatttgcagggaacagtggcattactgacttcttgttagaaacagcgcagaccagaacacagtagaatatcatcacctttgaaaagctaagtataaaaacgtcaactttaaatgatcgatcaaaaaaaaaagtgtctttcaaactgaaagtgaaataaatgttttgaaataaacgaaagtagagaaggtttatccccagcataatgcactgtaagaaatgggtacaaaaagaaagaattcttttttttttttttttttggagacggagtcttgctgtgtcacccaggctggagtggagcggcgcgatcttggctcactgcaacctctgcgtcctgggtgcaagccactcttctgcctcggcctcctgagtaggtgggaatatggacacctgccaatgtgcccggctaatttttgtagttttagtagagacggggtttcaccatgttggcccggctgatctcaaactcctgaccttgtgatctgcccacctcgtcctcccaaagtgctgggattacaggtgtgagccactgtgcccggccaaaaaggaagaattctttaaaatcattttctatgcttttctctattattttgagaatttttacatcattgctcatcagggatattggcctgtatttttgttgtactgtttttttttttcttaatctgtctttggttttggtatcagggttaaatactggcctcatagaatgaacgtggaagtattcccttctcatctatttcttggaatagtttgagtagaattagcattagttcttccttaattatttggtaaaattcagaagtgaagccatcagttcctggctttttctttgctgagacactttttattatggctttgatctcattacttgttattggactcttcaggttttgaatttcttcatggttcagtcttggcagattgcatgtgtctaggaatttattcatttcttctaagcttatagttgctcatagtagcctataatgagcctttgaatttctggggtattggctgtgatgtctcctttttcatctctgattttatttatttggatcttctggttcttagtctagctaaaggtttgtcaattttgtctatcttttcaaaaaatcaccttttgtttcatcactcttttgtacttttgtttcaatttcatatatttctgctctgatctttattttcttctactaattttgggtttggtttcttcttgcttttctagttctttaaaatgtatcattaggttgtttatttgaagcttttctacttttttttgtaggcacttacagctacaaagtttccttttagtactgcttttgctgtatcccattggttttggtatgttgtttccattttcagttgtttcaataaattttttaatttccttcttaatttcttcattagcccactggttattcaggaacatattgttaaatttccatgtgtttgtatactttccaaaattattattgttattgatttttagttttattccattgtggtcagagaagatacttgatataatttcatttttaaaaaaattttatggacttttattgtgtcctaacatatggtctgtccttgagaatgatctatgtgctgcagagaaaatgtttattctgcagccattggatgaaatactctacaaatattgattaggtgcatttggtctgtagtgcagattaagtccaatatttcttttttaattttctctctgggaagtctgtccagtgctcaaagtagagggttgaagcctccagctattattgttttggagtctgtctctctcattatctctaataatgcttgctttgtatatctgggtgctccaatgttgggtgcatgtatatttacaattgttatatcctcttgctgaatttacccctttatcattatatactgaacttgtttgtctctttttatgtttgccttcaaatctattttttctgatataaataagtatagctactcctatttttttgtttgtttccactggcatggagtatctttttctatctctctttttttcagtctatgtctgcttttgtagatgaagtattttttttgtaggcaacagatttttgggtcttgtttttttaatccattcaaccactctgtgactttttgttggagaccatagtccatttacattgtgttattactgataaggacttactctgccatttaaaaacttgctttcttgttgttctgtgattttcacttccttctttccttccttcttgtctcttttttagtgaaggtgattttctctggtggtatattttaaatttctttttattttttgtatatctgttgtatgttttttgacttgaggttaccatgaagcttccaaataatatcttatactgcattattttaaactgacaacaacttaacattgattgtgtaaacaaacaagccaagagaaaactaataaaaactctttaccctttaacttcattgccctgctaatatttgttttttctacttatatcttattatactgtctgtcacttgaaatgttactgtagttatttttgctaggttcatctttttattctgtctactcaagatatgagtagtttacacaccatggttacagtttacaacattctgtgtttttctgtgtacctagtattaccagtgtgtttagttccttcagatgatttcttattgctcattaatgtccttttctttcagattgaagaactctctttagcatttcttgtaggacagatgtggtgttgatgaagtcctttttttttttttttttttggtctgggaaagcctttatttgtccttcatgtttataagatcttttcactggatatggtattctaggataaaagtttttttttccttcagcactttaaatgtgtcatgccactctctcctgtcctgtaaggtttccactgaaaagtctgctgccagaattattggagctcctttgtaggttgtttcttttctcttgctgcttttacgttctttttctttggcctttgggagtttgattattaaaggtcttgaggtagccttatttggattacatctgcttagtggtctgtaaccttcttctacttgaatattgatatctttctctaggttcggaaagttctctgttatcccgtcaaataaactttctacactaatctctctctgcctcctctttaaggccaacaactcttggatttgctccttggaggctattttctagatcttgtatgtgtgcttcatttttttttttattcctttttcttttgtctcctcttactgtgtattttcaaatatcctgtcttcaagctcagtagttctttcttctgtttgattagttctgcagctaagagactctgatgcattctttagcatgtcacttgtatttttcagcttcggactttctgcctgattctttttgactatttcaagctctttgttaaagttacctgataaggttctgaattttggccaggcgcagtgtctcacgcctgtaatcccaacactttgggaggccgagacacttggattacctgaggtcaggagttcaagaccagcctaaccaacatggagaaaccctgtctctataaaaatacaaaattagccaggcatagtggtgcatgcctgtaatcccagctactcaggagactgaggcaggagaatcgcttgaacctgggaggcggaggttacggtgagccgagatcgtgccattgcactccagcttgggcaagaagagcaaaactccatttcaaaaaaacaaaaaacaagattctgaatttcttctttgtgttatcttgaatttctttgcacttcctcggcacaactattttgatttctctgtctgaaaggtcacatatgtctgtcactctagggttggtcactggtgccttgtttaatttgtttggggaagtcatgttttcctggatggtcttgatgcttgtagatgttcatcagtgtctgggcatcgaagaggtgggtgttatagtcttcatagtctgggccttgtacctgtccttcttatgaaggctttccaagtattcaaggggacttgtgaattaagtctttggtcactgcagccatatctacattagggaacacctcaagccctgtggctcttgcagactcaatgagggtactacattggtggtgttgggtgagatccaggagaacttcctggattaccaggtgtagactcttgttctcttcccttactttcccccaggcaaatagagtctccctctctgtactgagctgcctcggagctgggggagtggtgatacatgcctcttcgtggcaccaccactggtactgcgctgggtgagatccaaagcaagcatagcattgggtcttgcccaaggcccacagggatcactgcatgactactgcctatgttccctcaaggtccaagggctctgcagtccgcaagtgatgaatcagtgaggcttgtgtccttcccttcagggcagtgagtttcccttgtctccgagtgggtccagagaagctgtctgggatgcagggcctggagtcaggaaccttaggaatctattatatgtggtgttctgttctgaggtggctgagctggcatccaagatacagaacaaagtccttcccatgcttctgtctcaagcagaaggaaggagtcttacccggagctacaagctgcatcacctggggttgcgggaggagtgatgcaagtactcccgtggctgccctagctggtgtctcactaggtcacgtgcaccccaagtccactggctctaagcccagcacagcacagaagcttgcccaggaattagagcccttatggcccaaaacttgcccttcagtttatttcagatcccagagcaccttatcccatggtggtggggcttgccagaactctggttctgaccgctgggatggaggcttcccttctgactagtgctggtctaaatgctccctctgtggatgctggctgagttctgcctggtgttgctttctgctgtgacagggcagcactaaattccagtgctacgtcccacaatcactcttttttctcccttccacaagcacataaattctctctccgcgccatgctgccagtgccagggattaggggaaggatggtgtaggcaattcaagactatctttcttatcctctttagtgcctctttccttaatatgatgttaaaaccaagtactatgattgctcacctaatttttggttcttaggaaggtgattttttgtgtggatagatttggcgttcctgcttgggggacgatctctggaggcttctatttgctcatctttctcctaattgtggaattttaaacacataaaacatacgacaacaaaagtgcaaaagatgcagtgggagggaagtggaagtttggtgttttaatattgtaaggatattaagttatccatgaaatatataatattgattggaggtagactgtaaaccttcccacaaccattgaaacaaataaagttatttagcataccaatagataagaacaaatagaatttttaaaaagtaattgtatcaaaagaaggtgaaaaaggagggtaaaagaacaaatgagacaagtatgaaacaagtagcaggaagatagacttaattgcagcctaataagtaactgtactaaatgtgaaagtactacagatttgaactaaaagacaaaattgttagactggatgaaaaagcatggtacaactatctgctatctataaaaagtccattttaaatataaaggtggagatagtttaaaaggatgacaaaagatataccatgcaagcactaatcctaaagctggagtagctatattactataagaaaaattagactacagacagataataataccagagataaaacgtgacattttataataggattaatacatgaagtaaatatagtagtatatctgtgcatttaatagcagagctgcaaataacatgaaatataagcttacaggattgatgaggagtagctgtatcaagaaatacagttagatatttctgcatagtcctctcagtaattgatacaaaaaaataggaaattaacatgatgcttcatagttgaacagtactaccaatctttacctaatagaaatatttaaaatactacacacaaactatagaaaatacacattgtttttaagtacggataaaacattcatgaaactaatgtaagaatgagcaaaaaaggaaataagaaatcctaagtagatgaacgtaagaactcaaactagatgattctagttctagaaagttcctagcaagaactagaaaagtcatagcaagtttttctttataaattccaagctaaatcagtttttacaatgaatgtggataacttaagctaccctattttaacatacaagagtgtcagtttagatttcaaaaaaaagcaaaccgcagttcacctatatgccctttacaagagaccatttacaacaaagtggcatacaaagaaagaaagagttgcaatattaacaggcaaaattgaattcagggtgtaagtcaataaaaggtcaaagggaaatgttttatattgataaaagtcatgcttaagtaggtcttaggtaaaaatcctgaaagatataaaaaatcatttaaaaaaatcaaacattccattgcatcaagagaggaaacactatagccaaagcatacaaagaaaaatcttacttgaatttactacataaaccagttagagaagagtaccatgacactatgttggaatattgaaaatctacagcaaacataatacttaatgatgaaacattagaaaccttttcattacagttcaaaacaatatatgcatagttactgtcacatctgtttaccttggagcttctagccattgtaatgaattgagtcataaatattgaaaagaattaataaaacttattaattttaaatgtctgtaccaaaaacaaaaaaggcaagcaattaacaaactaatagaactaaaatagagttgttacttggccagattcaaaattaacatactaaaattagtacctcttctgtataccagaaatatctaattataacaatgaaaagtaaaagactttattataatagtcacaggattgtttcctagaaataaatttgataatatacgtggaaaattatataatgaaacttataaaaatttattgaaaattctaaaagatctgactaaataggcatactctgttcatagactgaaaaattcactagtgtaacaggttaatctgtaaataactccaactttaatcaaaattctcatggaatcatttcattaaatatgtatctaagaagtatatgagagaggactcatacttctgaacatctccataattagcactctggcccaaggtggcatcatctgtgcctggtttatcacattaacctctgaacttttccattttcacacttgccctctccaccaccatccacccaagccctgcagcctaaactgaacactcagagtgatcctttaatagattacttagttcaattctttcgatgaatttaaaagaggatattgtttagaaagactaagtaattgaatcaaggtcaaaaaatttgtaagaagtagagccatgatttgtatccaacatttctgattctagaccctattctcttcaacactagactatactgtattttattagctctttctgtgttgagattattttattatttttaaagaatgctcgtagacgtctggcatatatgatgatagatgacacttatctgaaatatgtagcttggcctcataaaaaatatgctttaatttcatttatagacacatagctgacctaggatgaaaaattgtcttgacccattgtgacatttcttatatttatatggtaatgaagaaaaatcaaaattttaactaatctgtttttcataaggatattatcgtcttttcttcttgggcttttaggcttaacgcctttttttctcctgtggcacatttgattgcactcttaactgcggtgctaaaataaaactcaattttagtgatcacagaatctgatgttgaaatagtctatttctggaaatgctgggtttatggtaatgatgaaagttgtatcatgttgttatggcaaccaaaatcctaaagtacagattaatgacaagctcactgatttttggaagtaagcagttcatttcttatctcagttcagttttaaataattatttagaatacagtaaatttctttgaacatattttaaaatgagaataatatctccatttagttacatatctagagattctcttcttcaaaggatcacagctcctcgccagcaatggaacaaagctggatagagaatgactttgacaagctgacagaagtaggcttcagaaagtcgataataacaaacttctctgagctaaaggaggatgttcgaacccattgcaaggaagctaaaaaccttgaaaaaagattagatgaatgtctaactagaattaacagtgtagagaagaccttaaatgacctgatggagctgaaaaccatggcacgagaactatgtgacgcatgcacaagcttcaatagtcgatttgatcaagtggaagaaagggtatcagtgattgaagatcaaattaatgaaatcaagaagagaagtttagagaaaaaagagtaaaaagaaacaaacaaagcctccaagaaatatgggactatgtgaaaagaccaaatctacgtttgattggtgtacctgaaagtgacagggagagtggaaccaagttggaaaacactcttcaggatgttatccaggagaacttccccaacctagcaaggcaggccaacattcaaattcaggaaatgcaaagaacaccaccaagatactcctcgagaaaagcaaccccaagacatataattgtcagattcaccaagattgaaatgaaggaaaaaatgttaagagcagccagagagaaaggtcgggttacccacaaagggaagcccatcagactaaccgcatatctgtcagcagaaactctacaagccagaagacagtggggtcaatattcaacattcttaaataaaagaattttcaacctagaatttcatatccagacaaactaagcttcataagtgaaggagaaataaaatcctttacagacaagcaaatgctgagagattttgttactaccaggcctgccttataagagctcctgaaggaagcactaaacatggaaaggaacagccggtaccagccactgcaaaaacatgccgaactgtaaagaccattgatgctgggaagaaacagcatcaactaacgggcaaaataaccagctaacatcataatgacaggatcagattcacacataacaatattaaccttaaatgtaaatgggctaaatgccccaattaaaagacacagactggcaaattggataaagagtcaagacacatcagtgtgctgtattcaggagacccatctcacatgcagagacacacataggctcaaaataaagggatggaggaagatctaccaagcaaatggaaaacaaaaaaaggcaggggttgcaatcctagtctctgatagaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagaggcttagactcccacacaataataatgggagattttaacaccccactgtcaacattagacagatcaacgagacagaaagttaacaaggatatccaggacttgaactcacctctacagcaagcagacctaatagacatctacagaactctccaccccaaatcaacagaatatacattcttctcagcaccacatcgcacttattccaaaattgaccacatagttcgaagtaaagcactcctcagcaaatataaaagaacagaaatcacaacaaactgtctctcagaccacagtgcaatcaaactagaactcaggattaagaaactcactcaaaactgcacaactacatggaaactgaacaacctgctcctgaatgactactgggtacataacgaaatcaaggcagaaataaagatgttctctgaaactaatgagaacaaagacacaacataccagaatctctgggacacatttaaagcagtgtgtgagggaaatttatagcactaaatgcccaaaagagaaagcaggaaagatctaaaatcgacaccctaacatcacaattaaaagaactagagaagcaagagcaaacaaattgaaaagctagcagaaggcaagaaatgactaagatcagagcagaactgaaggacatagagacacaaaaaacccttaaaaaaatcaatgaatccaggagctggttttttgaaaggatcaacaaaattgatagacggctagcaagactaataaagaagaaaagagagaagaatcaaatagatgcaataaaaaatgataaagggaatatcaccactgataccacagacatacaaactaccatcagagaatactataaacacctctatgcaaataatctagaaaacctagaagaaatggataaattccttgacacatacaccctcccaagactaaaccaagaagaagttgaatctctgaatagaccaataacaggctctgaaattgaggcaataattaatagcctaccaaccaaaaaaaagtccaggaccagatggattcacaggtgaattctaccagaggtacaaagaggagctggtaccatccattctgaaacttccaatcaatagaaaaagagggaatcctccctaactcatgttatgaggccagcatcatcctgataccaaagcctggcagagacacaacaaaaaaagagaattttagaccaatatccctgatgaacatcgatgcaaaaatcctcaataaaatactggcaaactgaatccagcagcacatcaaaaaacttacccaccaagatcaaattggcttcatccctgggatgcaaggctggtttaacctatgcaaatcaataaacataacctatcatataaacagaaccagtgacaaaaaccacatgattatctcaataaacgcagaaagggccttcgacaaaattccacagcccttcatgctaaaaactctcaataaactaggtattgatggaatgtgtcttaaaataataagagctatttatgacaaacccacagccaatatcatactgaacaggcaaaaactggaagcattccctttgaaaactggcacaagacagggatgccctctctcaccactcctattcaacatagtgttggaagttctggccagggcaatcaggcaagagagagaaataaaggatatttaattaggaaaagaggaagtcaaatcatccctgtttgcagatgacatgattgcatatttagaaaaccccattttcccagcccaaaatctccttacgctgacaagcaacttcagcaaagtctcaggatacaaaatcaatgtgcaaaaatcacaagcattcctatacaccaataacagacaaacagagagccaaatcatgagtgaactcccattcacaattgctacaaagagaataaaataacctaggaatccaacttacaagggatgtgaaggacctcttcaaggagaactacaaaccactgctcaacaaaataaaagaggacacaaacaaatggaagaacatttcatgctcatagatgggaagaatcagtattgtgaaaatggccatactacccaagataatttggagattcaatgccatccccatcaaggtaccaatgactttcgaattggaaaaaaaactactttaaagttcatatggaaccaaaaaagagcccacattgccaagacaatcctaagccaaaagaacaaagctggaggcatcacgctacctgacttcaaactatactacaaggctacagtaaccaaaacatcatggtactggtatcaaaacagagatatagaccaatggaacagaacagaggcctcagaaataacaccacacatctacaaccatctgatctttgacaaacctgacaaggggtaaggattccctatttaataaatggtactgggaaaactggctagccaaatgtagaaagctgaacctggatcccttccttacaccttatacaaaaattatttcaagatggattaaagacttaaacgttagacctaaaaccataaaaaccctagaagaaaacttagccaataccattcagggcataggcatgggcaaggacttcatgacgaaaacaccaaaagcaatggcaacaaaagccaaagtaggaaaataggatctaattaaactaaagagcttctgcacagcaaaagaaactaccatcagagtgaacaggcaacctacagaatgggaaaaaatgtttgcaatctacccatctgacaaagggctaatatccagaatctacaaagaacttaaacaaatttacaagaaaaaaaaccatcaaaaagtgggcaaaggatatgaacagatacttctcaaaagaagacatttatgcagccaacagacacatgaaaaaatgctcatcatcactcactggtcatcagagaaatgcaaatcaaaaccacaatgagataccatctcacgccagttagaatagtgatcattaaaaagtcaggaaacaacggatgctggagaggatgtggagaaataggaatgctttttcactgttggtgggagtgtaaactagttcaaccattgtggaagacagtgtggcaaatcctcaaggatctagaactagttttttgacccggtgaatccattactgggtatatacccaaaggattataaatcatgctactataaagacacatgcacacgtatgtttattgaggcactattcacaatagcaaagacttggaaccaacccaaatgtccatcaatgatagactggattaagaaaatgtggcacatatacaccatagaatactatgcagccataaaaaaggatgagttcatgtcctttgtagggacatggatactgctggaaaccatcattctaagcacactgtcccaaggacagaaaaccaaacaccacgtgttctcactcataggtgggaactgaacaatgagaacacttgaacacagggcggggaacatcacaccctggggcctgtcatggggtggggagtaggggagggatagcattaggagaaatacctaatgtaaatgatgagtaaatggggtgcagcaaaccaacatggcacgtgtatacctatgtaacgaactggcatgttgtgcacatgtaccctagaacttaaagtatcattaaaaaaaaaaaaagttacttccccctttcaactggtctttttgcatatcttttggtgttgtgaaaagcaagaggacagaaacagtcctgaaagtacttcccgtcagctatggactaggctgtgattgatcaaaatagtaagtaagtaaaatcaagtgcatgcccatgctagaaccagtgttcagcatgcactgctaacaacaacaacaaaaaaattcactgttttcactgcctgtacatagggtgtttagttgataaggacattcccaactttcagaagcatatgactgaactgagatgatttgttggtcattttggatttagtcatagaatccttgaaacttttacattttggacattgattatttgttactataatgattcattattgtttgagactgtgtatttcatatgtgatattagtaattagtgaataatttgggctaagaccaggcagacaatatagacagatagatcagttgattgatagacagatacttaatatactttttaagataaaggatgaatttacatagtaattattactgtaaataaaaatatagtaaactggcaagagaataaaatggttttaacactatagaaacattcatttatatacaaataactgatacgcttttataaatcatattttgggaaacttagttccctaaaataatgtatgtgtatgtatatgtgatgtatttattcatgtaggtagtttttttaaaacaataactcattaaaatactcttaactctcagtggaataatatagcttaaaagcttaaagtaccttataaagattaaccagttcaatatttggtttatagtggagaaagcagtcttggagaggttaaattacttgttcaaggcaacaataagtggcagagcttcaactagaatgtaagccttctaacagtaatttactcgtctataccattttatctgtactgtaccatatagaactgattagaaaatacttaataaaagtgagtgtaggaacctgttgctttggtagtgataaatgaactcatatttgttcagaaatgtggaatcacactgtcagccagagttcttggtctttataatttaagtttgactcagactcgcttcagagaatctcccttttcattttatttctatcctgttggctttagcaggcagttagcaggccaggaggagcagttccttattctttgctttttttccttcctccttcattcatgtaatacatgaagatttctttttatccagcggctttgctttcttcatcttctccaccatatgcatattctttttttaaccccttccatatctcagtggctttttaagctgaggcggagattgaagacatactataccatctaacaccaaaatttaaaatgaattttaaacactcgtttagttttaactggcttgattttatttaattatctgtgtttatgtggtactgctttattttatctattgcagacttacagtggattttcagctgtattgttagttacagacattcgtgagctaatttatatagcttagaaacaaatgtgtcaagttacaactaaatttcagtaaattttaaattttttatcactgttacttgaaaatgaaatttaaatttcactactttagaagtttcaacaatactacatttacaagttaaatactacatttacaagttactctgaacttttaaaaatcatattcaatatttataattgtacattattcttattttatactttttatgagaaggaatagccttatttttgtgtactccttatatacgatcaaatatatgctgtattgagattgagtatagacttgagtatgaggcatgagtaatgaatgctttacacacttctcagaaatctatgttattgcgcttagaaaagaactaagaacactgtttctaaaatccagtatctgacttgttgcaaaagtggatatcaaatgtatgttatatctaacaaagttttaaaatactagtttctagtagtttttaatgaaaaataatttttgcattattttgttacattcattgtcaagcaaatttaattacaggaaagaccactaatcaatagatcaaaaaatatctccaggctgggcacagtggctcatgcctgtaatcccagcactttgggaggccacagtgggcggatcacctgaggtcaggattttgagaccagccttgccaacatgatgaaaccccgtctctactaaaaatacaaaaattaggcaggcatggtggtgcatgcctgtaatcccagctactcgggaggctgaggcaggagaatcacttgaaccgggaaggcagaggttgcagtgagccaagatcatgccactgcactccagcctgggtgacaaagaagtgagactgtctcgaaaaagaaaaaaaaaaaatccccaagcctcatttagttaagcagttttctaaaccagtttctaccatcatcccttccctttcagcagaaaggtagtacaaccagtagcaccagtctactctgctcagaaaatttactcagcatgtctttcttctactcactgtcattttggaagctttagcaatttttggaaaatgtcaagttactccaactcgtcaagagtttggaccccattagaacagtgtacagatgttccaagatcttaagtggacttctttccttattccatccaactattttcttttctagaccacagatgcatatatttccacagatagtcttaaaaatgtattattctatccattattatcaaaaaagaacataattcctagaaaaacaaagaatgtgttctgttgatgatgacttcatgacattgacctgtgtgacaacttaacacaatattactattactgctataactattacgttaatctagctagtcacagtcatgtactcttgactatgtgaagaaacagttttcctgaaatagccactgattcagcatttatggaaaacagtggtggctcaagagcccagaataggactctgtaaataaggaaaaagttctttttctccatcaagcattcagtgaacatgtatttattgagcatccatcatattcaaaatatactgggttttaagggacatgtgaacataaacagtgtcaagttagttgaaattttgtaggacaggtaagacatgaacaacatgtatttctgtaattctaaacaattttttaagtacattttggaaattgggttatattgcagtcatatccatttgatgcagaactaaccccttcctaatacaaagctgttgggatctgaacatcaagaaaatgtagaagctttattgtaagttaggagtggtaaaagctatatgaaaggaacagaaaaagtgccatggacattccacaaaggaagtaattatttctagctctaaagatcagacaagacttcatggataagagagaacatttttgttgaacattaagagcatttacaagtggtgaaagaggcactctaggaaaatgaagtaggagcaaaggaactgagatcagcaaaccagagcccagagaacagtcaagggttgcactggaattagaatagtgatagggaaagtgttagataatttttgaatggtagaaggaatttgggcttctctgaaaccaaaagaggctactgaagctctttgaaagccccaggtaagagagagatgtgatagaaagtatgcctcagcaagattgatctaacaacagtgcctaggatggattgaatattgaagagactgaaagagggaagaatagataggagtttgtgtgtactccaggcaagaggtcattttagaacctgagctgaagtgatacaacattgttatgccattaacagaagtaggaaactacaagaaaaggaggtgtggaagcaaagctttaaacacacatttttattttagtttttgtaaaaatcagaaaattagtaccagtgttctcatggccagtaccatgagtaccatgagaaccatgagtaccgttagtaccatcttctcatggtgatacatgaatagtatgagtagctagggatgacaggaagttaatgtcatggaactatgcagagagttgttgcacatttaatgaaccaatactgttttttctagctggataattttgtaaacatttgcaggactcattctttatgtgcttttgtagaaatgtatatttgtgagaaagctgtgatttgctgcaggcaagtgtcacattttagcttggggtgatatagagagatgaagagaaagctaggagatgtggttgttagtgtaaaagctgtaaggtgaaagagcagtttactttaagttttcctgagagataaaagtgttgataaattgaaacaattgtaagcatctttctttaatgtgttaccacttttgcaaaatcaatacattgacattgggtcacagtttttgtttcttatttagcagtcctgtatatcaggcacaaatatatagcagtccaatatatatcaggaacaaaacacagtccatgccctctgcaacctatatagtaatggagaaagatttaataaataatgaatacaaaattatattttatcccaaaattaggattaactgtgtagccatatagtgattattaaatagtgtatgtgtgatgataatgaaaatgaaatgtgttgattgaagtgtcaagctgtcttacaattcttagtaaatatatttttttcaaatgatgtgtttacattttgtttgcttatcaatagagagcagatcgtaaaacaatctacagaattagtctgcagagcctatggtgaagtgtatgcagccgtgatgaatccaatcaatgaatacaaagatccagagaacattcttcaccgatcgccgcagcaagtgcagacgcttctttcctgattatcttatttcattgtgttagcaaaatatgacctccctaaaacactgaaggttattttttattctttgaatttttactctataatttgatagttacagttttctttgtatcataagattgtaagtcccgataatttttttttttttggtctcagtaacagggaagtaagtaacatgttgacctgagctagtattgctgtgtatctactctaaatgagatgatctatttttttgctagccatctctccagctctgcagttttcactgtattcaggaagcataaagtagtatgaaaggtttgaagaatttttttttacaagactagttctaaattaacagcttataaaaaatttgtctaaatttaataattagtataaggatatgacctaataaatgtctccttacctaaagattcatttgctttcttttaatatgagtaggcatacttagtagcttttctgaacctagcctatgtctctgtccccaaaatagctgcccttaaagagttgttagcagagagaaaaataacagtgaatgtgctcctggtgtatatggcagtgaatctcctttctgttctactttagcatactatatatatttgactgtgtacattcttatgcaattttaagtatacactcagcaataattagaaaaaaaggagagagaaaagtgatttaaacagggtggattccactctgtgggagccttcgatggaactcaaggtggagctcagcctttccaatgagctctaagcatgtagatagcctgagctgtgtctaagcctggtgtttaaagatgggtatttgtcatacaatatgggtcctaaatccaaccaactacacattttatctggtgttcaaaccaaagaaacaatgatctactcaaacattggagaaaaaaactgccagaggaggagttgccaattggcagtgtgtcttatctccatgttgtaactggactctgactttagaccattacctattaggaagattaaaaatgactgtatttttaaaggaataaatcccagtgtgcctgatttgacattcttgtcagcaaaaaaaaacttaatttctagtaaatctataaaaatgggtaagtccctaaattacaaatgagaaaattgaagcacaaggaaaaaaataactagtttgaaatattttgaaaagtaataacataaaactagtatttgtagaagattatgtgttgtatataacaaattagtatttatagaatatgacctatttatctgaagtttataattgtttatacctaatacagttctttttggagtaagaatgattatataatcgttatccatttgggtataaatctgtatttttagttttttccctttgattagtatgtgttacatataaagacagaaaataaagtataaatcaagagcttaaattgtatataatttatttctacagagaaagaagattgataccttgctatgagtgaattcctttgttttatagggaaaatttattgtgctttttacctggttttttcaaataaaatattaaaatatt

SEQ ID NO: 1637 - DNA, 97002 bp, Homo sapiens; identical to SEQ ID NO: 1636
  source 1..97002: mol_type = genomic DNA

SEQ ID NO: 1638 - DNA, 5667 bp, Homo sapiens
  source 1..5667: mol_type = genomic DNA
aaaaagaagtttagattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggtgactgacccccggccctgaccgcagcatgctccttgggcagtgggcagtcccaagcccacccaaccagactgtgggccccgctcaccttccccttcccacaggttctacaagctgcacgagcggaggtgtgagcccattgccatgacagtgcctcgaaaggtgatgctcccccgccccaccctgggctccaggctgggcactgactttgcggtcttgtggggggtgtcctggcataagcgctttcctcactatccctggccttgcccacagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 1639 - DNA, 5667 bp, Homo sapiens; identical to SEQ ID NO: 1638
  source 1..5667: mol_type = genomic DNA

SEQ ID NO: 1640 - DNA, 35596 bp, Homo sapiens
  source 1..35596: mol_type = genomic DNA
atttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcggtgagctgggagggggagcacggaggtggggacgcgtcccgggcagggaaagtttctgtgccgcgatgcaaagcagggggccaaaagcgagacggtgggggcagtgctcgacgcgtgtccgcctcccgctagctttgagggaccactgcaataaaccgcctggtcctgattgtccccactggcccctccgggagctgggacctccagaattggaggctgcgccacagaggggcgctgtctggtcggcccggtgtggctggcggcgtgcgggtgctcgcggtctcctgccgggctccccgcccccaggattctgcaggtgctcatcgctctctggccggcggtcagcgctaccgctcgccacgggaaacctacccactgcatgaggcaccagctagccacgtgaggctgtttctgtacacccgaaccgcgctcttgcccagcaaaagcggcagaacctcggctcccttccctaaataagagtaagacctggttcccaagcatgggtctcagattttctgaactctaatgtgatattggtagagatcctaaacattaaccatccgtagttatttttgagacatggattaaaactattgttttcttcttgttattaacctactgtaatggtgtggacgtccgcaaaggtctcattcaccgtttattatatctttttttcctccagattggcttgattttaaagaaagattataattaagattagcgtctcttggctacaggatgggtctaagtttctaattatctccacggtaccgtgcattcctagtttataagacgtttactgtgtgcagacctcaataactgggtgacttttggcaagtcatttagctccctgatcttcagtttcttcatctgtaaaatgaaactagtgattaactggccttccacctcactgagctgccctgagcacagatgaaactaagcaaagaaagttggatgttagtcgttactactaaatatcagtaataagcctcctgtacagacttgattttatggagccagcatttaagctaacaagctgggtgtccaattgtttctatggacatccagcttattgaggtgtctggaatacagcacatattagtttattacaactttttgctttcctgacattttactgtctcctgacccttaaacctttctccagaccattatcttcatctcttttctttttctgcatattaactccctttgaacaaatgtatattcacactttttctaagagcagagtacgtccctgacttctcacctatttctaaatttcaaagaggatattatcaactgaaaatcaaattcttcaccagtcctgccaattcagggccacagcagcagcatcatgtaggtcacttaactggagccccatgaaataccaggtctacctatcagccattcaagctactgtgcttctgttgtttgtccatttctcatttttgtaccagtattcccatcctaagcattataattacctgtgtaacaacctcatctcttttaagagattttggttcttatgattggaaaggttaaagagtgacctataggtcactttccaattatgaaaacaaaaaattaagaaatatatatattttcattatttcactccattgttcaaaaatctaaaaggcctccagtggaagaaaatctggtgtcttcagcctttctagccctttggaatgggatctcaccgaagctcacaccccctgatttctccagctgcctgtcttgtatgcgctgctcatggtcttccccacctgtctcccatggctcatgctttgcccactctccactgctaacttttactgctactgcatgctctccacacatcatctcttggccagttcctgcacttgagtgtgcttaataaaatactaaagtacctttataaaatgtaggttcctggttccacctccccctccagaggttcataggtttggagttagcacaggaaagctgaggtttaacaatcactctagaagattctgcaacaagtatctatagggcacactgctataagcaaagtcaatggaagcaaatttcctttttagtgttttcctatttttccttttgtctatttgcataaacagtttcaaatttcctacacttctagattttactcaagccttcagtggccacctaactttatcctatgctgagaaaacaaaaccatgaaacaagaatgctcccattttctaatcggctacaaacctaccaacttacaaacttacctccatctagaatcagattttgttctccactgcagaaaacctgctgaggccttcccgtcacattagaataaaacccataccccttattctccagtctgaggccttctgcctctccctgaaattctctgtaccccactcactctctctgccccagccacactggccttctctttattctttgagcacaattgcactaggtattctctcttttgaaatgctcttcctacaaattattctttgcctgtctccttgacattcaaggctcagccctctgttgtgcttctctgactcttgtctgaagtatccatattccagggtactctccaatacaaaactgtgttctattttctacagaccacctatcaccatctaaaaccttcttccttatttatgtacctgtttgttgtttgttccctcactggaatacaagttccatgagtgcaagaccttaatctgccttatttcctgatttgagttcctatcaatagcctgtaatttggaattcaataaatatgaattgaaatcttggtatgtttcctcctataacaatgaaagaagtatccattctgctgacaaattcagctccttttcctgtattcatgatcatgttccataccctcttgcctttgcaaggactttacttctgcagatatctcctaccttgcatcatcaatgtacctctttctgtatgatcatccccaccagcatttaagtataccccaggaaatcctttatggaccttctcatgacccactggaactccattttcctgtccctcttcttgttcttctcagcaaaacttttcattgactacttactcaaatttcgttatctccttctccacttcagacaggcttcttccccacagtctcctgaagctgtttcttgcaatgtcgctactgacccttatgctgataaatccaatggtcatttttctatgttaatctttctcagtctttcagcaaaaactgatgacttcctttaccttgaaaccattatcattctcatcttccaaaccaagacactcttacctgttttttccatacttccctgttgtctcttagtcttttttgttctatctctaaatattagagggtcttggggctcagccctgagcctcttctttcttcatttcttcttcctaaaaaacctcaactcatcttgtctcatggctttgaatactatttatatgttgatgactcatatttattatctatagttctgtcctctctcctgagctgcaaactgcctacttggcatcttgatgtggatgcctagtgtgttagatataccaagtctgaatggaaatgattctgaacacaattccctacctcaaggccacaacacacacacacacacacacacacacacacacacacacactcctttttcaggctttccatcctcagaacagggtaattctatcaattgtgtagcccaagtcagaagtctagaagtcaggaatcctcccatttcctcagccccacatgtaaaacaacaaaaaatcttgccaattctatttctaaaatatatccactgctcaatcctttgccaagcttcatttttttttttttggccctaaactgtactctttgcttctaaaagtaagcagttcgatccactctctacccaattgccagaatattcctttaaaaatgtaagtcaggccttgtgattctcctgcttgaactctccaatgacttctattcaggataatattcacatatctgtggtctaaaaagcccttcatgatccctcctgctgagttttctgacttgatcgtggaccattctgctttgctcattgcatcccagccacacttgccttctgtctgtccctggagcataccaaatccattcctcctgttaggcctctgcctaaaatacttgtacccagcaatttgcctggctgcttccttcttccttcttgtccttcagtcacaacttaaatgttgccttttcacaggccttccttaaccatcataactgaagttgcatgccaccctgtcccttctccttccagtgcattacattgtgacatatcactctatttcatatttcatgttcagcaccttcttatttatttcctggtatctatttacagtctgtctctttctgttggattataaattctatgagggtgggaaccttgtctctgatgttcacagatacatctcctgtgcttaggactgaactttggttaatatgcataactgttgttaaactaaataacaaacagggaaagaccctaaaaaaaaaagatatttgtttgggaatagaacattgcaatgggaatatgtgtgtgattatgaattgtgtgtatattcaaggaagtaaaagaagacaaaggtttttaaaggaaaaatatgaggattacataattgttttagaataattatccttggctacaaagaccaataacaaggatgatgccagtttgaggttatacaggcagatgccggaaggatgttcttgtagggttgcagtggcttttgtgcacggttgtggtttttcagtcttttatgatagtttgggttaacaggtatacaagcatgagaaccctattttcatggccttccctggctttctgaaggtgttttttgttgtttttttttttattacattagtgactctattttgattctgacaactttcacatcatcattcaaaacttgcttatcaaataggcaggaaacccagtattaaggtatttgattatatgaattatcagtctcaataatgattttccctcctacctgctttctgactaaaatttcagttttatttttattatcctatatgtttgtttttcatccatttcaaatggatttccaagccattccaggtaaagtccctgggcccaagtaattaaatatatctctgttcatttaactcagaaactgcttcgcctgttagttttaaacatggttggaaggatatgtgtctgaatgtcaagtcaccatctttgatcttcaatccagtcatgatctcctctgagttttactcctggctacagaaagatgtgaagagggtccagtgaccctcaagaaaatttgtattacttgatggcccatggcttaaccttcccttttctgatatgatctgccttgtgacttgggattctggctttcgttactaatgaggattgatgttcccaaaggaagatagcccttaagtctccttattggaaatgagaccctcccattttttatcatccagaaagtgtgatccgtatctcctttcatcatggaaagttatgctgtgaagcacccttctgcttttgctatttctggatcttcattccatcttcgtccatgtcattgccactgattaaatcgtgtaaatttaaattggttttccagcttgtggaggataatttgatattgtccttatttacatttgataattacagattaagtcacttgactagagtcactagtacaagtagtatcaggatcatgaagtttgtcttcattgaggtcaaaccctgatattccttatagaatcttgctattttgcacagagtaagcacttggagacttttgtagttgttaatggagaaaactaaagaaactgaggaaataaatagaaggggacctatagtgatatctggctcccaataatgatgcctattcttagaaccagtctttgtgacttctccagtagtagtttggggtcacagctaaggtctggctgtgttttgggagctttgtgtgtgaccttgtgtcagttcatccatgtttatactttgactttcacccgtacctgtctcagacctgtttgaaaaaggagattataaatttgatatttaaatacactgctattctaggagggccttacaactgagtactttctttttttgcctggactaccatctgatctggaagaagagttaacttcttgttttctgcttgtcagtttagggcgttgaaacttgagctcgttctcatacatagaaaaatgacttttccagctatatccctaagtgtatcattgctatagtttcttacctatctcctagaataacttctgttccattattaataataatattgttactttaagtcacaggaatctgtgttgaaatgactgtccctttatctagttcccatcagaaagtatttactgagttctctttggtggcatattactctactagattaacagaataaaataatgaagaataatcaacatattttctcctctctaggcattaacggtttaatagctaagatagttatgtaaattcattaaagtaattttcaggatcatatgtgtactgagcttttacaagatctcttatatactttagtttcttatgctatcctgggaaagtttgtatttaaagatttttacctttttgtcccacaaattcacaaatagcgtacattagttatgtgcagtttttttgtgtataaataagacctcattgaagctgggaaaaatattaatatccgctccccctaccacccttataaaaaaaaatcaaaacatatgtaatcatccttcaaggcccttgccacatgcctttcctgttttccccagactctgacctcactgtgaaaaaacaagcaaacaaactaaaaccactaatttttacttgtaagggtgaaggagatggaacaattctgaggattttctgaaattttatgaaaaattactttctccatctctgaagtctaccctaaaaattctctgaacctctgagcttatttctgtgtatattcacccttactgcaatgatatgcattcttcattccataaaatattgccctattttagactttcattctaaagatcaaagttttcaggataattggtaacaaggcagaagcagagaagaggttttagcctctcttggtttttatgtttctgtagcctttgtctcaggtcctcaggtcagggtaagtttctgccaaggtttccttttgctaagcctaaaattcagagtaaccaatcttaagtttgctgttgagatatcttgcaaatacaaatgctttcttgggtatatcaagaggcattctttgtcacctccctagagatcttcaagtggtcagatgctcagcagttctgtaaaggtgagtaatcctgtaatagaggcatatttgggtctgtcgctgtatctggatgagataacatgttatgtttaagataaaagaccagtaaattcacatgtcatctcaagtgaagagggctcctgagtgctccatgcttccttttactcctaggggcactgggtatgagggttaagtcatgatagctggccaaacctattcatcctgtgatctttatgactttgatctatggtatccatactgtgttagggtgaggttagaagttagagacaagagatgttaatattacctcatcctcatcccattcaattcaaaaaatacttttaagtaactactagatactaagctctagaccagacagtggggcctgggagtgacataaaaatgaatctgatagtctttgcctttgagaaactcctacactagttgtaaaggccaactcttaaatatatattgtactatgaggtagttctcttatttaagaagtgctatgaggtcatagagaaataaatcataaatgctacctagaagaattagagaactataggccctctgagcagaggaaacagcatttgcaaaagcataagtgtgcaagaacatgatgtctctggaaaaaatcagtgttgttggagtataggctacatagtgaggaatggtagttgattaaatggattggagcttacttgtaaaaaaatatatgcattttttccctataaacagtggtaagtcatagtaagtttttaaatgtgcagagtggcatgaccacatttgtgttttagaaagataaatgtgcagtagtatagaaggtgtaccagcccaagggagaacaattagaaaagtaaattatgtcattcagtgatccaatgagagactactgcaatgacaaaatagttggtttggagagagatttctggagtccagtcactaaacttcagtaagtaattgaatgaagagaagagagtagaggatgagttagaggatgagttacaaaaaggaaatgatcactgtgagatttttaaggcagaagacttggtagatgatatcatagattaacagaatatgtataaaaatggaaaatgaagactataagttataactgaccacaaataaagttggcatccatgcacagaaatgcagactgtgtgcattaaacaagtagtgttctagagttgactgatccgttggaaagttttgtaaatgtaagaatttctgtgagtaaacataagcaggcctgtcagcaagtccagtcaggttgagatttaatataaaacacaaaaagtctccaaaaagtctcctgaatcccagcctcaaattctgtttgggttgatttggttttcttttgtagataaatcatgtgtgagtcatagagaactcctttaggactctgtgattacacacatgggtattgcatttgggttgacaatgacatattcttgtaataaagggtgagttggcaggagacagttcctgggtacatggataccagaacagcagttccaaccagaaaccatcactcttccaaaagagatctgagtaattgccacatactttttaaaataaataagcaaaaaggaatcacctccctgatccactccagagacactgcttcaagattaccagctagagaggatccctagaagagaaggaagttttggctgctctcttccagttttaagtctccagtgctactgaccaggagcttgaatttcatttggctttaaattgtatgagtccttaatctgtcacccctgcttgtcataaatgatattctattctctgctattctttcagtagagaaagaactaagtttttctaaaatgtaagtctagctgggagatgatcactctttatttttatttttattttaagttctggggtacatgtgcaggatgtgcagttttgttacagggtaaacgtgtgccgcgagatttcttatctctttgtctttagatatctactctttggtgactcatctgctacatgtattatctcagacaatattgtaacctgggataatgacatgccttttaatgaatgtaagtaaaacaatctctttattgcaccctatttaattcctcttgtccccttccagagggaaattgagcatctgcacaccaaagtgagtagccaggagggtttacacttggtttgagtagctctaggcacacagctatgacttacccatcttcctcatggcccccaatcctaccacacgttcctttgtttactgtcctttgattataagttatttcatagtgagtaaatgcttacatctaaaacattccaggagattacacactgccaactttattccatgcaaaaagtaagccaccctaggtcccttctataacaatttatctgtggtctggggcggggactggtgaccagctcatagcttttcggtttttatcagccagttccatatatcttttgaccttgctacttcctatttagaatcatctttgagatcaggatacagaatttcaacaaaataggtaaattgtaggctgagttgcagtttggattgcaagaatgaagagaaaattctcagaaagtataatattctctctttccccacctactccttaaaaaggtattccttgtaagtcactcccagccatcccccatgggactttgacagcagcagcagggagaggggtttgctatgaaatcatcagtgccatattggatgtaatagggaaaagctgtttgacctcttggatgagaagtcaatgcattgcaccagcaaagataatcaagttgatgtctggagctctggagcaaccctcctcttcagtgtattactcttacttgaatgctcaattatagaagttgaaaatggagttgtggaatctggattatgttcatttttttaaaatgatacatgatatttaagtgtaagcttggttttaccctgaaaggcagcaatgtaatatggtgtcaactaaacagcaaacagaatcctctactgccaaagtgcttcaggggtgagttgggctgaaacttcaggatctagaaataaaacaaggtttttctgggaaatagatatatggtacctatggaaagagcagaaggaagatagtatatgtggttgagttttctagttaaagagttttttattgttattgtttgttttgtgtttctgtttttgtttttttgagatggagtctcgctcagtcgcccaggctggagtgcaatggcgtgatcttggctcactgcaacctccacctcctgggttcaagcgattctcctgtctcagcctcccgagtagctgggattacaggcatccaacatcatgcctggctaatttttgtatttttgtagagatggggtttcaccatgttgaccaggctggtcttgaactcctgacctcaggtgatccacctgcctcagcctcccaaagtgctgggattacagacgtgaaccaccacaccctgcctagttaaagagtttaaaagtaaactttgaaagtaatatctaaatgttgcagatgtaggactttttcttcttttgtattttggggcagtgctagatctgtgttattgtaggggaaattaaaagatgcttttttaaaaaagcagatagcaccaaagtcaatgattagagattttttcatacatatatatatatataattatcacatcttatccataggtgtgctttgaacatatatatgccactcttctctgtcttctggaatgcagaccaaagatgttaaattgattcagttgagtatatattatactgcagattctatatgtataaagacaacagttctcgaaagttacccttactgaaaccaagtatagcactgatgtgatgaaacagtttggctgtatcttcttatgtcagttttcactgaagacctcctcttggagccaaagggaagttaactgaaagttctagaggttggcaattttccctttattctgagactccctcagaaaaggcgtgcataacaaagtaaatgtaaacaatatccttcatggttattaggacaagtaaatgaagaatatgaggccattattcaaaacctctgttcacttcctgtggctttttcaaagtgttccagcctcaagtcaggacaaatcacctgtactgaggctctagcatcttcagcagcaggaccaaaagtggtcatctcagcctgtacccccagttgtgtgtttgaagcagccattgaataattagtatgttccaggtattgtactttctctgttcatgtacttttagcactggattctcactataccttatgaagtagtttgcgttatactatagactaagaaactgaagcttaaagagagtaagacttgcctgaggtcacacagctattgaatgaccgtggggagttgaaactaggtccactgagctcaaatttccctaatccatggtacctccccacatgtaactatcatgccactaatatgttattttcatgtgctgaatttgccttttgtttcattattaaaattgattagactcagaacttttggatatattcttttcattattattgtttggtcaagatgatttatgttgatctgtttgctgaggatcaagaaaaaggtaagaatttaggagtttgggagtaagcagggaataaataaactatacatatttctaagtctgtttctgaaaaagttatgtgatctatatttggatattttacctacatttgaatattttctcaccatgatcagtatgcctaccaagttccttttctacttttcagggatttcttgtggctctcctccgcctatcctaaatggccggattagttattattctacccccattgctgttggtaccgtgataaggtacagttgttcaggtaccttccgcctcattggagaaaaaagtctattatgcataactaaagacaaagtggatggaacctgggataaacctgctcctaaatgtgaatatttcaataaatattcttcttgccctgagcccatagtaccaggaggatacaaaattagaggctctacaccctacagacatggtgattctgtgacatttgcctgtaaaaccaacttctccatgaacggaaacaagtctgtttggtgtcaagcaaataatatgtgggggccgacacgactaccaacctgtgtaagtggtgagtatgaaaagaaagctgggttgggaggttggggtcttgcctttctgtgcagaccacgttttgtaccctcctgaaggacaaacagtgtgaacatgtaatgatgagggtggaagaaggaaacaagggaaaaggtgaaagttatggcttcttcgtggaggcatataactgctcgttcaaaaaacatcaattgagcaaaggagtttaaagtacatggaaaaatgtaattaaacacacctaataattgagtagggtaagttttgcaaggatggggtcagagtttgttggggatgtgggaatggggtggttttcaactgtatatctgtgttactgttaaaatgagaagaacggtgggatcttatagcaaaaatacacccaatggatttgaaattaatgtataagtagctgctaacacagtctagcacaggtgatatcctgctctctgtggtctctgtaaacatgttttgaagttatccactatttccccaagtcatcttctgagccatcacatttcaaataaatgcctttgaaaatagggacctactgtaaattattcattccttctcttttggtttggtttatgttgctgctgaaatataaatctgaatttgaattccacaattacaagaaatggcaatatttgacaaaaattatactatcaaattaggtattttcttaataaagaacaatattgacaaattttaagcagattaaagagctgacaaaactgttaaattagtataaaatgggattctgtttattgattgattgattgataaatagccttggaggaaggagatcttaacgatagttacaaagggcaatggctgctgaaaacagttaagcctttgtaacaatttagacagacatatatgtatggacatggaaggatatcgtatacatgtcgctaagtagaggaagtaaggcatagaatatgtattagttgtacacacacacataatataggtgtatatatgtatcatgcataggatcccaataaactatattgccaatatctaccaggatagcccttgaaatgatagcatgctacttttggaacagagaataagcttaaggatagggtgagaatataggtgaaaattgactttttttggtaattgaaatttttcacaaggcaaatgtaattcatatagtgtaactaaaaatgaaaaataaggtactatttatggctatttgtggcataaaatggatacacttaaaccacacctgtttgatctttaaaagactaggttgaaagttaataccaactggctaccatagatcatgtgtcatttatttaaatccatatcctaagtcagcatctcgatcaagcttgtccaactcgctacccgtggacagcatgtggcccaggatggctttgaatgtggcccaacagaaattcataaactttcttaaaccattatgagattttttttttgcaatttttttagcttatcagctatcattagtgttagcgtatattatgtgtggcccaagacaatttttcttcttccaatgttgcccagggaagccaaaagattggacccccttgattctagattgtgaaggatgcatcatctgacggcttttttttcctggtatgtgtgtgtaaagttttccctctcgagtgtccagcacttcctatgatccacaatggacatcacacaagtgagaatgttggctccattgctccaggattgtctgtgacttacagctgtgaatctggttacttgcttgttggagaaaagatcattaactgtttgtcttcgggaaaatggagtgctgtcccccccacatgtgaaggtaccctaaatttacaatctattttaagaatctgggctgttctgttatttgccatgcatttctcatctttggtttgttttttagaggcacgctgtaaatctctaggacgatttcccaatgggaaggtaaaggagcctccaattctccgggttggtgtaactgcaaactttttctgtgatgaagggtgagtgtcaggattatttatgagatttaattcatttgtcttgtgtgtgcgtggtgtggactgtgaaacctgcagaagtctcctctgtgaggatctctgggcagtctggggtagggttgtgagaggtaatgctgataaaaggaacagatgcacactgattgaaatgaacttgtcttgaattgtaagtagaggctgctgttcttcagcacaaactgcctaatagttctgaatgacaaccttctgtctccaggtatcgactgcaaggcccaccttctagtcggtgtgtaattgctggacagggagttgcttggaccaaaatgccagtatgtgaaggtaggctaggcaactatggtctgacagcactgcattctcagcttaactaaaagcttttggttcagtcattaccttacagactcttactgaacacagaactcctagagatctttaaggatatgtgcttcaccaaagcatccttattttttgtttcctcaagtaaaatggggttcctaggctttccctcctctgaaagctatgcagaccttctaagtaggtagaccatatgcataaagaaaatagtgtatttggtaaaagaaatcaaaggatcagcagagtacatatactcaggaatgaagcttgagaatcaatcttctaaattatgttgctttagctgccttgactgattcattatagactcggatatcactgtcctaggatagtggtatcaagcagcatctggggcattctttgttttcaatacacctatgatcttgtcatttctttctgcaattcccctagaaattttttgcccatcacctccccctattctcaatggaagacatataggcaactcactagcaaatgtctcatatggaagcatagtcacttacacttgtgacccggacccagaggaaggagtgaacttcatccttattggagagagcactctccgttgtacagttgatagtcagaagactgggacctggagtggccctgccccacgctgtgaactttctacttctgcggttcagtgtccacatccccagatcctaagaggccgaatggtatctgggcagaaagatcgatatacctataacgacactgtgatatttgcttgcatgtttggcttcaccttgaagggcagcaagcaaatccgatgcaatgcccaaggcacatgggagccatctgcaccagtctgtgaaaagggtgagtgttccggtactcagaaaaggtgcttctgattcgtttctgaaaaattagaagaaggggttgtgggctttaggtagggccttgtccagtttatacttccctcaaatctactacatctaatcaatataaattttgtagagggcattcttatcactagccccccaccattgttttattttgtgggaatatgcttggaaaaaatgttaggaatcactaagtttctcatttctataggggaaaaaatgaggagaaaaatgcttgtttgtcttaatagtgacttcttaaaagagaagtcattcaagccctcattcctagggatatatcagaatctcccataaaaaacatacaagatgattccttatgaagggaagaggcaggagaggagttgcagaacccagtggaaagtgaacaacatctgcagcagcctctgtgcagaaaacaacaacaacaacaacaacaaaagattgggaaactgtgatctaaaattacccaaagctggtctgcaacatatgttctgtatcatacagctgacgccagagtggaattatagcatgaatatcaatttctttggctcagtttctttctgtggttgtttacttaagcagttatgttttgtttttgtcctttcatttagaatgccaggcccctcctaacatcctcaatgggcaaaaggaagatagacacatggtccgctttgaccctggaacatctataaaatatagctgtaaccctggctatgtgctggtgggagaagaatccatacagtgtacctctgagggggtgtggacaccccctgtaccccaatgcaaaggtgccaggcctcaaatgtagacattttgttaactttaagattgccttgaattaaattctcatcctagtctcttttcttagtggcagcgtgtgaagctacaggaaggcaactcttgacaaaaccccagcaccaatttgttagaccagatgtcaactcttcttgtggtgaagggtgagtgaaggctgacttagtctgacccaattccggtgtatcagcacacactgcaggctctatgtaagagtttgtatcagtacaccctgcaagctctatgtaagagtttgtctcataggtgcttgcctgtcacatggtcatggaagtgtctatcatactatttttccatgcatggaaattatgcctgtgcaatgagaagttggtgctgatgttggctacatttttgttgctattgcttcttggcctgaaagtagtgagtctgcttgggagccatggctcttgcctaacttaatggtcacctgatggcaaaatgacatacgtgactctgtctctaggtacaagttaagtgggagtgtttatcaggagtgtcaaggcacaattccttggtttatggagattcgtctttgtaaaggtgagtagcaaaaatgatataggagctgaaataatgtgagatctatacatttcctgggagatttttgttttgggacatgttatgagaattagagtattagattctgttctattgattctgccaatagttatggttgcacagttttaccatgtctttcttttgctacctttttcttcatcaataacttaaatctactttgttactgattctattttgtggtttacgattatgggaataatgacagcggtgagtatatgagccaccatcttaattttgggtataccacagtttagtggagagagtaagggataggtgtcagatctgaattcacattctgtctctactgcttactagtgtgagaccttggaccacttgtacaactcctctgaaactctagcctttcttctgtaaagttggcataagactacagactaggaggtccagagaatgtaaataaaaagtaaaaaggaccaggcacagtggctcacgcctataatcccagcacttcaggaggctgagggcggcagatcacaaggtcaggagatcaagaccatcctggctaacatggtaaaaccccatctctactaaaaatacaaaaaattagctgtgtgtggtggcatgcatctgtggtcctaactacttgggagactgaggcaggagaatcacttgaacccgggaggcggagattgcagtgagctgagatcacaccactgcactccagcctaggcaacagcgtgagactccatctcaaaaaaaaaagtaaaaagaaacgtagaaaatttaaaaaacactacagacttcaaattattcaaattaaattgtactattgctactttctggatgaggaaactgcctatcacaaagtaggtgctcattcaacaataagttttctcagctagccatataaaccatcatatcacctcagcacagagtaaccaagaaagcataattctattaccctgtgtcttttattctcctattgcctaattaaaaagaattcttcttttaattagcaatttactactgggcctaactaactcctaatgtgatgttgatcaaccacattcactttgaataaagattttctttcctatgaaatgtgtttaaattgcattttacatacttaatgagctttcacacaactcacatcatgaaaatgtacccataccgtccaggaaacaacagattcataaccagcttcatttggtggttctttgttctttggtgtctaatacaggaactcaattctacagtatcttttcatctctctagaaatcacctgcccaccaccccctgttatctacaatggggcacacaccgggagttccttagaagattttccatatggaaccacggtcacttacacatgtaaccctgggccagaaagaggagtggaattcagcctcattggagagagcaccatccgttgtacaagcaatgatcaagaaagaggcacctggagtggccctgctcccctgtgtaaactttccctccttgctgtccagtgctcacatgtccatattgcaaatggatacaagatatctggcaaggaagccccatatttctacaatgacactgtgacattcaagtgttatagtggatttactttgaagggcagtagtcagattcgttgcaaagctgataacacctgggatcctgaaataccagtttgtgaaaaaggtaaaaacccaataagggggaaaaaaggagagatttacttaattattcttgtttattatctcccacccaaaactgcatcatggaaagaggcaagaggggcacagattactttctgtttcttccatcctataatagatgttctctgtgttgtgtgtgtgcatgcaaatgcccccttggatctgggatctattcagggtagataatgagagagcctttttaaagagcaaacagcattcagtagtgaatttgagcttcatgatctttggcatcagagtttcagactgtctgtccaatgttgtacacttagtgttcttgagtagaaattcctctgtgttggtatttatgtagggagtttttctcttcaggctgccagtcacctcctgggctccaccatggtcgtcatacaggtggaaatacggtcttctttgtctctgggatgactgtagactacacttgtgaccctggctatttgcttgtgggaaacaaatccattcactgtatgccttcaggaaattggagtccttctgccccacggtgtgaaggtactttaagttccagagttgtccttctctttgatatgagacatctataaatactgtaattccatccttgcttctccagaaacatgccagcatgtgagacagagtcttcaagaacttccagctggttcacgtgtggagctagttaatacgtcctgccaagatgggtgagtatgaagtggtctattctgagaaaaggtctcaaccttgttttgtggattaacttgaccttcaacttgtcttggtggcatcctttagaggctcctcattgtcacaggcatggagaatatgaggttccaatggcctaaatagcaactctgactcttcagtcgtctcttgacatggaaagggctttgcttaactcaaaagtagtttttttacttggagtaaaaaaaagtagttttttactagaatttcaactcctctctgccaaagttcttatttagaagtccctttttgcatgcagtttgaagagatatgatattgggaacaggaaatgcattataatctgtctctctgtaggtaccagttgactggacatgcttatcagatgtgtcaagatgctgaaaatggaatttggttcaaaaagattccactttgtaaaggtaagttagaaaaaataaaagcctgacaatggtaatggaggattagagagggcaggccactgaagaattagtctactgctgcttcagcagtcttaggcgtctccctcattggaggttagataagaaaaatcttatggtgttggtcagtattgacactgagaaacaacattgtcaagtaggaactgtttttcatgcatctgctaattttgctaacaataacaaaatatatagcccatattcctaggtcatgggaacatagctgtatttctttcttccttcacactttactctattttctgaatttttatggagtatatagtactcctataatcacatttaataaagctgtttttaaaaaaagcataatccatattccaaaatttaagttattttctagttatgtgaaatatatgcagttgcatattgtcatttgtacctgaatgaagaccgctcaccttgaggtactagctgaagtagaactccctaaatctcttctgcagttattcactgtcaccctccaccagtgattgtcaatgggaagcacacaggcatgatggcagaaaactttctatatggaaatgaagtctcttatgaatgtgaccaaggattctatctcctgggagagaaaaaattgcagtgcagaagtgattctaaaggacatggatcttggagcgggccttccccacagtgcttacgatctcctcctgtgactcgctgccctaatccagaagtcaaacatgggtacaagctcaataaaacacattctgcatattcccacaatgacatagtgtatgttgactgcaatcctggcttcatcatgaatggtagtcgcgtgattaggtgtcatactgataacacatgggtgccaggtgtgccaacttgtatcaaaaaaggtaagatacttggaagggataagttatgggatgttgtacagaataaagaaaagaggttttgaatctgcacttgacattctgcctaaagaaaagcatctaagagctaaggcagttatattgttttacaagatatttgccttttcctatcttctcacttgattgtttgttttctctttcctttctcagtatattgagcaataaatagtacatgaaaggataatggctaacttccaaattgatagcatctccaaaaattgttattgttatgactttagtgtaagaaaaatgcacatacatttttggcaaatgtttggcagtaatattgctaattatttgatatttaaggctatgttgccagccagaaagagaactttgggtgttctggagaattaattggccctccaacccattgaattgtctttcttgtaattgtagttatcatttggcagccttattcctgtccatgactatctacagcagaggctgtttggcaacggttgtctttgaccagcacagtaatcttaagtgaaacccatcttcagtttaagataaatagtgagcttgcgagccacaagaccccctttgcttcccagcaaggcaccagtaacttgagctgagcagtggctgccacttttagaaggacaggggctctctgacttgtcgtatctggtggcttcacttcctagctctcgtagacatttgaaggtgtaaccatgtctgctatttaaagggaaaggaaaagaaaactgttggctgatggattaccattgtgaactgtatccattaatgtttcattatcttattttttaacacttttcttcaaatcatattggctatcagtaggaaatgcagatctccatccagtgttgctggtctgggtggaatgaatgaatgtttttggataccagttagttggcttgttgcttctggccttcctgtatcgctatcacccagagatagtgcaggctatgtgttcctctgtgctgagttaaagaccctttcttattggtgtctaagccttcatagggtgtccacctccgcctaagacccctaacgggaaccatactggtggaaacatagctcgattttctcctggaatgtcaatcctgtacagctgtgaccaaggctacctgctggtgggagaggcactccttctttgcacacatgagggaacctggagccaacctgcccctcattgtaaaggtgctttgtctattttttattcttatttttatatcaaatttgtgccaaatagatatattcagttgggtactttcaacttaaaatagccaaagaaatgaattaactgtctgattacattaaaggctttaattagattaatacaatcattaaatatctcaaaataagaaaaaatgtctcaggctgtagtctatctggtgaatgaccacttatgtagtcatttacacatagaaagttggagttatgtctgtaaattaaacaaccaaagcacagattgtatttacacactgtagttacagttatgttaagtgtgtatttgataaagtaccaataaaaagcacagcaatcttttgagaatatttactgagtgttggtgggattatgggtacatttttaataaaagtttcagaaagtcattttcattgtcataaacagtgcatatgaaatatgactagtaaattagtgtctagtattcattgaacactttttactctatgccagacactgtgcacagcacctgacatgcattatttcatttagtcttcatgagagccacatgaggttggtgccatgattatccctgttttatagatgaggtttcagtagcatggagagatttggaacttacccaaagtcacacatctaggaagtactagagccaggcttcaaatccaagatctcactgtgttaatccattctcacactgctaataaagacatatctgaaactgggtaatttataaaggaaagagatttaatggactcacagtttcacatggctggggaagcctcacaatcatggcagaaggtgaaggaggagcaaaggcacatcttacatgatggcaggcaagagagcgtgtgcaggagaactgtcctttataaaccatcagatctcatgagacttatttactatcacaaaaacaacacaggaaaccccacccccatgatccaatgacctctcaccaggtccctcccatggcgcatggggattatgggagctacaattcaacatgagatttgagtggggacacagccaaaccatatcactcacactattgatgactacactgaaaagaagaaagaaatgagaaagcacgcacatgtatgaagaattagagagtaaaactagaagcagaaaataacagtaattcagaatacttcataatattaccaattcggccctcaccatttctccaagaagccattaaaattatccatcactgtttggatagaaactgaagcaaaaaacacaaatataatctggcttaaattacccagaggttattgagatagagggctgacagtaaaagattgtgtctaggatatagtcttatcctatttcagtgcagctttccttactgagagtgaaacaggttggttttataaatctttctattaagggaaatttctgctttcttggtaaaaggccaaaatatgactgtgcttgaattagatttctttaatttcagaggtaaactgtagctcaccagcagatatggatggaatccagaaagggctggaaccaaggaaaatgtatcagtatggagctgttgtaactctggagtgtgaagatgggtatatgctggaaggcagtccccagagccagtgccaatcggatcaccaatggaaccctcccctggcggtttgcagatcccgtaagtaccaagggcttcaccgccgcttgtaactggctaacggagagaagagagtgagagtttccctcagcgtggagagtcctgggttttaaattgacataggtttgtgaccagttgtataattacagaggaacttgaagtcagtggtctattctagaaaaagcacagcttggccaggtccgtgacttctgcctgtgataccagaattttgagaggctgaggcaggaggattgcttgagcctaggagtttaaaaccagtctgggcaatgtagtgagacctggtctctaccaaaaaaaaaataataataataaccaggcatggaggtgtgcacctgtggccccagctactcgggtagctgagataggaggatcacttcagcccaggaggttgaagctgcagtgaaccatgattgcaccaccgcactctagcctgggcaacagagtaagaccctatcaaaaaaaaaaaaaaaaaaaaaagaaagaaagaaattaaataaaataaaaaagaaaaaggaaaagaaaaaacacaactttcttaggatggggaaagtgaagaaaagaaaatagaaacactaatttaaaaggaacaaaaatgtgaaacaagcaacctgaaattttgaaaggagttgctgcatagaccaccctacgtgctgaatctgagttaataagtgcttacaatttgacagggaactccagaaataggttaaataaatagttgttacagttaatatttgcattctaacctgagaaatctctgattataaagttgagtatattgtttttgtcattggtggactcccccaatctacttagagtgaaaaaaaaaggccagtgagttgctacataagaaacaagtggatataactcaaggttccaatacatcttttttatctgttgttttttgtttttgtttttgtttttgtttttgttttaaatagacacaaggtctcactatgttgcccaggttggtctcaaactcctgagctcaagtgatcttcccaccttggcctctcaaagtgctaggattacaggcatgtgccactgtgcctggccccagtacatcttttaaatcgacttggaagggagctagagtgttgatttctgggacattaccatgaaacgtggggctacattgaattatgacactatactgataatcattttcatgattttgtactatttttaggttcacttgctcctgtcctttgtggtaagtcttcttaaatacttgaagaaaagctcttataatattttttaaaaatatgtaatgctagaggtcctatatcctatctgatgatatatttaactcatagggaatgttctctttttggtgttttaaagatacttcaatgtacatgtcacattacaaaatgtcactttggcatagagttggataaattatttgaacagccagctctttcttctttttaaattgatattttagtttttattaactgttggtgtttggcttgatttggtctattgaaataggcaggcttcttctgctgtagcaaaatacatttcacagctgagagttaaatgttatgcaaaattataagaacctggtgtcctgtgcacctaatttctattcttgagatttctctcttgtcacctcagtgacaagattgttactaataaaactaaaaggaacagaaaaactcaatgaaaagttgactggaaccttgtggtcatgtgcttggtgctttagattaaaggtggactggatcaaatcagaaaaaccttaagctcaactatgattattcaggaattcagcatttatgtccaagaagagttaagtatgagtcacataacattttccccaccactagcaataggccctgcaatcagtcagaacaatgtaggtgatcgtcttctggcatttgatacttgctggatttttcttctaggtattgctgcaggtttgatacttcttaccttcttgattgtcattaccttatacgtgatatcaaaacacagagcacggtaagttcaaaggcgaatacttgattgaccaacatgcacaagtggtttcggcttcttgtctgaaactaaacacagaagcacaagttatgtgaaataaatactgcaatgtgataactaaatgaagtatctcgtgctatacaaaaggaagccctttctgtaggacttaagagatatcaaacacttagcttattttattgaatgatgtttattcagatagtatattgtaaacaaatctagagaataggaaaaaaatcccagtgggaacgactgcaaatactttggtgtattcgtatctgatctttttcgtatattttttctctctttaaactgaaattttgtcattttcatcttctgtcttgatttttttcatttagactcatgtttatgtttttatgctttaagtcatgttttcagttactaaatagcatattattctattctgtgtatttatatatgtatttatgtgttttaagttccttccaaatttactttgataatatataaagataggagtagcacctctggctaaaccttttttcatacccacttatttccttagaatagatttctagaattactaaagataagtgcatgagcatttaatatacttgataactattgtcagatgacttgccaggaagtttgttcttagtaatatttaatgtactgggatatgtcgtgtttctcaaccccttttcctgcttcattgatttgcctgttccattacaaaccactttgtgtttaattaatacctttatgttattatatctggtagggcaagaattcacactacaattttataggactttcctctctattctcttctgtttgttcctataggtgatttttagaatcatttataatttcaaaaaaaaattgtgattacatttaagtctatagataaatttgtgagaaattggcatcttttctgtaatgtcttctcattcagaaatatactaggtctttccatttgatcaagtaatcttttctctcccttagtcattttcatgattacttaatattaactatattactacgtttctatgttttggtatgttatgttttcttatccagaaattagatatatttttgcatattatttttaattatttttaaacatcttaatccattaggaatttattttatggtatggtagttgaagtaaacctacttgtactttttttccctatatattcaattttttcaaaacctattttgagtaaaccatcccttcaccattggtcatagttttctttatcagataaagcacgcctattcaattcttgtgtacactggggcttatgtcagagatatctgacataaatatgcaagatagattatattccactgatcggcctgtctctatgagccagagctactctattaataaatgtagctttttccgagatgtgttccccctcttcaaaactattttgaaattttcttctatttatttttgcagataggctatagaattatttgcaccacgactacacctcccataccctagaaaaataaaataaaatcttagatcattgataggaagtgccttaaacctatatatttatttgggaagaactgacctcttcatgatattcactatttccttccagaaataccagatgactaattattcagatgttttgttatattttagttaaaatttaatagattaccttatataagctacatagccataaaagtatcttatttttattgctttataaatagaatcatttttggttatgtcttataagtaattgcaaatgatatctaggaaagtctatctttatacagtcattaattctaatagcttttcagtgagttacccaatcatctaagtagaaaactatattttctaccaattattattattggtagaaataatttctacctcatatctaccgattatacattttcatttatttgtttttgtctcattttactgagaagaattttaaggaaaatcttcagtaatattagggaatattggcatattttaacctttatttttaatataaagcctctagtgttttatcactaaaaatgatactgcatccttttttcttttctatattacataaagtgtatttatagtcacaaaagttgtttttccctatttaaaatcactgaaaaatcttgtttcccttctttaagcatatttttatatcactataaatatttgcataaatttttaaaatacaaaagtaaatatgcttgttgtagcaaattagtttataaagatactgaatagtctcttccactgaacaactgctggtgccttcaagtccaacatattaagttgatggatgtcagcaatttgctgtagatactttcatatgttgctctatctagtatatacatgcatggcttttaaaacatttgagcagtaatgttagagaaatagaagtcatgcgaaaagaggaatgaccacgtccatccattcttttcttatacaacaatggctgagtgcctactatgccttagcactatactaggctagaatcacaaagcctagtagcatatggcctctgtcatcaaggaggtcacagcctggtaaaggaggacaagcatgtcgctaaacaagtaccataaaataacgtcgccatggtggattatatgatatttggtgaggatgcaaagcaaatggtcaatatttgggagttttaatcaggaaaagtttcagcgtggaagagatgtttcaggtgagcctcaagagagtgtagacaagaagagaaaggcattccagacagaaagagcagtttgaataaaggcccagaggcttggctttccatcatgtgttgtgagaactacataacccatttgaaatggctgggaaatagtgtgtgtgtgatggtgattgaaggcgaaagtggcatagctttaggtggagacatgccattaaagaaaaaaaaaaaaaaccctgacacgtaaatcttgtggaagctacagaatactaatatgtgcaaaggatacatttttaacaaagcataccgtcaggtgttggcctcggatgttatgtgtgcataggttcgtgagtctttgtacatgctagtgttagggcggataatccaatgaagtcttaccaactctcaggtagctccgagtggggagatgaccaagtcatgccacctaaaacatgtcaccaaaaagctccagcaaaatttctttcacgtgccaagtcccctgcatctatcatttaccctgccaccagtgccatctgatgccatggctcagttatgtaattcctagaataggctcagacatgaaggggttgcactgaaactatgtactgagggtatctacgaacctgggcagtttgttctaggctggaggcgggagggtgagggctgcctatggggttctggctgtcctgtacagttagcgtgtacttagagtgtagagtttaccagagtgtgtaccacacaaccctgctttcatgaatgacttcagaaaaaaagggtgttctatggcaaataagatttggacatactgcacactgtttttttttcttgtggagaatcacaaggaccatgagaatatttaataagaggttttttgctatcaagaggacaggatttccaggacttggtgacatgctggatgtggggagaaggaggcacatagaatggctcacatgaaggcgatgaggtggaccccctgactcactaaaagaggagaggggcaggatttgtgggggaagatgaggagttcggttctgacctggtactttgaggtactcatgatttagggcttgggagaagggtctggactcgggtgggtgacacttaaatcacaatgaaagctgtggaaccaaaaagaacagaacagataaaaattgggatgagaacagccctcagaagaacagtaatgttcaaaaggcagaaagtgaaggaagagaggcagggggaaaactagcagagagtagcgtcacagaattcaaggagaaaagggtctcaaaaaaaattagggatgtcatttgcagggccttcctcataggaagtcacaagataatttcagccaagaggcattagaaatgtaaatacatagaaaatacagtctctatctctttccttcatgctactgagtttgctatcagagcactgcatgtgtataaaaatttgcaaatttggggaatgcttacaagtgcaaataatttataatattccagtctaattattgtttattaatatgattatatcatgtactatacttaagtgcctcaactgatatgaagcaaacatacctgtttaaccagattcctagttgccattcatttatttccatttgctaacccacttcaattgattttccaataattgataaagacacttgaatggcctgaaatgcttttttaaatgagatgagtaatcatttaaaaatgaatgtctagtgacaatattaaatattttgaaaagccatctaaacacttgaaagacactatgctattcttttctagtcatctaagatattgtaacaaagcttaaatctcacattgacctaaaaattactgttttataatcttcttaacatatctcctgtacacggaactcttcaatattctagtgagtgacatgctgtcagtgtctttagcagtattctttcttccccagtaattttgtattatgttattttagagctttacatggtagtataatcacattttattgtcttttagtaattctggcaaagtggttttagaagcacaatgaaatatgtgtactttcaaagaaggaaagtaaaaacattctcttcaaactcgtttaaagcttttaagtcagactagaacattgagtcccaaaagggtaaagttatgatctaaaataagaacttatttttgcttcttttcttcaatttggaagttgtagttgttagtcattaagcgtcctggatcctagggtaaagctgcttagtgtcagcctctgacttgaacacttacaagcctagatcattcattttttatgtgcctttccaaaaaatggagttacagtgtttacacttcataggataaaaacaataaaaatgaaatcatcacagaaaaccaaacaccgtatgttctcacttgtaaatgaaagttgaacaatgagaacatgtgggcacagggagggaaacatcatacactgggacctttcacagggttgggggttaggggagggatagtattaggagaaatacctaatgtagatgacgggttgttgggtgcagcaaaccaccgtggcacatgtatacctatgtaacaaacctgcacattctgcacatgtatcccagaacttaaagtataatttaaaaaaatgaaatcatccacaaaagtacttaccatgtgttgggaattatggaaagcaaacaactgctacattgaaacatggtcaatgagtaaagatattacatttttctttcttcttctgtttagcaattattatacagatacaagccagaaagaagcttttcatttagaagcacgagaagtatattctgttgatccatacaacccagccagctgatcagaagacaaactggtggtatgtaatgaaatggaatattattaatttacatataaaatttccttcaacttgtatttatcaataagcgtagcattcacggtgtatatacatgcttcttactattgcacaagtcttcagtaatcatgcatagcaattgttcatttacctacttcattttgccaactaatgttccaattttttaatccattcatccattcaacaaatattaaactaaatagcaaaacaactaagaataaaatcaataagatgataagcattatatagagacataataaagcaggcaagggggataaagagaacagggtggtcgcaagggaagctcttactaagagaatgtcatttgagaaaaaactcaagggaagtaaagagccagggccggccttggtggctcacgcctgtaatcccagcactttgggaggctgaggcaggcagatcatttgaggtcaagagttcgagaccactctgttcaacatggtaaaaccctgtctctactaaaaatacaaaaattagccaagcgtggtggtgtgcacctgtggtcccagctactcgggaggctgaggcaggagaatcacttgagcctaggaggcggaggttgcagtgagccaagactgcgccactgtaccccagcctggacaacagagcaagactgcatctcaaaaaaaaaaaaaaaaaaaaaaaaaagccagccatgtggccatatgagggaggaggattccagaaagaacagtaggtgcaaaggccataaggcagtgtgtgccagctgtgttggcggcacagcaaggaggccagtgtggcctacagttgtagagatgaagtcacagagatgggggtgggatgtgggcgagaggatgatcgtacaaagtctgctatgtcattgtaatgggatggtgggcaggagaggatgattgtataaagtgtgctaggtcatggtaaagagattggtttttatttggaagcttttaaggagaggagcaacacattcaccttaactgctgtgttaagaacagactgtaggaagccatgggtggaagatgggagtcaatgaggaggctgctgcaatcatccaggcaagaaattgtcagtggctaccaccaggttgtaagaagaggccagattctgcatgcaattttaagacagtgacagtaggattcgtggatagtttgtatcagaatatgagaggaagagagctgtcaataatgacacgagggcttttgcctaagcaactggaaggatagaactgccattaattacatgattgagattgcaaagagcaggactggggagaaaaatcaggagttccactgtggagatgttaaatgtggatgtctaatagacttggcaagaagacagctgatgtacaagtctgtattttgggcaattggtccaggctggagataaaaatttgggctttgtcatcatgtggttgtacataacaaggagactgaataagatctccgagaagtgaaagaggctagcaaaaagaaaaggtccaagtactgagccctggatcctccaacattagaagtcatggagtgagaaggcacccactaagaagtgaaggagcagcctctgatactatccagagaagaaccttaaagtcaggcaaagaaagaattttagggaggagggagtgatcaactctgtccagtgttgctggtaggccaaaaaaatgagccctgaaaactgaccattgaaattcagtagcacaatttttttgctgttgttgtttgagacagggtctcactctgtcgcccaggctggagtgcagtggtgtgatctcagctcactgcagcctctacttcctaggttcaagtgattctcatgcctcagtctcctgagtagctgggattataggcaagcagcacaaaatttgctgctgaacttgacaagacagtttttgaagagaggaaggaggcaggagcctgactggacggagcttaagagagaatgaaaggagagaaattgcagctatcaaatacagacaactctttctaggtttttttctataaaaaggagcaaataagtaaagtgctagtaagagtaaaacataaagtcaacagaaatattttttaagattggagaaatagcagttatgccctattcctacatgatgatgggaataatttagtagaaagggaaagagtgatggcagaaagagagagaagaattgctcgaacaaggtctgggtaagctaggaggaacagattaagcagaggagctcctagctgcgtgggcttagtaacaggagggagggcagaatctgcaggtgcagatgaaggcaggttgggagctgtgatggggagtgaacgtgtggaagttctcttccgatgattcagtcttctcagtgaatagaaagcaaattattcaggtgagagtgaggctcagaaaggaggtattagagagttaagaagaaaaaggaaggcattaaatcatcaactaagaactgaagactgaattatagggagtacagaaaggccgacaggccacatgagatgtgcacctgagtttcccatgagaaagtggggatgaacatttgaaggtttactctgtccggggattatgtgacagtctttcatgccttctcttacttagccatcagtaccactttgaaaggtgggtgttctcccaagataatatcaagatgaagaaataatatccaagaaaaccttgggcaaggtctcagggtcaatcattggcaaaggtggaatgcaagctcatgcctgagtttaaactgctttctcctacataatctagaaaataaagataccagccaggagtggtggctcacgtctgtaaacccagcactttgggaggccaaggcaggcagatcacgagttcaggagatcgagaacatcttggccaacatggtgaaaccccgtctctactaaaaatacaaaaattagctgggtttgatggcacgtgcctgtaatcccagctactcgggaggctgaggcaggagaattgcttgaaccagggagttggaggttgcagtgagctgagatcacgccactgcactccagcctgctgacagagcgagactccatctcaaaataaaataaaataaaaaatataccacctctgtcctcttggaacttattttaataagataaataagacccataaatatcataggtaataatacataccataaacaaggtatagaaaatctgtgatggcagttgaggaagaaaaggtaacctgctgctggtgagtcctgacagggggaccatactagtgacctctaaatccaaaccagttgaggtacagagtacacctagctcataaatatttgttgaatgagtttatgaatgagaaagattagtactttcatttctcatttagtttaattcatgtttatatgaatgtatataaaatgtagttatttgttccagagcatgttatatgaagaaaggcctttcaatagaatgatatcttctaatagacttgatgctttgttggttataccagctgtaactggtatgtaaagagaatgttagcattatttaaacttcgagttgcaccgctgctattcatgctgcctcctaaacagaaatgatctatttcagtgtgcctcattgcttggaattcagcggaatattgattagaaagaaactgctctaatatcagcaagtctctttatatggcctcaagatcaatgaaatgatgtcataagcgatcacttcctatatgcacttattctcaagaagaacatctttatggtaaagatgggagcccagtttcactgccatatactcttcaaggactttctgaagcctcacttatgagatgcctgaagccaggccatggctataaacaattacatggctctaaaaagttttgccctttttaaggaaggcactaaaaagagctgtcctggtatctagacccatcttctttttgaaatcagcatactcaatgttactatctgcttttggttataatgtgtttttaattatctaaagtatgaagcattttctggggttatgatggctttacctttattaggaagtatggttttattttgatagtagcttcctcctctggtggtgttaatcatttcatttttacccttacttggtttgagtttctctcacattactgtatatactttgcctttccataatcactcagtgattgcaatttgcacaagtttttttaaattatgggaatcaagatttaatcctagagatttggtgtacaattcaggctttggatgtttctttagcagttttgtgataagttctagttgcttgtaaaatttcacttaataatgtgtacattagtcattcaataaattgtaattgtaaagaaaacatacaa

SEQ ID NO: 1641 - DNA, 35596 bp, Homo sapiens; identical to SEQ ID NO: 1640
  source 1..35596: mol_type = genomic DNA

SEQ ID NO: 1642 - DNA, 115460 bp, Homo sapiens
  source 1..115460: mol_type = genomic DNA
acgggggcggacctcggcgcgctcccggccgctcgctggctccggggccgcggcggctcctctgccgggtcgcgccggacgactggcttcgggcggcggccccggcggcctgtggacggacgggtgggccgaggtacaggccccacggccgccgtctcccgcttctgcccgcgcagagtccgcgccatggccgcctcgccgggctcgggcagcgccaacccgcggaagttcagtgagaagatcgcgctgcacacgcagagacaggccgaggagacgcgggccttcgagcagctcatgaccgacctcaccctgtcgcgggtgagggcccgggccggcgcgggcgggggcggccacggccgcgggcgggacccgcgcggcgggtgagaggttgcggggccaaggcgatggcggggccgggcgggggccgcgcccgggaaccggcggctgggagggggaccggagcggccgcggcctcggcgtttccccgcctggcgacacccgctagccgttcgcgatcccgggctgaggtgggagggtcgcccggccccgtgtgcgggaagatgggcaggggtgaagcccgtggaggcgggcggccgtgcgagggcggcctgagggggaggaggacgaggagccccgagaggaaatcgcaaacagctcggaggccggccgggtggcgcggcgcggcttctggtcgctccgaacatcccccaccatcgagccctgctgttctgccggcgtggaaggccgcgggcaccccagggtcccacgcgctcgtggggggagctctgtgcacaagtccatccagggcccggccctggggtggctcgggttgttggaaccacgacgggattccgtgtcgagtgtgaggctctgctccttttactccttggaggtgctttatcgggtccagtttactttgttcggcccgggatatttagtgagaactgacaagcgtcgctggtgactggagagggacctggaggaatgagtaaggcgcgagccgggacaaacacctggagaggttaggtaaccgctgagtgaggcagtggaggatggagagccaaccggagtgtccgcgcagggttgcagagaaggggggtcagcaggagtggggctggccttgaggatcctgaatgctgaccttggaggaccatcgggaggatgggggaggatctgcagattctgggggactgaggcgggggagacagtttgaaggagagctgagagcagagttgcaaaccagctgagttgcagacacattattttttggccagcgcagtgtttgggaaaaattattgaatctgttgccagaatttttaaattggaagacttccacacaaaatccaaatttccgtattatttatttattattatttatatatgttaaaaattgggagacctggtaacactaattctgaattcctacatgacagctaccgacctgctggagctgggtgatgatgaaagggagctgagctgagctccctttcaaatggagtaagaactctagtttgccaccgtccactctctgtcacagtcccccaaggggagattaggtgacagttgccatttatactcatgatggtgttttctttcagtgaagttaaggaaaaagtgaaatatttcctgtacttacatttctgttcacattgagaaaaaatatatatatagagagaaagaagctgaagatttcaagaaaatgttttcttataccctatcagcttcactcattttttacctgcctggcatccactggcatttacatctgtgaccttggttagattcagagatgaactcgataagctcagagcacgttgaaaagaatgggtgggtgaaagctgaggattagtgttggggcctgtgttgttatgtgtttttaaatacatactgtacattgtttatgtacaaatacatgcactgtatatgtctgtatacctatggcggatccaatctttcacccaattcatgaatcttctttaaaatatccctgacaggtgaggccatgagtaatgtacagactctcttttaaaagcaaaaatttttcacagatcctcactgtttacttactttcaagtaaaaaaaaagtgtttacttactttagagaccctgctatagctcagggtctcttgaatttagcaagcctaatcaactgtggcccatatgataattcagtcaccactttattctaattactacaaaattatggtgtcattttgcccttcacctggtacagggaatcatttacatattaattctgcccgtgttttcttcttggccagttaccagtaaagtaacactgcttggctccaccgtgttcataaacacatctgtaaatgataacactgaatttggctactaatgtttgcttatttaaaaatcttaagggttattttcatgaagaaatcacaaaattagaacacttctcatagagaactcttagattcccagcatgtctatgaagaatgcgtctctaaggatccaaagatcccagttggaggagtatctgcctagttcataattggtaactgggtggcagatatactgacttttcattactagcccatgacagacatgctaattcctgacttttcattactagcccatgacagacatgctaatcgatagggcagacattactgatctatctagatgctctttcccctctgagcctgtgttgggattcaagttcttctctacatgatcaaagcaatccttcagagttggccttacttacctattcacctaggcgttacttatcctattcacctagtgggtaggatagactagactgtagaggattttctctagctttagaagtccggcattatcaggaagcagtgggaaaattttgagaagggagtactaggaggaggagttgagtggtggtacctggaatggtaaagagagggaggaaagtggggtcgggcgtggtggttcacgcctgtaatcccagcactttgggaggctgaggcgggcagatcacgaggtcaagagatcgagaccatcctggccaacatggcgaaaccccgtttctactaaaagtacaaaaattagcctggcatggtggcgtgcgcctgtagttccagctactcgggaggctgaggcaggagaatcgctcgaacccaggaggtggaggttgcagtgagccgggatcgcaccgctgcactccagcctgggcgacagagcaagacttcatctcaaaaaaaaaaaaaaaaaaaaaaaaaaaaaaaaaaaaaggccgggcgcggtgggtcacgcctgtaatcccagcactttggaaggccgaggcgggcagatcacgaggtcaggagatcgagaccatcctggctaacacagtgaaaccctgtctttactaaaactacaaaaaaattagccgggcatggtggcgggcgcctgtagtcccagctactcgggaggctgcggcaggagggaggctgcggcaggagaatggcgtgaacccggaaggcggagcttgcagtgagccgagatcgcgccattgcactccagcctgggcgacagagcgagactccgcctaggaaaaaaaaaaaaaaagggaagaaagtggttgcaggtatgcctgggaagaggctgttctgttgttcatttattaatgtattcatttgtcagtatttgagtgcctactttgttgttaatggggtgtgtgtttgtgagggagaagagtgaaaacatggggctgtcctttaaagatcttactgatttgttccacaaatttacttactgagtgagtccttagtgtgtgccaggggttaggatggacactgggtatatagtaatgagcaagcaaaacacagtgtcccagtggattttaggatttaatgaggaagacattcatttaataagtaaggacacattttggtgaatatcaccaaaacagaagtaggtggagctctggacctgtatggtagggaattctcacctcttccagtggcctaaaggctcagggggagtgggggaggcattcgagggtttgtgtgttgagggagggaatatgttgcaggtacagagaacagagattcagtaaaagaggatgaggaggggatgtgagatgaggctggaggcattcatagggatcaggttgtagagacaggatttggaacttgatcttaagggcaatgggaagtcactgaaggggttaaactatgtgagatttgcttttttaaaagattcctctagctccagcgtggtgggtagaagagaggaggaggaggattttagtaggagatgtgatagtggcatttactaagatggtggcagtcgggaggcagagcggtgagcagattgatacttaggaggtggaaagggccagattttgtgaatgggtgaggaaggtgagaaagagggagggctggaaccatttcagggtgttcttcattaagtggacactggcaggagcaggtttgtgcggaaatgctgagtttgaggtgcctgtgaggcacataagtagagatggtccagcaggcagctgtttagatggttttgcagctcgagaaggaaggctgagctactgagaaaaatgggggaatttttgttatgtagccacagaagtagatttggctgcctaggaagaattgatggaacagatattgtaaactggtggcttaagttctgtattttgccctctaacatgtttttggttttggcccaaaatgtggttagttggttggttggttggttttaattagggctaacaatgaatattgggattttatagtaaaatctggactttggtttcttttgaaaaatgagataatccaacgacactcacccgacatttctggacggcaccagttgcctggagctgaatggtggctgccccattagaaaggccatggatgtggtcttcagtttgccacagtccctaccaccctctaaggtattctttgcagtgatcccagactgcttcacttagattccctgcttggcagctgtaggcatttgagtttgttacccttgtcagaaggtgaactgtgaggccaggcgcggtggctcacgcctgtaatcccagcactttgggagaccaaggcaggcggatcacctaaggtcaggagtttgagaccagcctgaccaacatggagaaaccccgtctctactaaaaatacaaaaaattagccaggcatggtggcgagtgcctgtaatcccagctactcaggagactgaggcaagagaatcgcttgaacctgggaggcggaggttgcagtgagccgagattgtgccattgcactccaacctgggcaacaagagcgaaactccgtctcaaaaaaaaaaaaaaaaaaagaaagtgaaccatgaggagggcctaggagaagccaaaggaactaaggaactacaccatttgaaagggaggtggaggagctggccaagaaggcttgaagagcaaccagaggggcaggagaaagccaggagtactcttatgaagaggagggaatgccgaccagctgagcctagtgctgctgacttggtctgacacaaaagatgtgtcctttggtctagtcatgtggaggtcatcagaggaggtcatcagtaacctcggtgagagatgctgtattctcagggtgctgggtgaaaggctaattgtgagacgttgaggagtggacgggggtggggaatggagatagggttggaaacttattccagaagtttggctgtgaagagcaacttgtgttgaggaaccagaggactaactcagcatatcaccctggagtgttgattggacttgaatatttgcgcagactcattattttcatgtgaaaataaaccaatgataagacatagatatgtcatagattagcgagctctcaggatggaggagagagagaagatggaaatattaggtttgggctaaatattgaggactttccttttgcgaggcactgtaatccctttcacatgttgttatctcacatagtcctcaaaatgagcctatggtgtgtatatctggaattttcctcatttttgtggatgagtaaactgaggcttagagaggcatggttgcagagctggtaagtggtagagccagggtttgaatctagctatcacagtgaatgtctgtatacttagctactttaatttccctcataaggatcttcagctgcttttactccctgctgtaaggtatcagtatcatttgttgaaaagacttttctttgcccattgaattgctgtggcaattttgttgcaatcagttggccatataagtgttggtttatttttagactcttttctgttccagtgatttgtatatctgtctttttgacaatagcacactgtctgtatattatagctttataataaggcttaaaacctggtaatttaagtcctctaacttagctctttttgaaaattgctctggccaggtgccatggctcatgcctgtaatcccagcactttgggaggctgaggcgggtagatagcttgagcccaggaattctagaccagcctaggtaacatggtgaaatccgtctctaaaaaaaaaaaacgaaaattagctgggcgtggtggcgcgtgcctgtatttgggaggtggaggttgcagtgagctgtgattgtgacactgcactccagcctgggcaacagagaccctgtctcaaaaaaaaaaaaaaattgctctgactattctaggtcatttgcacatccataaattttagaattatcttgtcaatgtctctgaaaggacccgctgggattttggattgtaatcgtgttggctattgtgagacttttctcaaaaaggaattaatgaggcctggatctcatttcctgtaggcattaaagaaaattccactaagatgtgtgactgtaggccaaaggtcactaactcagtaagtgaggcaggtaaggaaaatgaatggaggggccaggaatgagatgatcatggcagctgatcctgggccatcgtgaagggataatagggtacagtgaggacttggcaaacacgatctaagggggtggcctcttctcagcttcatccagcgatgccatgcaagaacatgggttcagtgttgtctgatctttcaatcaggagaagttggaaatccatatttttatgcagtgtcctgattttttcaattgaaatttaatacactgaatgggtcaacatctggtgggtaaacagaacactctaggtgaaatgtggcctatgggctgccagtctgtgacctcggccttaggctaatcattctttggttcacatgttcatcatctgtaaacatgaaggtgttgaagacagtctcaaagttctttttctagctcaatgagtctaaatttcaaaagaggaaaatgtcaaaataactcagagtttgaagaggtagctgagatcagcaataatgataatatcttaagttgaccagagctttacatttgacataccactcttgtgtctgtgtcatttaatcctcactttatcttgtgcaggaggcgtcagagttgtttgcccaaccacacgggagttgcaggttacaaagtcacatcatccgattccaggtccagtgctttttgtttttttagagtctcgctctgtcgcccaggctggagtgcaatggcgccatctcggctcacggcaagctccgcctcccgggttcatgccattctcctgcttcagcctcctgagtagttgggactgcaggcgcccaccaccatgcctggctaatttttttgtacttttagtagagacagggtttcaccgtcttagccaggatggtctcgatctcctgacctcgtgatccgcccgcctcggcctcccaaagttctgggatttacaggtatgagccactgctcctggccttttttttgagacagagtctcactgtgtcacccaggctgtagtacagtggcatgatcttggctcactgcaacctctgcttcctgggttcaagcaattcttctgcttcatcctcccaagtagctaggattgcaggcatgcaccaccacagctggctaatagttagtagagacggggtttcaccgtgttggccaggctagccgtgttcttttttaacagtctttgaaggcttcggaaataggtgctttgggagggagagcagttatgggggattgtgagacggccttcagctcagttgagggcaggtccctatctggatttataacttagtttggttgaagtgtcaaggcttttgggtaagagttgaagcctttgtgagaactctctgaaggcaggaactttagcatacattcatcttagtaagccagtgcctggcatactacctgacacacagttaagtttttgtatcagtaaatcaatggataaattgatccttcaaaaaagaaatcaaaggctttaaatcaagatggctgagaattttgtccagagaatttcaagaatagtcagatgcttctgataagtacttttagaatgttaagattgaaagctgagagactttattcctataactccactcctagatggaaaaaacaccatgtcgtcctcctcatgtttgactctgagatttgggttttgattaataggttataactgtctccctgtgcagtacatttaagaaatcaaatacagcaggtataagggaagttaaagccactgaaggatttcgtatgcctttaaaatttccaaacaagtataagtctttatcttttgagaatacatattgaaatatggagtgataccatgtctgaaatttctgtcagtgaggcactgcgggtagtggagagggtaaagatgaaagatgattgtatataagttggtaatttttaagctagaagatggatagatggggtttcattatacttgtctttatttcacatatactatttgaaatctttcataataaatgtaaaaaggaaattatcagagagcttcataggttcaacaatgcttttggtaaaccaaacttcaccttttttttttttttgagtttgtaattagtatgatcatcgagggaaagatgggacaaaggaaaagagcatggcagaaatgggcatatgggctttgaggctgacagccgtggctcagcctcctgctagccacgtggcaagtcactgaacttccgagtctgggtctccaggtctgtaacagcaggagagtacagtctcatttgcatggttgtggggaggattagggatgaagtgggccaagtgtccgagaacagcacctggcccatcctaggggcttagatctggtagtgttttattattgttagagacagagagtgatgaagggtaaaaatctgccccagggctctcgtctataaccctttcttctctatatgaattatagtgccaagggttatgtaaccatggagctaatttattattttagaaacagaactcttaaagaccagatcagaccactttgagatttacaagaactgtaaccagtttattgctttttgaaaaatgaagtaaggaagaacttacaaagaaaagcatattaaaatggtgggatgccattttatacctattgaattgacctccttccttaccccaattaatggtaatatccaatatcaatgagtttttttggtgaaacttttctcatatgtatattataaactctttgggaaagcatttcggcagtatacgttgagagccaccaaaaggcccatatccagagatttagtaatcaccctttggaaggtgttctaaggaaataattcagaagaactgttatatacccactaaaaattactctgtaatagcatagaaaaggcttatgatgagcatgctaggttgtacctatcttatgatcacagctatgcagttcttaccataaatgtaaacggaggctggaaaagagcatgaagaagggaaaacagctaatgtgttagggttgtggatagtagcttagtttttctttcagaaattcttttattgttgttaaagattatgccagtgtatccaaacatacacactcaaagaccttgcaagaggacgttactatcatggtatatgggacatttggaacatgggtaagctctttccgaaaatagagtaatcaaaacccagaaagcaccggaaaccttgagggtgtgatcacttacgtcgagaagaaattgaaacaagactttcattcttgaaccgttcccctacaaaatactatactttgatgcttctttagatctttgctgttacctctcagcgttcttaaatcactttgtttccaggttcaatttcagaagcttcagcaactgcgccttacacagtaccatggaggatccttaccaaatgtgagccagctgcggagcagtgcgtcagagtttcaggtacctccagatatgtactttcttgaagctgaatggagtgtaaaaaatagacaaagattatcactaaaaagatgagatcttgaaggataagctgggcctaggtacagttcagtcttcttttggaaagtccattaatattctctctcatagtttctacagcatacgatagtgttatttcacaaatggctgaaggcagcactggcaagtagaattataacacaagcatatgtaatttaaaatgttctagtagctacattaaagaagaagaaacacgtggggttaattttaatatctatatttttcaaaatgcagctttctcatctataattttaatattacttaaataaatgtttggctgggcatggtggctcacacctgtaatcctagcactttgggaggccaaggctggcagatcacctgaggtcaggagttcgagaccagcccggtcaacatggtgaaaccccatctctactaaaaatacaaaaattagctaggtgtggtggctcacagctgtagtcccagctacttgggaagctgaggcatgagaatcgcttgaacccaggaggcggagggtgcagtgagcagagatcataccactgccctccagcctgggcgacagagcgagactgtctcaaaaaaaaataaaaataaaaaaataaatatttaatccaatatatccaaaatatgatcattttaacatgcaatcagcataaaaaaactgagaaatctcacatacttttctgtgtactatgtctttgaaatctgttgtgtattttatactcaaagcatactttaatttggaccagccgcatttcactagtttcatgtggctggtggctaccacatggctcagtgcaggtgtaagacacagataagtagtctgtattgcatttagattactgcagtgtcctcgggtgctttcatcgttcacatcagtggaaagccttgttcaaaccaatgtggaattggtgtttcagacaatggtatatggcactattgttaagacctgaattagacctgcttagatatcccaatctgtgaaacattaggagcctgtcattctaattatgcaatttaagattcggtgttaaagttgagatataaactttaagatgaagcattaattgattgtttggatgcctgaccattttaaaagcactgtcttatttctttgtggtagaaactgggttcacttttttgatgatgtcaaataaagccaaatgtattatttaagttggggacttccatttgagagtgctgataggaactccaaatataatggtgattagaaaaagtactacatgaacatatttgtaccctattgcaccggaatcttgtcttcaatataatgacaatggactctttaccatattactgcctgtattagagatctaccttcatatatcaaactaccttatatattaacccactgggttatttagtatccaaataacataggtctctgccttatgcgggatttcatacttcaggaaatacagcattgtgcaagtttgctgtgtctgagatcccaattttgtgctactttattgtcaactttagaggaatatagaatttactatgatgttcccctccggttgcattggggaatgggataaaatgataatccttggccttcccaggattctttttttctttttttttttttgagatggagtctcactctgtcgcccaggcaggagtgcagtagtgcaatctcagctcactgcaacctccatcacctgggttcaagcattctcctgcctcagcctcctgagtagctgggattacaggcgtgcactaccacgcccagctaatttttatatttttagtagagatggggtttcaccatgttggtcaattggtcttgaactcctgacctcaagtaatccacccaccttggcctcccaaagtgctgggattacaggcatgagccaccgtgcgtagcccccaggattcttttcatactgtttttgttttgttttgttttgtttttctttgcaacagtcacaaacttacacaatacttggaagtatagtccacttaatttttttttttttttgagaccgagtctcattctgtcgcctaggctggagtgcaatagcgcgatctcagcttactgcaacttccagctcctgagttcaagagattcttctgcctcagcctcccaagtagctgggatcataggcgtgcgtcaccacgcctggctaatttttgtatttttagtagagacagtgtctcaccatgttggccaggctggtctcgaactcctgacctcaggtgatccgcccatctcgtcctcccaaagtgctgggattacaggcatgaactactgtgccctgctgacataacttttttttcacttgggaataagttcctgacctgatgccccatcaccccctaatatttcactgtgtttttcctacaagcaaagacgttgttctatataaccaaaatacagccatcaagataagaaaattaacagtgatccattattacaatctgatcttcagactgcattcaccaaatgtccccctgctgtcctctgtagcaaaaggattcagttcagaatcacatgcagttattgcctgcagtctccttcagtctggaacagcttttcagccttttatttttgacattaattcaagtactcttaacgtttgtgatcctgtcacatttgaagattacaggccagtttttttgtagatataacccctcaattggggtctgcctaatgtatctttgtgatttgattcagactatgcatctttggcaggaataacgtagaagaagtgaggctgttatggtatcacattagggacatgattttgatgtgtcctgttaatgatgatgttctcttttatcaattaaggtggtgtccaccaggcatggtggctcacacctgtaatcccagcattttgggaggctgaggcaggcagatcgcttgagctcaggagtttgagccagcctgggcaacatggagagaccctgtctctactgaaaaaaaaaaaaaaaggccagatgtggtggtgcacgcctctggtcccagctacttgggaagccgaagtgggaggattgagtgcttgagtccagagagcagagatttcagtgagctcacatggggccacagtactccagcttgggtgacagagccaaaccctgtctcaaaaaaaaaaaaaaaaaaaggtggcctgtctgtcaggcttccccatttaaagtaactcttttcccctttgtaatgaataaatattttgcgaggagatactttatcctgatcttcattaaactttcaatctatacattcattttttatctctcggtatatggttttatgattttctattttattcaatctattataatctattattttatttattcatttttgaagcaatgaaagcacagatttattgaaataaaagtatgctctacagagtaagagtgggcttgaagcgcaagctaatctattatttttattttgatcttcacattctccccaattaggctggtgggagccctcttccgaactgagaaaaattcttgaaaaactgaggagagtcccagagcacagattttttttaagtaaatgtttttgaggtattatgtaaatacaatataatttataccttttttaggtatacagctctttgccatataatcaccaccacaatgaagatgtagaatagttccattaccccaaaaggttcccttgtgtctgtttgtaagtattctccatcccccacctccagcctctggaaaccaccatctgtagttttgactcttccagtgtcctattagtggaatcaaatgtccgtagtcttttgagtttttctctcacttagcatttgagattcatctgggtggttgcgtgtgttagtttcctagggctgctgtaacaaagtaccacaaacttagtgccttaaaacaacagaaatttattttctcatgttctcatgttctgagtccagaagttggaaatcagcatggtgtcagcagcaccatgaatgctctggggaagaatccctccttgtctcttcctagcttccgtggtctgcggcagtccttaacttgtagctgcatcacttactctctgcctctgtcatcacacgactttcttcattgtttgtctgtgtctgtgtttaaatcttcctctcctttttcttataaagaactagtcattggatttagggcctaccctaattcaatatgatctcacctttgcttgattacatctgcaaagattctgttttcaaataaagtcatattcacaggttctggggcttaggacttgaagatatctcttttggtggccataatttaacccactacattgcattgatcagtagttcatttctttttattgctgagtagaattccattctatggatgtagataatttatgcattcatcagttagttgatgggcatttgggttgtttccaccttttggcaattatgaataaatattctataaacattcacatacagtttttatgtaagtagctagtagtggaattgctagatcatacagtaagtgtatattaactttagctttataagaaatcgccaagctgttctccaaagtggctctactgtttcacattcttaccagcagtgcatgagagttccagcgaccctgtatctgctctagcacttggtatttcagagtttcaaaaaaatggtggttaaaaaacagaacataaaatttaccatcttaaccattttttaaagtagtttattggtatcttctaaaaccatttttaaatgtatagttcagtggtattacatacattcatattgtgcaaccaatctccagaattttttcatctgacaaaactgaaattctatgcccattcaataagaattctccatgttcccttcccaccagcctctggcaactactgttttttctgtctctatgactttgactattctaagtgcctcatatgagggaaatcatatactatttgtcttttttgtgactggcttgtgcttagtataatgtcttcagggttcacccgtgttatagtctgtgacatgatttccttccttttcaaggctgagtaacatttcattgtatgtggatgccacattttgttccattcatccgctaatggatacttgggttgccgccacctcttggctattgtgaataatgctgctatgaacatgggtgtgcaaatatctcttcaaggctctgctttccattcttttgggtacatactcagaagtaggattgctgaatcatatgacaattgtggttttaatttttttttttttttttgagactgaatctcgctctgtcgcccaggctggagtgtagtggcgtgatctcagctcactgctgcctccgcctcccaggttcaagcagttctactgcctgagcctcctgagtagctgggtttacaggcgcgccccaccacacctggctaatttttgtttgttttttttttttacttttgagatggagtctcactctttcgcccaggctggagtgcagtggcacgatctcggctcactgcaacctccgcctcctgggttcaagcaattctcctgcctcagcctcccaagtagctgggactacaggcacctgccaccacgcccgggtaattttttttgtatttttagtagagacggggtttcactgtgttagccaggatggtctccatctcctgactttgtgatccgcccgccttggcctcccaaagtgctgggattacaggcgtgagccactgcgcctggccttgtctagtttttaaattgagttgttaattttcttaatcagttgtgagagttgtttatatattctggataccagttctttatcagatatgtattttgcaaatattttctcccagtctgtggcttgttttttcattttctcaagtctcgaagagtagaagttttaagttttgaagtctagtttatcaattgtgttattttatgatttgtgcttttgtcttatctattaataagagttcttcatctaactcaagttcccgaaggttttttttctatgtgtttctctattagttttatagctctgtcttttacacttaagtaaattatgagttaatttttttgtgtggtacagggtttgggtttgaggctcactcattttgcatagggatgttaaattgttctagaaccatttgatgaagactttcttttccctattgaatgccttggtacctttgttgaaaatcaattgaccatatacatgtgggtctatttccggactcttctgtgtcattggtttctttgtctatcattttgctaataccatcttctgtgtcattggtttctttgtctatcattttgctaataccacactgtcttgattactgtacctttataggaaggcttggaattaggtaatgagagtcgtctttgttcttttttgaagctgttttgcttattttcattcctttgcttttccataacattttagaatcagcttgttaatgtctataaaaacacctgctaggattttatttttatttttttgagacggagtctcactctgttgcccaggctggagtgcagtggcacgatctccactcactgcaagctctgccccctgggttcatgccattctcctgcctcagcttcctgagtagctgggactacaggtgcccgccaccacgcccagctaatttttctgtatttgtattagagacggggtttcactgtgttagccaggatggtctcgatctcctgacctcgtgatccacccgcctcggcctcccagagtgctgggattacaggcgtgagccacaacgcccggccaacacctgctaggattttaaacaggattgcattgaatctatagataggttggggataattgacatctttataatatggagtcttccacgaagaagacttccatgtacagaaaaacagatttttattgaagttcagttgcttataatcatttatatacaattctccttttatttttattatattgatatatttttgattgacaaaattgtatatatttatggtatacgatacgatattttcataaatgtataccttgtggaatggctaaatcagacaaacatatgcatcctctcacatcattatcatttcttttgtggtgagaatctgctctcagcaatttgcaatatatgatacattgttattaactttagcaatcatgatgtactatagatatcttgaacttgttcttcctgtctactccttttatgtttgtaaatcactttggagtttacaaaatgctttcatatctgttattttacttcatcctcttactacaacattggttggtaagtgtagtactattttaatatactaaagaccaattttctatcctaatggaggatctcaaagtgcattctttttttctaacccaatgagcccttatgcaaagaacgtagacttatcagatgagtaaacaaaagccaacttttcaggctgccttctgataatctttagcaaggggcagaccatcagtaaaggggtagctagggttatagccctcatgtctctaggcagggcctggcacacatacactgagggcagagaggaggaagtgggcattatcttcttctctgagagcgagggctagggctgtctcttctgcttagtggagggatagcatgttccagcctgtgtaacagctagggcacatgttgactgaatggcttgtcaggcagctgtagagagagggacaaagggcttctctctgtatagggctttgtaggtatagttgtagcttttcgtatccttttttttttttttttttttgtgacaaggtctcaaggtcacccagctggagcgcaatgatgtgatcttggctcactgcaacctccacctcctgggctcaagggatcctcctgtctcagccccccagggtagcagggagtacaggcgtaagccaccacacccggccagtttttgtatttttgtagagatagagtttcactatgttgcccaggctggtctcgaactcctgagctcaagcgatccacccgccgtggcctcccaaagtggtaggattacaggtgtgagccaccactcccagcctcgtatcctttatataacctaccctagtcctttcaaatcatatcactaaaaactaattgtactttttacatctctgattaactacattttaacaaaattgcatcatgtcatgtgtaactgagggcttttaagttctaatttagggaacaatctgatggtcaagggaagaaacccttataccaaggcagtttgcaaaggcctggagggccaggtccagcaaggtggttttcctggggcccactaccaatatgagtagtataatgaggcccagagttcgcatagcaagtaagtaagagaaccaggacttaaaaatcatgtctttgacttccagttccatttccatggttttcctttactgcatttcctttcaagttttcataaggttctttaaaggaaaaaaaaagattggcaaaaagatacatcagttaaacaaaagaaaacctaagtagcagtattaatctcaaaataccactactaaccacagctgacatttattgagtatgtgctatgtgccagacactgtgttaagctctctatgtagatggtaattgtcatagcattatatgacttttatgtgataaaacaacatagcaacaaattgcaaaaaggaaaaactccaagaaatgagaattcgacaatagcacaattctagatttttaattcactacgactgagccaatattcaaaataaagataataaagagttacaccattaacaaatcagaattactgtataccaaaatttattccctagagtttattctctaaaaaggtaagatacctttctagatatttctagactcattttaaaagcaatacttctttttctgattataaatgtaacacttgcttattacagaaaactggttacatcttttttcaccatttggccttttctttcagtagttttgcagtgactataaatattttttaacaaaatcagcctcatatgtatgtatagttttgtattttccttctatgtgttcaatggttttcagaaacagtatttctagtgactacatgctattctgtcacatggatatgccacagtttcactgcccccttattgtttgggttgttttcactctttgttcatggtgtgtgtgtgtgtgtgtgtatgtgtgtgtgtgtagtgtaaattgatcacatactgggccaaataaattctcagtaaattaaaaaaggagaaattgaatctgaacataattaataaaattgcaattaataattaaatttaaatttaaaaatccagctatttgaaaattttaaagcctttttaataactattagatatactatcaggcaggctgggtaccatggctcacgcctgtaatcctagcactttaggaggccgaggcgggcagattgcttgagcccaggagttggagaaagatagtgaagagctagaagaatgccttcactttgaaaatctgaggaatgccttggatccctcctgaggaaaatatgtaaatatgtatacatgctcttattcacttattttattttattctttttctttttttttttttttttgagacaggtctttctctgtcacccaggctggagtgcagaagcgtgatctcagctcactgcaacttctgcctcccaggttcaagcgattctgctgcctcagcctcctgagtagctgagactacaggcgcctgccaccatgcccggctcattttttgtatttttagtagagacagggtttcaccatgttggtcacgccagtcttaaactcctgacctcaggtgatttgcccgccctggcctcccaaagtgctgggattacaggcgtgagccaccacacctggccccattcacttcttttaaaaaagttttattagtgaaaatttcaaacagattacactcatttttgcttaaattttgatcctgtgtcaagaactcttggcctaggatgacttacatttgtaagtttgtattaaatatttaaaaattggctgagtgtggtggctcacgcctgtaatcccagcactttgggaggccgaggtgggcagatcacctgaagtcaggagttcgagaccaacctgaccaacatggagaaaccccgtctctactaaaaatacaaaattagccgggcatggtggtgcatgctgtaattccagctacttgggaggcttgaacccgggaggtggaagttgcggtgtgctgagatcgcaccattgcactccagcctgggcaacaagagtgaaactccgtctcaaaaaaaaaaaatcatttcccttattttcctttgcctgtttttttttttttgagtctataaaatgtatttgatggaaaattgtggaaaatgttttagtaacttagtacaaggttaaacaagcagatggcactgtcatggagttatttgaagtatatttgctgttgctattgtcccctttaatactcaagcagccttttagcagcctttgaaatctcatttgtcctcatgcagataatccagttctgtgtgcatatttgcatgtcagatctcgaaacctgcttttttttttgttatttcaaggtaatataaagtagcatataggtaccaccatgcataatccagaacccctttgctttccatggaagccaacctctcagggctcctgccccctcactgaggatgcaggcctgggaaaggggatcagaaacgggtttgtagggaaggatgagctctgcctgtcctgttgcccagggagcactcctaataatgccaaggagctcaattccaagcaggtgagaagcttacggaatgaaacaagagaggctgattctcattaaatattttcaggttgtgtagggcagaacaatgagatgaacaaagcaccgatctgtcctctacttcctttttctgaaaggaagaggtgaagtttcttcatgccatctggacagtgttggggttacataattagactcctcccgactgagtctccttaggtaaatcacagaattctctgactcatctagaagtgatgataatgacggttacttgatagagttgttcataaggatctaatgaatgcggaataaatgcatatctctggaaactaaagtactaagcaaaagtcagtagtatagtaatacaaatcgtgcttaggaacaattgtgaagtaggaagtttgtctttatcactttctacctctttttttctgtgcttcttactgtctccccctcaccgctgctgtccaatatgttagtcactagtcatttgtggctatttccattaattaattgtatttaattaagattaaatacaattaaaaattcagttccttggttgcattaagccacatttcaagtgctcaggaggcacatgtggctggtggccaccgaactggacagcactgccccctattttgagaagtgggagagttcttggaggaggtaggcattctaatgctgcgttctaggtcccagtttcagcaccggattaagtcctcaccttcccttaagagcccagggctttaaggtgatcttcccttccctgctcgtctttatcagccaatcagatttctatgccttggttgaagtgtttcttttagtggtaagcaaagcaccctgattaagttcatatcaaaaactttgaacctccacttaactgctctgagtacaagcatttcaaaaaaggatgcccccaaaatcagatctccgcttggtagaatttctcactgtaaaatgtggcggttcctctgaaagggtgtgtggtaaggcgcgcccttacattacattacattacacacacgcacacacacacacgcacacacacacacacacacacacaaatgtcttctaaaggaacagactgaccctgtgaaggtgttgggtgtcgtggtctcctgctccgtccctactccaagagtggtgttaactacttttctttttcactcttcattaattgattaataaataattgaattggcaaatgtttcccgagcgcctgctgtggcagcaggtctgtattaggcacaggacacatagaaacgaagaaattggcccttccacagaagtcagcagcccagttagtcctcgtttaacaccatcaactctgtgtccagtactgcggcccgagcagccggcatctggccactgcccctcggtgaagaaggctgctctgccttaagccacaaatgaccttggaatctcagagactattccaaaatggttctgtcttgagtcacagatcagagagtctccacagagatctcaaagtagcttcttgtgtcatctaatggtcttcagaaattctgtctctgtttctgtggtcagctcccagctgctcattattcctgatcacccctcatctagttcttttgtctcctggagtatgggcagtgacttgtggaaactctgcttcctttcgtactccctaggatgagctgtggtgtgataaagatgactcgggcagcaggcaaacctggtttgagtcctggttctgccactcttttaatctatgatttgggcatttcctcaactatctcagtctagttttttgtatgtgaagtggggattataatagtaattatccataggataaactgagctaaggggaggcatgaggccttgaccaagggggttttggagctggattgtgttaagggaactggggtgtaaagaaaactgattccttcccaagcatctaactaaattctgatcatgtgtagtcattcttcatagtttgtggcatagttctttgctcagaacttaaatgtgagagggaattttgttcccaaggttataatgttatatttttttcccttagccagccctactcttggtacagcatgctctctgccagccctgagacaatctgcttttatccaaatactgttagatgtaatgaggcagggcagtgaccttgggcttctgcatgagatttagaaggccacatttataaattattttagcatgaattatttccgggaaagatgttcactgattactaatatcatctattttatgttgtttcttattttctttttcagagattgacatttttctgaccttgtctgaattctttttaagagttcgtacctcctgaactacatgcactttgcaactctgatttttgtactgtgtctgtgtgtgatgtgctcactggtttgcctttgattttgacttccagcagcatgtccttctattctgcctaaggaaatagtgagaagcacagagagttagggggttacttaatagttttggaatgtgcatctgtcccgaaataggagctgtgaccaagaatatggttgtcgtatttttaatccatattcgaatcatttttcccttcctttttatctagccgtacatgttgaatagaagacttatagaatgagagagaaaagtagataactcatgaatctctaatcatctgggataaagcctttgtttgaaattatagaaggggcggggaaacgttggtcccacacactgaattaggaacatctgtacccatgagaacttgagcaagagaactggaatattgccattttcattctgcctcctacgtgctctcaattgttcatgcagtggaggggcagcaatagcatggatacttgagatctttaaaatacccctccaagtaatgttttaaaagactgaatcagattccattaatcgaaaattttcatgccagtaaagttggaagagatgggaatgtttcctgagaagtctatccatgggataaaaccaatgatctacttgaaaagaaatacgacaagtactaaagtgacaacatatactttgccttaaaatattatggcagaagctttagggcagtacagaggctgcatagtgtgatgggcaaaagggtcatactctgaatccaaatgtggcctctgccactttctagctgtgtgaccttgggcaaaccacttagcatgtctttgcctcatttttctcacctgtaaaatgggcatagttctaatgccaatatcagagttttgtggagaagaataaatgagttgttatacataacacccttagaacagtggttggcacaaggcaagcacattagaggtgtttcctctttttttttttttttgagtcagagtcttgctctgtcacccaggctggagtgcagtggcgtgatcttggctcactgcaacctccctctcctgggctcaagcagttctctgcctcagccttccgagcagctggaattacaggtgtgtgccaccaagcccagctaatttttgtatttttagtagagacggggtttcaccatgttggccaggctagtctcgatctcctgacctcaggtaatcctcccgcctcggcctcccaaagtgctgggattacaggcatgagccaccatgaccagccaaggtatttcctcttataattgttcctattgctcctgcttccactgctgtaattccttctgccatcgctgacacctctattgccacaactacagcgtaggcttgggcgtcagcctggctttgagttctagcactgctgcttacctatttaagtccaagtcccatttctatatttgtaaagtaggagtgttactagtacctacttcacaggacctggtgaggatgaaatcagataatacgtgtgaagcgcctggtgcagtaaatgcttatggttttgttgttactgcagcagctctcaaccagggatcctcccacaccagagtgttgtactccactatgggttgggttacaagttatgtttcttactaaaagtaccaatggttgggaattattttttaaaataattagagttaaatcaagggtatccccaccctgacaatattgctgttcacttctattttgagaagtgggagagtgcctggaggagacagccctgcccttctacaattggccatactctggctatatctacagctgttgggatatgcgggtgggggatgcacatgtgaaaggtgagtgctttgtgtgggggcagaaaacaaatttgagagttgctggccttagggtgctgtcatttctgctgcagaatgtaccactcgtgctcttccatgtggcagcccccctttttagttgattgcccagaccaaagcatcattatcccccaaagcccaactgttcttatcttgcctaaacatatatagatgccaggaaacatttgttctgactattaaaatcactttttattatattaagcagctactgtaacttgccctgaatttattcattaataagtatttatcgagtgcctttatgagtaagatattatctggtttatgaagaaaatgcagacactatcagtttaagaagctcataatcaagtatgatagactaggaggatatacaataactatagcacaaagacgttaactctagtgttctttttcttttttctttttcttttattttttatttttgagatggagtcttgctctgtcacccaggctggagtgcagtggcatgatcttggctaaccgcaacctctgcctcccaagttcaagtgattctcctgcttcagcatcctgagtagctgggattataggcatgcaccaccatgcccagttaatttttgtatttttaatagagacggggtgtcaccatgttggcaggctggtccgaaactcctgacctcaagtgatctgcctgccttggcctccccaaagtgctgggatttcaggtgtgagccaccatgcctggcctctttttcttttttagcttccatttttaaacctttacgttcaggaaaatacattgcatttgtttatagcttgttccttaattctttgtttttcattataaaagtaatatgtgctcattgtgtaaaatttggaaaatatgtaaacattaaaaaggaacagaaaaaatgagccatttttcatcaactagagattaccattttaatgttaagtttatttttcatgtatctttatacaggtgatatcagtcttcatatttatattatttttttctttttcaaccattatataataattatttccctatgtcattaaaatactttataagtataattttaatagctaaataatatttcatcatatatgacttataatttacaagcatttccccaacggacattttagttgattctgatttttttaatgaataatatggtaataaacacttttatgtatgagtcatccatatttctgatcatagatttccacaagtagaattctgaaaccaaagggtagaaatatcgccaccgttgttaatagatgtggtttcattactttttggcaatgatatttaccttagcaaaacttctgacactgatggatttggatatttattaccttaaggataggagatccttagctttttcagatctgacgttccaagtgtatgttgactgttcaagaatgactccaaagttcatgacataaagtagtttgcatatttactgaagcacaaaatttaatcacacgggcctagaggctggtgagtgaccaaggctgcctagcaaatgtttcattggggcttcatggatctctgtgtaatacgtcttatatattgacttaaaaacttaatttgtttgaaaatggacagcttttgtgaaaatcaaaagggccattaatttatggtatacaattatgcacagaaaatctacagccgtcagagaaatatgactcaagaaaatactgagagttgatatagatactttcatattaaaatagaaggtttacaacggtctactacttttcaatgactactttctaattgcttaatagtatgtattgacttgtcatttctagaaaataaatctaatttcatttttagtgccaaccattggaattattctctttataatcaccacatggctatatatatatatatatatatatatatatatatatatatatctttataatacaatatgaaaaataaatacattaatcaaattatcagaccgagcttctacagatgtttgccccttacttgctttaattttaaaagttctctttggcaggaatgtcttatactctagctagggaagaaaatgtgtagaaaacaattttaatcagtgtctgggagtctgagaacaaacttagcaaatttagcttagaacaatcgcaagtttagcttagcatctttccttaaccttgtacttctaggtaggaccgcctacactgccagcaccccctcacagtctaggagcagcttctctctcccccacattttgagctgttccccttgaggttgctttctcgccctttgctgacagggaggtggtggtagctgcatttgtctcccatctggtccccagaacgtttcttgcttttgttttacagtcttgtgacaaactagcacgcccccttcctatctcagggcctggcttccccagcccccaactaaggtctcagacacgtacaaatggtgcccctctttgaggggctcgtacatctgcacatctggacctttcacatagtgatctgttaaaggcatagaatcagcctgtaatatgctgagatcaccctggtaatatggtggagtacagacagagccgggtctgtctggtttctggctctgtagccttttcccctgggtctcctggggccacttgaacctgactagccagcctctcacccatctctaggacccagcctgaactgaggcagagggactgaggctgcctcacactctgtaatttggcctcaagtcaccattgctggccttgtgcctcagctctgataactggactcttgtctggctcctgcgtgccagaatcccatggtaacctgcctcgtttccctgtgccttgtttttatcagcctgcctcccagggattgaaatcgtgccctgaaacacagtgaccaatgcactttcctgatgtcaaccaccccacttgcctttctgattggattccagagtaccttaaatttctcgttgttctgcagtgcctgtagtcaggaaacctctgttctggacacttttctctgtaaatgacaacttagttcttccagttacttgtgccaaaaccttggagtcacccataactccttgcattgtctcacatcccacagctaagccttcagcaaattcttggttctgttttaaaaatgtatctagaatctgactaccctggtcggacccgttatcattttgtccctggattcttgcaagagcctcctgactgggcttctggcagaggagtcctgtcttctttcagtatattctcaacactgccacctgactgatccttttaaaatatgagccagattatctcactccccacagtcctccagcggcttcccgtttctctcagggtaaaggcaaagtgcaaagtgcaggcagtccctgtagggcccccatcatctctgctcttagctgcttaccacacatctctccaacaccctcctcactcactccatgccagccacactggcctttttctctgttccttgaaccttgcttaggatttctctaccaggaatgctttttttccagatatgtgaatggcttacttcctcacttccctcagctcctcactcaaatatcacctgtcagggaggccttgcctctctaaaatctaaattccctccaccgtctttcctgcttgatttttctcctcagcacttatcacgatccagtatactatatatatatatacatatacacatttatttttttttgagactgagtcttgctctgtcgcccaggctggcgtgcagtggcgtgatctcggctcactgcaacctccacctcccgggttcaagccattctcctgcctcagcctcctgagtagctgggactacagacgtgtgctaccacgcccggctaatttttgtatttttagtagagacaggatttcaccatgttggccaggatggtctcgatctcctggcctcaagtgatccgcccgccttggcttcccaaagtgctgggattgcaggtgtgagccaccgcgcctgtcctactatgtatttttatttatttatctcttttatattctgtctcctccaagccccctgggagcaagggtgctttggttcactgctgtatttccaaagtctagagcagtacctggccagggtatgagttccataaatatttcttgaatgaatgaatcaaatagttgagtattagcactattctgagaattttgtatgtattatctcattgaattcttacagtaaccttatgtgatggtacttttatgactcccattttacagatgagaaaactgagtcttaagaggttaggcgacttgcccaaaaggacctgagccaccacacaagtattccactagagcagcaagttagaataaacacagactttattattatccagatttatgttcaagttgcagctctgtcaattactggttgaattaaaacctctctaaactttaatatccttacttatgaaataattattctacctcccaggttattggaagaattagatgagatcatgggtgcattattttcatgtatattttcctgattgctggaaaagttgaaattttttcattttgtggttgtttgtttgtttgtttgtttttcgaggcaaggtctcactctgtcagtcaggctggtgtgcaatagtgtgatcttggctcactgcaacctctgcttcccgggctcaagtgatcctcccacctcagccccccaagtagctggcaccaccggcgcatgccaccacactcggctaatttttgttacccggctcatttttatgtttttggtagagatggggttttgccttgatggccacgttggtctcgaactcctgggtgcaagtgatccatccgccttggcctcccaaagtgttgggattacaggcgtgagccaccatgtctggcctttttcatgtatttaccggccattctggtttcctcttctgtgaatttcctgttcataaccttttctcagttttttttcttatcaaattgtaggagttcttcgaatgttagagatacatgttgtcttatatgttataaatagctttcctcataccatcatttgttgtttgatgatgttttttggaaccttcttttattcatctagttagcgctccaggtttggtggttgatcaaatacttgagaatagggatttattcattcagctagtatttgttgagggctggaactctgtgggatgtccattcagtcaggacacctctaaatcctgacttccagtttacgtcactgatgatggctctcatccttggttctaccagattcttgaaagagaatgtgttttctcagagccaagtagacccaaacatttcccagactttggccacataatcagaaatttcaaaagagttctggaatttgtgggcttagctccaagttaccaggcatccgttgtcttccctgtgggcagaattcgcttttagcttactccaccctcctcagctacgcagcatgattggggcagacgatgaatacttcagatatcccctgtggggttaactccagaggcagcctcagaaactagacacataattcatatggtcaaaacctggcaggctcttctgaaatcgtgtgacttcctatcaggccaccagctctgcagatcctcaaaggtctggctgtcagaacaatagggaatgagagcagcgcccagatgctgcctgctggagctgcaggtcctgtttgagtctgaacaataaaagtcctggaatgaattaccaaggctcctgattgcaccctgcaggttcaggtttagtttgtggagatgtctcacataagaactgtcttgtaagccgcttggggggttcaacaaaattggtcaacaaaatttaataccatacaagcccttttcttgatcaagcaatttagtaagtctctgtcataagtctctatgacctgccatccaatatgtcaaaataaacaaaattttcatgttgatggtcacaagtgcagtccctagagtggggatctggtgaccacttccaccactaactagcactggatcgtagacaagatcgttagtctctctgtgtctcagctcactcatctgcaagatgtggctactaatagtacctaagatagagctattgggaggattaagttaggtaatgcatgtaaatccttagaataatgcccagcacagttgttgttcaatacatattgcaaagttcctagtataaactccctgttgcagccttctaatttgacttcaatagattgttggtaccatttgcctctttctttgcaggtatcctacctaggcctagagaactaagcttttgctgttcattatatgaagcttcttaaatgtcatacaggctagttgcatcctactaattcttcacagactagataaaaatacttttgctgaagtcttaatcggcctgtcctgaagtcaaccaggctgtatgttagtgccttgactcagtgcagctttcaagagaggcagaaagaatacccacagagaaggcacatgtgggcggtggcagtgtaggaccaggaaagaagctaggtctctatattccctcgcattttgaatctgtgttaaattcaatcatattagtatgaagcaatcctcttacctatctccttaatccagcctctgactgccagctcacaaaagagggagaagaggcactacatttaaagtagtgattatctctaactagaattttaagtccctacatgttttggctgtagaaccagccaaagttttgttccaattccctacaaaatttcacaatagtcaggagttagaattggtccctatgttatgaaacagctagtttttatactttaaacttaaaatgaagctttagttgtttattattactgtggatattttccaagagacagaataacatctgtggaagattctacacaggccttgatgccagacattgtaattatttccctgctcaaaggcaatagtcagtgcctcaaggaactccctggctataagcagttggctgcctcgacaacagatagctaatgtcttagctcttttctgtctctaccgccagcctcttggggatgtgacttgagaaagctctcccctccccattttctcctgtaacctctttggaggaagtcaccagggtaaccactttcttttatgctagttttcttgagtgcaagggaaaacacttccccacagacatatgacagaagtttaagagtggtgaggagaagaacacgaacagttactgagtacctgagctatgctttgtgtacctgatatcattgagttcccacatcaaccttctgagataggcattatcatccccattttactgatgcttaaacagtaacatgcccaaggtcacacaagtggcaagtgacagtcaggactcaaacccaggtttatctttctcgggcctttgctcttattttgcaaattaagcaagtgtagacacacaaaaccaatttgtttttacctaggaaacgtgttttatgctttgtttttctcagtctggatagatgccgttttctagtcccctggaaccatcgtatgcccagtttagtaccacttttgtttggtttctcgtcttagaatatattctgcttattcactcccccggccacctgagaaatctttttactacttttagtccaaatcaaactttccttcccttgactacctaggaagtctctccttgggtgagtcttaactcgcctgaactgagagtctcaccctggaacttggttaagaaaggccagagttgggaggcaacagcctggatggaagaggggggtcagttgacactggagggggcaagccagaccagccgcaagcaggagccaaaaggtcagaaagccagtgagaatggggtgggccaacaggagcagaccaggccacacaggctgtgactcccccttgcagtggctgctgggcactggccatgcctgtgcttgtctctctcagtatctcttactctgccatcttgtcattcatgaaattgctcaagagacgctttctaccagtccgtgcctgcttagtctccgagaagttttgggggttcatttagaattaattaatttagaactagcatttaaaagttaaacgggctgggcatgatggctcatgcttgtgatcccagcactttgggggactgaggcgggtggatcacttgaggtcagaagtttgagaccagcctggcaaacattgagaaaccctgtctctactaaaaatacaaaaattagccagatggagtggtcaatgccggtaatcccagctactcgggaggctgaggcaggagagtcacttgaaccgaggaggcggaagttgcagtgagtagagatcactccactgcactctagcctgggcaacagagtgagactctgtatcaaaaaataaataaataaataaaataaaaataaaagttttaaaacagcttataaacttgagttaaaatataactcaagtgaagcagagagaagaatattaaaggggaaacatttaatgaggagcaaagcatagccttgaccgagcttctgctaagagcggatggctctcacttggcacagacatctttctgtattgcactacttgccctggcagaggcatcagaactgttagaaccacaatggactgtgcagcacttttcatgcaacactccccctttaaggttagccaaccgagagcaagaaaaaataggtaataagctcaacattactcagctagtaagtggctggtacaggaatcaagttctgcttacttagtctgaaggttttcagccacttcataccatttgatcaacatatttgccctttgtttttgaatgaaatagaaaaaataatttccttctttccttctttcttcccgccttccttcctttttttcaaacaaaattactgccatttatattagtgtttctaccacttctatcatgaccactgctggcaaaaatgtactgaacttttgctgtgcatcaggcaatatggctaactaaggctttgcatacatcatttactctttctagtaaccccagagtaggtactattactgtctctatttacagggaagactgtggaggccaagaaggattaaacaatttccctgcatcacacagccaaaaatggtaaagccagatttgaagtccaggctctttgattctggagttcatgctagtaactaccagctctccgtctggcagtgttttgttcttttgttgaattactaaaacagaactattttctctgaatgcagaagttgaaacctgttgaggaaattcaaccagagtatttcttgaagaaaaaagaaaccatttcctgatttctttatttgttaaccctatgacatcattagggttggtagtagctgctcctttgccttcacacacaagaaaaaagtgtgcaaatagttcttaggaactactgaagctgttcagaggaccagaagctagaccctcctctattattttctctgccctacgtctggcctttttagcttgtggaacttatcatccccgccatccagtaaaggctacaaaggccccgagactagtccctgcagttactactgatgttcttttcttgcttctcatctgcttttactaccagttctgtcttgcccatggtcaaaccattatctctaaaactccaccttctaagctacctctgacccttcgaatttgccatggttagaaaaatcaggaaaataggaaacctaaccagcaaagaaacatctgggagtgtatttgttgtcactgtaagcaatgacacatagattaaaacaataagataccataggcaggaatggatagagtatggactcaagagtaaggcagcttgggttcaaagcctgtctctacccattacaagccttgtgttcaacaatttaaccaaccttccttccttccttccttccttccttccttccttccttccttccttccttcctttcatggagtttcgctctttttgcccaggctggagtgcaatgatgcgatcttggctcaccgcaacctctgcctcccgggttcaagcgattctcctgccacagcctcccgagtaggtgggattacagacatgcgtgaccacgctggctaattttgtatttttagtttttagtagagacggggtttctccatgttggtcaggctggtcttgaactcccgacctcatgtgatccacccacctcagcctcccaaagtactgggattacaggtgtgagccaccgtgcctggccaatgtaagctttctaagtctcggtttcttaatctgtaaggtggggataataatagtagcacttcacagtgtcgtgaggattaaacgagataatgtatacgaagcatctaacactgtacctagagcatataaatgccaataaaggctaattatcaaagtcataacttagcctttttacccattaaattaggacaaatttttgagtgatattcagtgttggtgagtgggtaatgcaatgtgctcttgtatacaggcacaccttgttttattgtggtttgctttttctgctttacagatactgtgctttttacaagttgaaggtttgtggcaaacctgcatggagcaagtctattggtgccatttttcaatggcatgtggctcacttcatgtctctgttgcatttcagtaaatcttgcaacatttcaaactttttcattattatatctgttatggtgatctgtaatcggtgatctttggtattactgttgtaattgttttggggtcccgtgaacatcacccacataagttggtgaacttaatcaagagaaatgttgtgtgtcttctgactgctccattgatcagccattcctgtgtctctccccctccttgggcctccctcttccctgagataacaatattgaaattaggcctctaagtgttcaagtgaaagaaagagttgcatgtctttcactttaaataaaaagctgcaaatgattgaggttagtgaggaaagcatgttgaaagccaaggtaggacaaattcttgaaggaaattaagtgctattctgatgaacacacaaatgataagaaagtgaaacagccttatttgctcataaggagaaagtttaagtggtctggatagatcaaactagccaccacattcccttaagccaaaggctaatctagagcaaagcctaactctcttctgttctatgaagactgagagagctgaggaagctacaaaagaaaagtttgaagctagcagaggttggttcatgaggtttaaggaaagaagccatctcacccaggcgcagtttctcatgcctgtaatcccagcattttgggaggctgaggtgggtggatcgcttgaggtcaggagtttgagaccatcctggccaatattgtgaaaccccgtctctactaaaaatacaaaaattagccgggcatggtggcgtgtgcctgtagtcgtagctacttggaaggctgaggcaggagaattgcttgaacccaggaggcggaggttgcagtgagccgagatcatgccactgcgctccagcctgggtgacagaccaagactctgtctattaaaaaaaaaaaagaggaagaagaagccaactccataacataaaagtacaggatgaagcaagaattgctgctatagaagctgcagcaagttatccagaagatctggctgaggtcattgctgaatgtggctgcactcagccacagattttctttcctcctttcttttttttttttttttgagacagagtcttgctctgtcgcccaggctggagtgcaatgacacaatctcagctcactgcaacatccacctcccaagttcaagcaattctcttgcttcagcctcccgagtagctgggattataggtgcccgccaccacacctggctaatttttgtatttttagcagagacagggtttcactatgttggtcaggctggtctcgaactcctgacctcaggtaactcacccttcttggcctcctgaagtgctgggattgcaggtgtgagccaccgtgcccagcctgcattttcaacatagatgaaacagtctcttttggaagcagatgccatctaggactttaattcctggcttcaaagctccaaaggacacttcgattctgttgttagagactaatgcagctggtgacttgaagtggtttcaaaatcaacgcttattaccattcctaaaatcctagggcccttaagaattatgttaaatataccctgcctgtgcagtatgagtggaataacaaagccaggatgacggtacatgtgtttgcagcatggtttactgtacattttaagcccactgttgagacctactgctcagaaaaaaaagattcctttcaaaatattgctgctcaattcagtgctttttcttggttgataaaaaacaaacaactaaaatattactcctggctgggcttggtggctcacatctataatcccagcactttgggaggccgaggcaggtggatcacctgaggtcagcagttcaagaacagcctggccaacatggtgaaaccctgtctccactaaaaatagaaaaaattagccgggcatggtggcgcatgcctgtaatcccagctactcgggaagctgaggcaggagaattgcttgaacccgggaggcagaggttgcagtgagccaaaattgtgccattgtactccagccagggcaacaagagtgaaactccgtctcaaaaaataaataaataaataaataaataaaatatcactcctcgttgacagtgcacctaatcatccaggagctctgatggaaatgtagaagattagtgtttttatgccttctaacacaacatctgttctgcagcccatggatcaagaagtaatttcaactttcaagtcttattatttaagaaatacatttcataaggctatatatagctgtcatagatagtgattccgctgatggatcatggcacaaagcatactgaaaaccttctggaaagggttcactcttttagatgccattaagaacattcatggttcataggaagaggtcacaaccttatcaacatgagcaagagtttagatgaagttgcttctaaccctattggatgactttgaggggttcaagacttcagtggaagaagtaactgcagatgtgattgaaatagccagagatctagaattagaagtggagcctgaagatgtgactgaattgctgcaatctcataaaacttgaatggatgaggaattgcttcttgtggatgagcaaagaaagtggtttctagagatggaatctactcctggtgaagatgttgtgaccattgttaaaatgacaaaggattttaaaataccacataagtttattaaatcagaagtagagttcgagaggattgactccaattttttttttttaaatagtctcgctctgtcacccatgctggagtgcagtggtgcaatctcagcctactgcaacctctgcctcatgggttcaagcgattctcctgcctcagcctcccgagtagctaggattacaggcacatgctaccatgcctggctaatttttgtatttttagtagagatggggtttcatcatattggccaggctggtcttgaactcctggccttaagtgttccacctgccttggcctcttaaagtgctgggattacagacctattgactccaattttgaaacaagttctattgtgggtaaaagtgttacccagcagcatcacatggtacagagaaatcttttgtgaaaggaagttgatacagccaacttcgttgttgtcatattttaagaaatttccacagccaccccaacgttcagcaaccaccactgatcaatcagtggccttcaacatcgaggcaagaccctctactaggaaaaagattacaactcactgaaggctcaaatgatccttagcattttttagcaataaagtatttttaaattaaagtgtatatatttttcatgcataatgctattgcacacttaatagactacagtatggtgtaaacaagtataacgaaactttttttttttttttaaagagacagagtttctcccggtcacccaggcgagagtgcagtggtgcaatcatagctcactgtagccttgaactcctgggctcaagcagtcttcccattccagcctcctgagtagctggaactacaggcatatgccaccatgcccagctaataattttcatttgaaaaatttttttgtagagatagagtttttctttttggcccaggctggtctcaaactcctggctttaagccgtcttcctgccttggcctcccaaagtgctaggattataggcatgagccaccatacatggcctgtaaacaaaacctttttttttttttttttcttgagatggaattttgctcttgttgcccaggccgaagtgcagtggtgtgatcttgactccctgcagcctctgcctccctggttcaaacgattctcctgccacagcctcccaagtagctgagatcacaggcatgcgccaccacacctggctaattttgtatttttagtagagatggggtttcaccatgttggccaggctggtctcaaactcctgagacatatacctgttgtaaattggtatacgtcttttttgctttttgttttagaaacaggatcttgctctgtcacccaggctggagtgcataggtgtgatcatagctcactgcaacctcaaatttcaagattcaagcaatcctcccatcttagcttctgaagtagctgggattgtaggttcaccccgccatgcctggctaattttttattttttgtagagacagagtctcactatattgcctaggctgacatcttttcaaaaacagttttggaatatatataaaggatgttaagatagtaatattatttgacagattctactttggggacactatcctaagaaagtaatttaatatctgaaaagaaaacctgtagcctgataatgttgtaatattatttattatagtgagtaattgatttcagtaaaatatgatctatcagctcagtgcagtttgaaattatgaatgtaaagacttcagctacatgaaaaaatatattactatgttgaacaaaatacttaaaaaggaatacaattatatggactgatggttataggagtatatgaagttttcacacagttgctaggacataacttgtttgtctttagtgtctttttgacattgccaaaagcttctgacactacttttttaaaaatgtggcttaaaaaattgtcaagtaatgagcaaaacagagactctacttctgtgccttagtctcattgccagttgccagcctctgatttcaggtgggtgtgagggatggagggacaatgagggatgaggcagggctcggagatggtctaagaagtcacttgtatctcatgtgggtttcttctctcaaattcttgagtttctctttatagaccctcattagaaaagtcggttatgtgggcatcagtatgagcccttactcttgactccaccactgttagggacatcctcagtgaaatccctgacaatttcttcagtaatacatatgttatataacactcctttataatgatttttttggggaaagaatagtaattctttagatgctaacccagccggctgtaaacaaatcatggttctttaaaaaccatggctcacacctgtaatcccagcactttgggaggctgaggcaggtgaattacctgaggtccggataacagtaatgcatcctcataagagttcaagccagtaattaatgaaatacaaagccaaagtccccagaaatgagagatggtttgtgatgagagaggatctggggtgtctgtggtctgttacacacattacttgatgataaaaacagtgatctttactttggcttacaaaaggctcgtgcttcagcagagtgcagcaaaatgttccctgaccaaaacgactgtgtctgaagggcacagcttgggggaatacagctatgaaaaaaactacacgaggaacaaaaacattggatgaaaatagtggttgtatttggaaggtagaattataatcctccccttttctacgttcctaaattgtccataatgtggttatatttttttaataataaaagtccaatttaacaaatatttattggacactgcgtgtcagacacaatgcttgatgctggagatacaatgacccagacaggcacagtcactgcttggcggaacttcagtccagtgggagaggcagatgattttacaagtcattgtgacaccatgtgacaaacccacaatagaggagttcagagagtggctggattgtgtccgagtggtgcctaacccaaacgggttgggaggaggtcccaggaaaggcttcctggaggaagaggtgactaagctgggacctgagggctatataactgaagattggagtgaggagtgttctaagcaaaagaagctgcatttggcaaagcttggaggaactgaaagtttggtgacactggagcatagattgagcatgagaagggagtggtgagagatgaggctggagcttgaagtaggaaccagatcacaaaggactttgctttcttattaaggaatttggattttgtcctaaggcggtgtaaagctattggaaggatattcatttgcttgcctgcttgctcacttatttattcttccaaatttgttgtagaaactcaaataatatggaagcatgaaacatgaaaagtaaaagtctccccttctctacttcacaccctccccccagttctaatccccatggtacctattgctaagtgtttcatctgcaccctttctgcagttttctgggaagtatatgcaagcgtgtgtgtgtatatacatattttctttctacacaaatggaatcatgctatactgaataactcccatcttaaaagcaaaacttgactgggtgcagtggctcacacctgtaatcccagcactttgggaggccgaggcaggtggattacctgaggtcaggagttcaagaccagcctggccaacatggtgaaatcccatctctactgaaaatacaaaaattagctgggcatggtggtgtgtgcctgtaatcccagctacttgggaggctgaggcaggagaattgcctgagcccaagaggcggaggttgcagtgagccaagattgcgccatcgtactccagcgtggctgacagagcgagattctttctcaaaaaaaaaaaaaaaaaaaaggcagaacttgatacaccttaggtatctttctatgtcagtacctaaagatatatattctttctaatgacagcagcacagccatttatgtagctatcccatcatttatataaccagtctcttattgagagacaattagattatgtctagtttttcactattacagaggaaaactgcagggaacattcttgttatgatatcgtgttggatatttacataagggtatttgtgagatatgttcctagaagtaaaatagctgggtaagaagggttgtacatttaaaattaaggtagatattaccgtattattccctgttaaggtgatatcaatttctactctcaccaacatatgagtgtctgttctttcatatactcttccccactggatatatcctttttttgatttctattttttgagatggagtctcactctgtcacccaggctggagtgcagtagtgcaatcttggcttactgtaacttccacctcccgggttcaagcagttctcctgcctcagcctcctgagtagctgggattacagctgtgcgtcaccatacccagctaatttttgtatttttagtagagacggggtttcaccatgttggccaggctggtcttaaactcctgacctcaggtgatctgcccaccttggcctcccaaagtgctgggattacaggcgtgagccaccatgccccgccaatatatccattttttaaaaaaactgtggttaaaaaacacataacttaaaacttaacatcttgatttatttttaagtttacagttcattagtgttaagtatattcacattgttgtgtaaaacagatctccagaactttttcatcttgcaaagcagaaactctgtacctattaacaactccccatgccacctcccactagctcctgaatcaccattctactttctgtttctatgaatttaactattctaggtgtctcgtacaagttaaattacacactatttgtctttttgtaccagcttatttcacttagcataatgggtagaaacaagtcacaggtgttgcctctactcaagggcggggattccacaaaggcgtgaacaccaggaggtggacatcattgtgggataccttggagtctgtctaccgtaatcttccttgtatattccaaatattttctccatctagtagtttttgtttgggagttttatgctctaatttgtatgagttaaatgtgttggtctttctgtgactgctgtgttacaatttctagtatgtttagagtggccttaatcatgccaagatttcttaaacattcacccgtttttcatccatattgtattctaatgctattattactttggaatttattttgatgtgagatttgagagagggttcccattttttttttcctctgtagctaatctattgtctcaattcttgaataatttcttttttacatagcttgttctgttttttactgttttttttcccattgatatggctacctattcctctgtccatttccacatcagtatattattgtaactttgtaatatgttctttgattttacttttagttatgtttttaggcagatacatatgaacatacattcatgtggtctaagattaaagataagcaaaaagtgcagtgaacagtatcctctccatctctgtcctagccacccagttcactccccacaggtgcaaccactgttgtcacgtttatttattccttcaggaatattttatgtatgtatcagcaaatgtgaatatatagtccacctcatgccacacttttctctgaagatagttgaccatacacatgtctgtaccttgcttgaatgaagttaagtgaataaagttaagtgaataatacatcttggagatcttcccatgtcagttcacaaagtacacctttatctgttttaaaaattagtacacagtattcttttatatgactttgtcataatttattcagctagttccctattaatgaacatttaagtaatttacagattttaaaaaaatatataaacttattggccgggcgtggtggctcacacctgtaatcccagcactttgggaggccgaggttggtagatcacgaggtcaagagatcgagagcatcctggtcaacatggtgaaaccctgtctctactaaaaatacaaaaaattagctgggtgtggtggtgcgcacctgtagtcccagctactcaggaggctgaggcaggaggatagcttgaacctgagaggcggaggttgcagtgagccgagatcgcgccactgtactctagcctggtgacagagcgagactctgtctcaaaacaaaacaaaacaaaaaaactatgcttcaatgaacaacattatgcacatacagtttcatacatatacaggtatagctgcaagaaaaatgactagaagtgaagttgctggggcacaagcatatgcatgtgtagttttagtagatattgtcagttcaccctccctagaagttgtacattcctctctgctgtatatgaaagtgcctgtttgcccacatcctccccaactcagtgttttgtcaaactgtttgatctctgttagtctacatagtagaaaaattatgtttctgtttagttttaatttgtgcatttttcttatgagtaacgtgtgttttttcctgtttatgaaccatttgtattatgtttaccgtgaacaatctgttcatatcttttgcctttaattcttttgtgtggttgatctttttcttactgatttttaggagtttttatatattagaaaaactagccatttatctgtgatatgagatgtaaatattttccacatttgccacttgtcatttgactttctttatactgaaattttttttctaacagacattacaattttttcatgtatcaaaagttaatgttggctggatgcagtggctcactcctgtaatcccagcactttgggaggctgaggtgggtggatcacctgaggtcagcagttcgagaccagcctggccaactgagtgaaacccccgtctctgctaaaaatataaaaattagatgggcgttgtggcaggtgcctgcaattccagctactcaagaggctgaggcgggaaaatcgcttgaacccgggaggcggaggttgcagtgagccaagattgtgccattgcactctagactgggctagaaggatgaaactccgtctcaaaaaaaagaaaagttaatgcctttttggttgctcccaggttttttgttatagttagaaagttatcttcttttgtttttgctaacactttatacctttattttcaaatataaaatctttgatccatcatgtgcttatgccagtgtaaggtatgcagtgtgaatctggcttattttttttccactttgctagctagttgtctcaacactatttatgaataatcatcttttctccgatagtttaaatgctacttccatcataaactaaattctcatagtttgattggattttgagacttcctattctcttttattaatctgcgtgtctattcatacaccagaatcacactattttaattaatgattatagcttcatattatattttagaaacctggtaagattaattcactttcatgctgcttttcggtgatttttctaggctattcttgcatgtttatttttccagatgaactttatttatttatttattctctttacaccagtgttactgccaaccaaatgaactttaaaatcggcttgttgaggtctttttaaaaaatgcttttattattgggttttatgcagctaaggatatgatcagatttgtgttttaggaagattattctgactgcagggtagaactaggttggaggaaacaagattagagacaaaaagaccaatgacaagattgttgcagtaatccaggggagaatggatagatgaggagttgaggatagtattgggttcaagaggtgtttagaaagtcaaaatggccaggtgcactggcctgcatctgtagtcccagctactcaggaggctgaggtgggaggaccacttgagcccaggaaattgaggccagcctaggcaacacaatgagactccatctctaaaatataaataaataatacaatacaataaataaaaataaatagatggtcaaaatgaccagacttggtgatgactgagatgtgcagggatgaggaggaagcactcaaggatgaccccaaactttctgggttaggccgtcgagtggcgccattcccagcgatttgaaacacacgagataggggctggtttaggaggaagatggcaaattcacttctaaatatattgagtttgaggtgcctgcaggtagtcctagaagagtgtggtccagtgggctgttgaatgtataagtctgaagctctggagagacatctgggctagagagatggagtgatatgacagagccctgaggaaccccagcactaaaggatggtcaggaagttcaggagtgtgcgaagaagactggaaagaaacactcagagaggtaggagaaaaatgggacggcatggagccccaggagccaggagaagaatgttttcaatagagcaaactgtcagtaatttccagtgttccaagaggtcaggagctgaaaatgcccatttggatttagtagcgtgcaaagtctgtggttatcttgggaaatttcggtggagcagagggatgggggctgaggtctgtgggagttgaggaagtggagttgaggcaactccttcatcacaaagcttggctgtgaagaggagagacaccgggacaccggggcaaggaggaggaataggatgatgcagcaagttagcgacttttgtgtctcctccttccccagctttacgtgggagaggctgggccatttgtttgttttttgttttgttttgttttgttttgtttttttgagatagaatattgccctcttgctcaggctgccatgcagtggctcacactggctctcctcttcccagctgtggcacatcccagcggcagttaatcttgccactttcaatctccccattaccattataagtgctgggattacaggcaggagccaccaggcccagcctttggcccacatttaaatgcagatggaaagagctaatagaggagaggaggaagcagtctgtgatcctgttctttgaggaccaagtaatactgagaaggatataaggggttggagaagttggccaaatcagtctggcagagagtaagtcaattatagtgttggtatatgttccctgacagttttgacttttaattttgttgagctgtctaatatttttgcttggctattttgagaaggagcctctaagaaattggattcaggtttagaaatttagttgaagattaagtttaaaaagtaaggtacagacagtgtatcagtaagttaccatttgtgtaaaaagggaggagatatctgcactcccatgtttattgcagcactatttacaatatggaatcaacctaactgtccatcaacagatgaatggataaagaaaacaggttatgtatacacaatggaatatcatccagccataaaaaagagtgaaatcctatcatttacagcaacactgatggaactggaggccatttatgttaagtgaaataagagaaagacaaatatcgcatgttctcactcatatgtcggagctaaaaaagtagataccacaatgacacacagttagattggtggctaccagaggccaggaaagggagagggggatgaaggaagaaaagggatatttatttatttatttttaaatttttgagatggagtctcgctctgctgcccagactggagtgcagtggcacgatctgggctcactgcaacctccatctcccggattcagcagttctcctgtctcagcctcccgagtagctagtagcttggattacaggcgtgcgccaccaggtccagctaattttttgtatttttagtagagatgaggtttcaccatgctggtcaagctggtctggaactcctgacctcaggtgatccacctgcctcggcctcccaaagtgctgggattacaggcatgagccaccgcacctggccaaatgtatttattaccactgaactgtacatttaaaaatggtaaagatgggctgggcacagtggctcagccctgtaatcccagcactttggaaggctgaggtgggcagatcatctgaggttaggagttcgagaccagcctggccaacatagcaaaaccccgtctctactaaaaatacaaaaattagcgaggcgtggtggcatacacctgtaatcccagctactaactactcgggaggctgagacaggagaattgctcgaacccgggagacagagggtatagtaagctgagatcgcaacattgcacttcaggctgggcaacagagcgagactccatctcaaaaaaaaaagaaggtaaagatggtaaattataaatgcatgtatagagttatattatacacatatgtttaataaagagcagcagtaatatgtattcttatttgctgtacatgcataatcagtatttcaaaggactcacaagaagcaaaaaatctggtatcgattgtgaggtgggaactgggtcgaaggggagcgagaattgaggatgccttgtcactctccactgttatatagggtatttgttgagaatgccaatatattacttatttaaataacgtgatgtaaactgtttagttatctttaaaagtaatgattacaacagggcctgaattttcttatttactaatgattctaagcatctgtaatctgtctgttctgtgtctaagaagctaaatcttgctgtgtgcctgtgaggtgtggatctttgcctgtacagttggtcctccattatctcattatctgagggttggttttgcatatgtagattcaaccaattacagatcaaaaatattagaaaaaaaattgcatccttactaaacatgttttttctttgtcattatcccctaaacaatacagtatgacaactatttacatagtatttgctttgtattaggtattataaataatttggaggtgatttatagtatatggaaggatgtttgtaggttacatacaagtactgtgcccttttatatcagggatttgagtatgcatagattttggtgtctgtagggggccctggaaccaatccccctgcgtactgagggacagctgtgctccactcttccccactggggaccgacagccttggggaagtggacagtcctggttcttgggtcaaggaagaggaccatggcctggaacatcctggccctatccactatagcttgaccgagtgggctctaaggctggtttatagggaaggaaagaggaaatggggtagtaattattgtgtcataggcaaaagcctcacactggctgtccccttcccctgggaaaaaattctttagcatttctctgtaaatttcattgtgattttagagcatgtgtctgaatgattacatggagtaaacgtatttcactttttttttttttttttttttttttgagacagagccttgttctgttacccaggctggagtgcaatggcacaatcttggctcactgcaacctctgcctcctgggtttaagcaattctcctacatcagcctccccagtagctgggagcacaggcacccgccaccatgcccagctaatttttgtattttcagtagagacagggttttaccatgtttgccaggctggtcttgaactcctgacctcaggtgatccacccgcctcggcctcccaaagtgctgggattacaggcatgagccacctgcccagacacgtattttacttttaatctctagttttatattacatgctgattgcacatccccactcaggaacatcagaagaaatacaaaaagaggaaatatttcaaaactttgaaatcccacaaaaataatcacattcactaataaatatttctccttatttattttttagggtaccaggtaaggagactctccagtttagttaggactatgcctaatctgagttcccataaatcctcaaatgaactatatatgttattcttctggagactgaggaagctggttaatcactgttcccttgtctgggttctcaaaggttcagcactgaagccgggagccaggagaggatagcattatgacctttactcctcagtaactcctaaggctcacagagtggttagttttccctcccctgtctgtaggcaaaagtggggacttgcagataggaagaataggcttccttagtgtcagtcccgctggtttttcttcttcttcttttttttttttttcctgagacgagtcttgctcgctctgtcacccagactggagtgcagtggcgtgatcttggctcactgcacctctgcctcctgggttcaagcgattctcctgccttagattccagagtagttgggattacaggcacgtgcatgaccacacccagctaatttttatatttttagtagagatggggttcgtcatctggccaggctggtctcaaactcctgaccccaggtgatccacccgtctcagcctcccaaagtgctgtgattataggcgtgagccactgcacccggcccactggtttttctgtttgtttgacaaaaggaatgccagaccaactcagtctccaaacaagcgcccagatccagttatggctttaactgagattaaatggagaatctggtttcagggaccagttcttccatttttggtagcttggttcgttatggagactaaagttcttaccatgatgaattaaaaaaaaaaatttatttttgtatttttctgctgtttaaaccatgatgaatttttagcaacctctcatctgggcagattctcccaagagatagtgaatgcttaggaacactttacagctcagcctaagggagaacatatcagaagcatggctggatgagaaaggagtggcctgcctgggaaagtactccgttcccatcttcagaggggtctggtggcggctagatggcctttggtgaggatgctgtctggttgcattggctggcccggaagatcattccaaactctgtggcttatgagtccagacagaacaggacaaggacactgtgtgtgtcttttcatgagctagtggccagatgaggaaaagtaccctatgctcttttaaataaaaaacaggatgtaagtttttttaaaaattcaatatgctttatttagaattaccatgtgctttatctaactaaatattccagagcattttattctttccagacatgttttctcttatactttcctagttcctttgtgacatcgtatgcttattttgtcctttaaagttatcaacagtgtgaaaaaaagttgttttgttggctggctgtatggtagaaaacacagccttcatctctttttttggcatatatgtagaagttattgagttaaaactgaaaaggcacctttaatttatgacagtatcataactttaattaaaaaatcaaacttgttatttggaaatgtaaaatcttccccaaagtagaataaagaacccccatagactcatcaccagattcaatatttttcaacattttgccactcttgtttcatctgtcccctcccctttgttttttctcttttaattccaaattacaatctcttctaaactcagtgaagtgtcctaccaagttgaatcacagcggtggatctggtgtgattcagaatgcagtgggggtgaaaggagggagtcggcaggctgacaggtgcctgtcttttacatatatttcctacggcaggaagaggttggtgtgggatgaacagaggctcaggcactttgtctcctttcctgcttggcctgaagtgcctacctgacccttgtggcctccaagggtgcctttggccagttgccttaccagccactaggccggactcctgccactgctcaagtcttagttgatcaaaagccagttcttcccttctgcagttcctttctatcaccataagaagcaaatcagcttcctctggaggagataaatgggcaaacctgatttacccagaacatatttctctagtcattgtcttattagcattaaagttaaaaggagaactacactcaacggaaggcctccctcaccacccaaagatatcacaccaggtggggaggtggggatgggaacaggcagtttaaaacttctacttctgtggaggcttgggtggcgctctgtggaaagacagtaaagtgcctttagaggcttgggtctgcattcaccctgctatgccatccctgagaacttgaagctgaaattcttcattttatcgtggaaatttgtagctgtacagaaaagtaggagtagaataagaagctcccatatagccctcaccagtttttaataacgatcaacactttgcatttaaactttttgattatgcagcctagtagtaaaaagagttttatatccccaatttgggtatgttctttgttttttaaattatgtacatataacactgtattgttaatattaagtatacaaaaaaatagaaagctaagtggaaacagaacttctaatgttttccccataccctatgccatcctgtaaatcccctgggggtacacattcctctttggagccaaatcatttagaaacattatgtaattcagcaaacacgtgttggagcccactgtgtggctgacgctgtgcaaatgctggagggaagatgctgggggaggtctcactgcttacagcctgctccatcagggtcagggaatgaacatgatccatcttctccaggtgagaagctctgcctgagacatagaccttattctctgccttttcttgagcaggatcccccagcatgaactctgggcgtgttttatgcattgtcgttatttcttcttctttttttttagagatggggtctcattatgttgcccaggctggcctcctattcttgagctcaagcgatcctcccacctcggcctcccaaagtgctgggattacacgtgtgagccaccaccacacccagccattatttcttattttgagaaattattttgcctggccctctgtgatcattttgattggtctgattttgactttacctgctaaaaacaaaacaaccccaaaactgttttatctctatcattttctggagtcaccttttaacttagtttatctgttaactttacttcccttttatctttcatttaaaaatacagactaggaaggggcaacacaagggccacagacatggtgataggccaggtcctaaatcagcaggttgggtgctggtgccttctctggtctgttctgctcttcatctcttcttttcatgcctcacagcaagacttatttggtcctttggagaagattggatccccagatcagctggtcaaaaaaggcatagcctccaggttaaaaacaaacaaaaaacccatctaggtggttcaagggctctgaaagtctaatcacttctgcgagactggaatagactagccccaaagatagtgtagtgctggcaggctgctgggggaaaagccttccaaaacccagaacagctgggagcctcacaggagttttgtgaactgaagcccctgcctgctggcatacctaagcactgcagagggcaaaggaagagtgttgggggctgctgtcagagaggctggctgggtgctggcaggtctgacgctggagatttgttatacattttgaacttctcttgaagtttctcttttcttttttttttgaatgatgttataatagggtatttaaccaagtatgacatccttttttattccgcttagtttgtaaggtagacttaaatgatccatttaaccccaaggcagtgtgaattaatagcagcccctttgttgtggacaggccttcacgactcccccacttgtcatgagaatcaaaggaggtgctggcagtgcctagaatgatctccagctgggttcccaagagaggcacagttgttcctttgttatttagacttgtcctttttaaaagaggggggctataacatcttccattagcttcagtctgcatataaataaagagccctgcaagcttcaggaacctgccttacttcctaaacttgataaatttccactcttcaccaacgctttttttttttttttttgagatggagtttctttcctgttgcccaggctggagtgcagtggcacgatctcagctccctacaccctccacctcctggattcaaacaattctcctgcctcagcctccccagtagctgggattacaggcatgtaccaccatgcttggctaatcttgtatttttagtagacatggggtttcaccatgttggtcaggctggtctcgaactcctgacctcaggtgatcctcccgcctcagcctcccaaagtactgggattataggcatgagccaccgtgcccggcccccagcagaatttttaaaaaagagttgtggtctcattatgtcgtccagggtggacaccaacagaaatttatttagtactggtggccaatctgtcgcacatttgtcaagaactaaagaagtaaactaaagaagaaccaagcagcatcatgggcaagctggaggcccagtagagctaagtgatgagtttaaggatgccgttagagccaagcattaacggcagatagggtagatagacactaccctatctagtgtctctactaccagctacgtttccaaccagtctcctctcctacccaagctctgttggaaacagatacaaacccaagtatacagaggaattaagaagggttggggtagcattttaattctatcagaggaagcattatcgtcaatgaatagctttgtgacttttagctaaccgtttacataaatattaagttagatacttactccaaatgagactactggagccaacgtcaatttgtaggtgtgccgtttgtattgcatcatagtcaggtgtcttagcaagactgttaacctgtaattgaatcttaaatcttcagtggatttagaagaatgtaatacaatttatctggagaatttctttttcatttttcttttttgaaacaacaaggtctcgctctgtgccccaggctggagtgcggtggtatgatcatagctcactgcagcctccacctcctgtgctcaagggatcttcccacctcagcctcccaagtagctgggactacaggtgtgtgccactgtggctagctagtttttaaattcttagcagagacaaggtctggctatgctgcccaggctggtctcgaactcctgggctcaagcagtcctcccaccatgagctcccaaagtactgggattacaggcatgagccatggtgcccagtctggaaaattccttaatatttttttttttaacttctgtatatatcagtacaaatctgtgtaaaatctcaaaaagaattgattttatgtaggctatatagcaaaggaggcaaagcggtgaggtaaagagaatactgaatgaggctcgggatcctgagttttagtttttaggctgctacaaactagctctgcaatcttgagaaaaatcacttcagctctctgtaccttggtttcccatctgtagaaggaaagagcagaattccactccctcttgcttttacttgtgttgctttctctgctaagccagcaactccagttcccttcctttgcctatccccaccttattttcacctactgcaagctggaaaatgagatgcctcagtttgttagacctgggtggggtgtgatgcagaactggaggggttcctttctaactgctgtcctctggggttcttatccatttttgttatttaggggctttctttgctttctggctcaccactgagatggttgaaattgccacataaatgacccctggctcaagctagcacattgtcctcatagcataaaataatggtgacatcacattccggtgcagtcctctgtaatattgaagcttcatgcaagtacccattcccagtgttgacgatggtattccaggaaaatatgtgttgctcttgcaggagttttatcactttttttcttgatcacgagtcatcatgaggtctgtcattgaagctactaagagttgtcttatgtagaattgcttctgtttgagaatatcgattaggcacccctttgtacagatgctgaggttgtggtattctggatcaatactttttcaaagtattaaccatttatatgcttaatcctggttttctgcatgtttttaatatattttttaaaacttggtagaacttcttttttttttttttttttttttgagatggagtctcgctttgtcgtccaggctggaatgcagtggcacaatctcagctcactgcaacctctgccccctgggttcgagcaattcttctgccttagcctcccggtagctgggactacggactctcactaccatgcccagctaatttttgtgtttttagtagagacggggtttctgttggccatggctggtcttgaactcctgacctcatgatcacccaccttggcctcccaaagtgctgggattataggtgtgagccaccgtgcctggccctgtagaacttcttacatggaaggatgtatttggtcataccattagcatttagaaacccatatttcacttcaaggtatttggaaattacatttctcctgtttttaataactgtataaaaatacaactataagctaggatttattttgctacttagctgcagaagaaaaatgtatgtcttgattgttcacacataaagaatatactgtaccatatatgcttttgataatgataatcttcctagttgataataaacaacaactctccaattcttggacttcagctcatttcctaacttagcgtgggcttatgtaggaatctgcttatggtttaccagtcaagtaagatctggggtttctaattaaccacaaacataatgatatgccaacagtacagtacatctacccaaacagttaatgcaaatgtaggtcacattgatagatcaatagtgtctaaattagaggaagtaatttcccccctaggtgacgaaatctagttgcaacttttcagccattcatcccaggctgcagctttcagatgctatgtgataggtaggtgtgcacctacacgtaactgatatctcatctaactgagctctaggtcccttggggaagtactccgggagtatggtactgtctgccgttagctctaaacttctacctggaaatccacaactctgcttcttttggaagattcacacgtcctgtttcattacagaaagagttctgccgttagcattagccatgtcactcccctccccggtctatctagcactggatcccagacactgatgtggagaaccatttctgtatggaggcacagaagccttctcttcctcatttgatgtctaggtcccatgttctgaaacagtagagtgcttttcagatcctgagcctaaggccctccttaaaacacatagagtcctatttacaggttcgtttctttcttgcttgctttctgtatttatttactagagacaaggtctcccctctgtcacccagtctggagtgtagtggcaggatctcagttcactgcaacctctgcctcccaggctcaagtgatcctcctgcctcagcctcccaagtagctgggactacaagcgtgaaccaccacacctgacaaatttttgtattttttgtaaagatggggttttgccatattgccaaggctggtctcaaacttgtgagctcaaatgatccacccacatcagcctcccaaagtgctgggattacaggcctgagccactatgcctggctcccatttgcagattcttttgacttacacctcccttgttcttcaagaaaatggggccaggcacaatggctcatgcctgtgatcccagcactttgggaggccgaggggggtggatcacttgaggccaggagatcgagatcagcctgggcaacatggcaaaaccatctctactaaacataaaaataaaaaaattaaaaaattagccaggcatggtagcacatgcctgtaatcctagctactcaagaggctgaggcaggagaattgctcgaacttgggaggcagaggttacagtgagctgagatcacgccactgcactgcagcctgggtgacagagtgcgactctgtctcaaaaaaaaaaaaaagtaagaaaaatgggactctctatttcattcagtctctctctgtcatcactaccatattagccagctttgctttagtaacaatccaaaaactcagactctcaacaaacatttatttttcactcatattacttgtccgtggtgctggaataccttctacgtctctcctctgtgtatcttctccatctgcaactgaggctgaaggagcatcccctacttaagacatgatagtctcatggcagaaggaaaagagtatgagagtttctgtttgaacaatatgaacatcacatttgctcataagccattggccaaagcaagtcacatgggccagtcaactttttttagccattcatcccaggctgcagctgggtgacgtcagaggtgacttggaatggcaacagatggtgcctgagctgtaggaccgttggggagcaccgtgggaggctcagaatgctggggcagtccctaatagtgatgctgctgctcctgaccacgaaaggactctgcaggtcagccccacctttgacaagatgcttcccagggttccaccatgcagacactcatcctcctttccaatgtccgggtatccctgggacaagcagctcttatgtatgtaacatcattttgtcttctcaacaagcctgtggaagttattatcatttccactttttagataaggaagatgaagtaacttgttaataagtggaacatctgaacttgaactgtttctttgactccgaatcatatgtgtttttggggttttgttgttgtcgtcgtcgttatttttatttttattttttttctgagacagagtcttactctgtcacccaggctggagtgcagtggcgcgatctcagctcactgcaacctccgcctcccgggttcaagcgattctcctgcctcagcctcctgagtagctaggattacaggcatgcaccaccatgcccagctaatttttctatttttagtagagatggggtttcaccgtgttgaccaggctggtcttgaactcctgacctcatgatccacctgcgtaggcctcccaaagtgctgggattacaggcgtgagccatggcgcccagcctgttgttatttttaagagacagggtcttgttctgtcacccaggctggagtacagtggctcaatcatagttcactgtagcctgacattcctggggtcaagggatcctgagcctcaacctcggcctcctgagtagctagcactacaggtgcacatcaccacaccagctaatttaacaaaaatttttgtagagacagggtctcacactgtgttgtccaggctggactcaaactcctggcctcaagtgaccctcccctttggcctcccgcaatgctaggattataggcgtgagccactacaaccagcccaaatgatatattctttgaatggcaacgtgcaatgtttaaaatactggccgggtgcagttgctcacccctgtaatcctagtactttgggaggccgaggcatgtggatcacttgaggtcaggagttcaagaccagtgtggccaacatggtgaaacccagtctctactaaaaatacaaaaattggccgggtgtcgtggcttgtgcctgtaatcccagctactcaggaaactaaggcaggagaatcgcttgaacccaggaggcagaggttgcagtgagccaagattgcaccacactccatcctgggcaacagagagagactccatctcaaaaaataaaaaaattaagtaaataggctgggtgcagtggctcatgcctgtaatcccagtactttgggaggctgaggcgggcggattgcctgaggtcaggagttcgagaccagtctggccaacatggtgaatccccatctctactaaaaatacaaaaaaattagccgggagtggtggcatgttcctgtaatcccagctactggggaggctgaggcaggggaattgcttgaaccaaggaagtggaggctgcagtgagccaagatcataccacttcactccagcctgggtgacacagcaaaactccgtctcaaaaaaataataataaaataaataaaagaaaatactgtatgtactctgcagatataaccatgtaagaacttacatggataaaacttgaaaaggagtagaaaaagtgaagtgcttggccttttgagtggcacgtagtatttctttgtcacccaggctggagtgcagtggcatgatcttggctcactgcaacctctgccacctgagttcaagtgattctagtgccaccatgcctaatttttgtatttttagtagaggcagggttttgccatgttgcccaggcagatctcaaattcttgacctcagacgatccacctgcctcggcctcccaaagtgctgggattacaggtctgagccactgcacccggcccagacttagctccttcagtttctggcttccctaactgaacagccactctaattcatttgatgaggaagatctttgagaagtaattgagaaggttaagccaaatatagtttggagtaagatcagatactgcaggggcagagagttgagattaggccacagtgaagaagagaagaaaatatcaaatgtaagcagagattaacaccccacaactgaataccagcagtaatacaggatttgggccagcagcagggttaatgcaaaagaggcagctgttaaatcgaaaataagagcttttgttttgttttttgttttagagacaaggtcttgctctgttgctcaggctggagtgcggtggtgtgatcatagttcactgcagcctcgaacacctgggttcaagtgatcctcctgcctcagcctccccagtagctaggactacaggtgggcaccaccacgccccactatttttttttttttaatttttttttgtagaagtgagggcttgcagtgttacccaggctggtcttgaactcctggcctcaagtggtcctcccacctcatgctcccaaagtgctgggactgcaggcatgtaccaccatgcctagctaatttgtttgtttgtagagctaatttttctttcttttgtagagacagggtctcactatgtttcccaggctggtctcaaactcctggcctcaagcaattctcccacctccgcctcccaaagtgctgggactctagacaggagccactgcacccagctagaaaatttaataggaagtctaaaagacatttcaggaactctctgcttttgggaacgccttctaaagacccttctccccaccttgtggactggccttcaggagcccagtttggcagtaattgtgcagtggctcaggcatgtaatcccaacactttgggaggccaaggtgggtagataacttgaggtcaggagttcaagaccagtctggccaaaatggcgagaccttgtctctacaaaaaaataaaaatgtagccagcatgttggcatgcactgtagtcccagctactcaggaggctgagcctgggaagtggaggttgcattgagccaagattgtgccactgcactccagcctgggcaacagagtgagaccctgtctcaaaaaaaagagatcctgtgtcctcattgcatcttgccaagaagcacctgatgtcagtttgtcccattatttttcaggtatttcaatatattattctctagaatagagtattccattgtctgagataaatctagcttccctatatcatagtggctatttttcttccagcccagaagtttttccttggtaagataactttattttgtgagtttatagatttggattataaaaatagatcggaactgttagactaatttggcccagagattttatgagtccacttgggagaaataggagtaattctcaaaaccaaaatgagaaaatccatgtttaacaaagaaaaattagtttttagctgaaggaagtcccctataaaaacattgcgtcacaggattcctttcacagtaagctaccaattttatatgtgactcaattgacgtaaaactctgttttaaatgaatagtatgtgaggtgatggatatgttaataacttgatttcatcattttgctatgtatacatatatcaaaacatcatgttgtacagtgtaaatatatacaatttttctttgtcagtaacaccttaatgctggaggggatgggagaagaaaatctgttttctatatttcacaagcacatctattgcacaatgtatacacattgcctcattatgtgagatttattggcccagcctaggatttggcttttgacaaccaaaaaggttgccctttgtgataccagtctcaaaaatgttaagaacgtaccccaagcatctctttaaaaaggattttggatttattgaccatgaatttatctacaatctgtttctgctttcatttgtatcatttagggactgatgatttgtatgttttccacttgtatttacatagcattccttttttcctctttaactcaggggttacacactctgaatgtctaaaatgatgagtcagtgaaatggtttgtgtgtaaggattcatagtaagagagtgggtgtcccatctacagggagcagccatgctcaacttgagcctgagatgagtgcggctcattgtggccaagatattttgatttatgggtgggtgcggtggctcacatgcctgtaatcccagcactttgggaggctgaggtgggctgatcacctgaggtcaggagtttgagaccagcctggccaacatggtgcaaccccgtctctactaaaaatacaaaaattagctgggcgtggtggcgcacatctgtaatcccagctacttgggaggctgaggcaggagaatcacttgaacctgggaggcggaggttgcagtgagctgagatcacgccattgcactccagcctgggcaacagagcaagactccatctcaaaaaacaaacaaacaaaaaaaattctgacttttccctagaatcctcaagtctgaattttcaaacattatgaattcaatcaaaaattttaaaagacactgtgcagaacaaataggtgcctcgtggcttgccagtttctttctttaatatacctcttttacatttcaaagtgtcctttctagttttctgggatttagtatatgagttcaccgtcttctgattctcctcccccaattgcatgacaacttttattattctttcagctttcctcttaacacactacagattatttgtcattattttatggttattataaagaaatagttccatatactactttatttaccttgacccaaggcccactaatgtataataagtaaaactgtaaaatcggtcctttcatctcctgttgttatcagttgttcttgagggtgagtgtcaatttcatggttggaggccaactcttcttcccttctctctgcagccgtcatttcaccaagctgataatgttcggggaacccgccatcacgggctggtggagaggccatccaggaaccgcttccaccccctccaccgaaggtctggggacaagccagggcgacaaatatccttttttactcttcaaagggagtgtgcattctgaaatgtttgaaaagttttcaggatttatcttccctgcaattctcctttggcctcagaatcttcatttatctgatgaaaggaggcaatacaaataaatgagttggaaactagaaacatctctgcagtcaacatttggaaacatcattgtaggtgtttatgaaagcatcaataaagttcagtttaatgaaataacaacaaaaacaacctgtaattcggtcccattgcagggtgttctgagcattttctccagaaattggccacgttagagttaaacctgactttgaatcaggttagagagccttagtctctttagcaaaaatggacatagagatatgtgatttatttgtacttcttttgatctgctgacctgcttttggaacttacagacaaaatttcatattattttctatttgtgatgtttcaaactcagtaagtgataactaaaataaacctagaatataggaaaatctcatgcagtgatgtacagtcacaccaaactctgctgttaagtagaaataaaggaaaggaaatggtgaattcacctgacagtttcatttaatcagtcctgtttacagggcggcagtggtgggtgcagctgtgtgaccagcattgtgccgaaggctttggggaacagaactgagctggattttttgggagaggacacagaagtgtgccaggagggcccgtgctctcacttcattcttctcagtactcgggcgcaggggtggaggaaggagaagaaaggcggggtgggtctcgctgcggagagctgaattcctggcagtgatggtagagttggcttcacaagcctagaaaccaggaagtgggggcagggcactcatgtttactgagcacctacccatgccaggcgctgtgctgggtaatttatgtgtcacttagtcctcaaaaactcactgagtcgttaatttttttaaccctcattttctgatgaggaaactgagtgtgtggtgaagtaacccaggattcagaccaggccccgctgatggcccagcctgtgctctcccctccctatgccacctgcgaccattcgcagtgatgaggaccttgtacaagggagccaggagttgtgggggcactctagggaaaccccaacttttcttgccttcaagcttcttgcagtttttagtctatttggaggcaaggataatgaccccagggaatgtttttctctcccctttctcccgcccccaggaacacaccacatttggtccacagaaggactgacttctgattttgtatattatgtggctgttatcaaggaaagtaaagatgataaatgatcttgagaatctattctggaatgtgtgataactttgacattgaatgaaaaaggcaaaaggaaatggaggcaattcatcagcaaatttgtacatgtcaggatggagtggtacatcaaaccgttgtccaaattgccaagaatattcaggcaaaagacttggagtgtttctttgattgatttaacaatgtattttttttggctgggcatggtggctcacgcctgtaatcccagcactttgggaggccgaggtgggcagatcacgaggtcaggagattgagaccatcctggctaacgtggtgaaaccccgtctctactaaaattacaaaaaattagccaggctcggtggtgggcacctatagtcccaggctgaggcaggagaatggtgtgaacccgggaggtggagcttgcggtgaaccgagatcgcgccactgcactccagcctgggcaacagagcgagactccgtctcaaaaaaaaaaaaaaaaaaccaatgtatattttttcagttctcagttccctctttttcctgtcagtgctctcatttctatatattagattaaacattatgctatatatacgtgtgtgtatgtatatgtggctatctcagatacttttgaagtacggtctaaatgtataagcatgcatatagttttactaaccaaaatagagaagggaattgaagaaaaaagaggagaatgtttattcacttataaaaattatttgttaagtatgtgctagtggtcagacaccgttttagacattttaattcactgtaacagtaaacagcatggtccctgacctcaagttgcccagggttcagtgggagaggctactcagcaaacaagcagccacggcaggtatggcgtctgcagggaggcagctcaggggctgtgggagcacgtcggaggtgcagcttgaactagtctggggaaacgaagaaggcatcctgggggaacatctgaggcttgaaggataagaagtaagaggataaagtgttcattcagcagatctttacagagccccgtctctgtgccaggcactgttctaagcactggggacccagtgatgaataagggaggcatacttcctgctttcttgagttcacagtcctgtgggagatgacagcaaacaggcaataagaaaggaaaatggttttagatggtaatgagtgagatttaagagagtaaagcagttgggaggtatgttccaggcagagggaagagaatgtggtgcaaagtcctacccagaaggggagatgacttcttgtgttcaggggaccctatctcttatgatagggtataatctggcactgtatggatcaacttgagagcataagcaaagctagtcaactcctaaaggaaggagaaacaaaaaccaagttaatatgcagagaaattaaagttattagacagtatgagtcagattcactgatcatgagccatgtctctgtggtctcctaagctcctaaattgggttcctgggactggacatcggttgatgcaaagaaagttctttagcccagtctcttttgaggaatcaagggtccgtgaaatgggatgattttattttggtgttaatctattccacttggaggaggagggctgtgattccgtctttgctttcacgacctgcattctgttggttgtgaaataatctgcttaaaattgtggccttgaacatttgtctatgactttttaaatgaagtttcttcatttgaaagtataaaacactagtttgaatctttgttagaacaaaaggaaaaaatcagaattattatagctgtttcttggcttgggtgttatttaagacacactggcttagacaagggttttaagggttcactcctatgatagggtgatctcaaataaaacgaacattgtttaacaaatactctggcctcctctcagagtgggcagccacagcacgcagagctctgccacaggagattccttctggagtgggctttgcccttggcatgggtggccacacaagaccaaggcacagctgcagctgggccctggcctagccccacacaggcggaggagaggcactgccagggcttgctcctggctgggggcctgggctcgggcacttggaagagaagctcttctgcccttctgcagatgtgcagtctgtagcagcccttcttactctcactcatcaaggttggcagacgtgccgtgtcccaaacaccattgctaaacttctgaactattaacataaatttatagcaaataaaatattttctcagccttgtggatgacacgctcagaaggaaacacgaaatgccttccttgaaaggaagtcaagagttcaccagcgtgaagggtcgtgaagagatgcctaagacctactagagttaggaatgattctcctctctgggctgggccttgctttgattcttttcatcataatgagatgaaaatgttaggacattggtttataggacactgtttctttgagatgcatggcctattacatttgagaaacaccatactctgtatcacctcttggagcctgaccgtatatatcagggctctgaaaagtcctgcagttaataaacttcttatctttaacccagaatttcaaaacttaagtgatcacaaaatccaactgttacctaacacccgtcttatcttgaaggacaaggaaacattggtctttagaattttaagggggaaatattctgacttcacaataccacatgcaacctgtttgcctctcatttgctgagggaaacaggatgttcttataaatgcaaggactcaaaaagatgccactcatatcctcccttacagtttcactttaagatgtcttctagtgggacatagttagaggtaaagggacaaaaagaagtagaatgacaataaacacatggctgagcaatcaggaaggagccaaattgtggccagttttatatattaaatctgaccctgaaacttgtcttggtaggtgggttctgttaaccagactccgagcccacttaccccaccagctacatggaaggtctcaggcctgccccacaaactgtgtccctggcagaacacagagttccagagcaggagagaaatgactggcttccaggctgccccgacaaggcagttcctgagccctgcccaggtacactgaccgcacagggacgggaagccaagagaagggaaccctgggcctgctcacccagccgcaggtcaagcagcacaaagaaagggccagggcgggtcttgttttcagcttctgtggctcagtaaccccacccactggtaaactggccaactgatgtcctctcttatcagaagaagaagagctgctccccttcctttggtgaagagtaagaactgttccctctaacactccacaggttgagaggaacagcagtccctgtgttgatggattgaggcagtaactcgaggaggaagattttcctgcacagaactgcagaggcttggggagagagagaacacactgggatgactctgagatcctaacatgagtgtcttggtggacggtggcctcactaaatgagatggactataagaagaggaacagattaaggggacagtgattggttggatttttggtagaatttgagctgtcttgggtacttttggcagagaacttgagtaggcagttggaagtatgcacttggagttcacaaaagaactgttgggagctggaggtgtcgatttatgagttactggactgtgggtgacagtggggccgagggaaggatgcgattggccaaggcgagcatggaggacaggggctctctaccaggaagacgggcactggccctgaggctcttaggaagcgcctcctaaagctcctgtgcccggaggctcccgccaccccctccacctgctcacactctgcctggtgcccagggatcctgagagcatcctttgcctctcagagcaatgcaggcaggtgtggcctgaggctgcgaggccacaggaccccagggaacatcaggacggaaggcaaaggggcggaaaggagtgcacagagggataagaaaagatccatgtgagtgtggggatttttttttttaactttaatttttgtttccatccattgcagccacctcttctttgtttatctttttcatcatccctcctccctgccttccttttttaatgtggaaatcttccttgagccaaaggcttcactaagcttaactaaggaagcaatggaggaggcgctgatgtggttgttaaaagccctgtgacctgtgctgcccttccgctggcacgctggcacctggcagggatgccagaaatgtttcttgagtaaatggtaaattcaagtttataaataagagtgtttcctttgtctcgaggttgttacttagggcatgtcagtgttgtggagtagtttaaagccacctgaatgaagttttctgaagttttccaaagaacaaataaacttcttctagattttccttgcattaagtataagtgtataacatgagtggttctcttgggttttcaaatatccactaaattagatgagagtgaaaattaagagagctcagaggtcacatctttcaacttttgatgcctcaacctaattatattaaaaatttccaggaatttactatattttcatgttgttaatatcaggaaggttaaaatgctaacttacacctcaacattgaaatcaccagcgtttgatgattacgtgactattacaccactgcattctaatttgtattatcagtactatgagatcagagatactgagtttaaagatggcagtgtactgagaaaaatggtaaacttctacttcctgaaattaagcgtttctgaacagagattcatcaaatctgcagaaaagagaaaggcagataaccgtaggttctgaggctcggtgtttcctccctaatggctttgccaacagaaatactgacaggttttgtctgtcacgggccttactatttatcaccttttcctctcctacctcctactgtggtcttgcctcatctgtacttcatgtaccttaagcctaatagtgaatgttgaagaaatgtctctctttggaaattatctgttttattttattgatttaaggtcaaattaagaaataagataatgagacttgtcaaagaaaacgaatacatagaagatgaaacttgcaatcctaatgcctctcctggcaaagaagacatttcccaccaaatcactaagaactcatgagagcctccgttttcctaattccagattctgtatttatttgagctgcccagcccaggcctgcaggatagggccccactccatcaaggctcctgtttcctcctgagcccgagcagatggtaccttctcttatagcctccatccttcccagaacactccaggtactattttctattttctgggggcatttggcatagttcactgtttcctgagaggcagcatagcttagcggagagctctcaggctttggtgtcagtgatttgtgggtctgacccctgatccaccaggcgtgctatctgatcttggatttctcagctcttctagaactgagcctcagtttcttcagctataaaatggggaaaatatctgcctctcaggattgaggttaaataaagtgtgaactcagcacaggcctggcacacagtaggtgcttagatatctgttttcaaatttctgtcttaatgtgtagtttgtatcttctttattatttccaccttaagaaataaaagtttgggatgaaaagtattattggtaactgccgaatgtatatttaatccaatcagtgatccaggagacaaaaggaatgggcttggtttgggtgagtgataaggaggcaaccttccacataggaggtgagaaaggggaaatggccttagcaaaggcagaggggcaggaaaatacaggctgtgtttgtggaactcagaaagctggagggaagacaagagcagaagagaccattgtccccaaattgtggatcaccgcaattactaagccagtaagttttgattttgccttttaggctgaacaaaatcattgaagatttcttagcagaataatatgattaacagtgtcttcagaaggctattgtgtgggaacaattaactaaacgaatgaaaacagcgcccctctgctcggtgtgtagtgcagcatcccatttgtgtctccgtgcgtccagaatatgctccaaggcatggtagacccagtgaacaacacaagactgataagacagtgcccccaacaacactggaaagtttacctttcttcacacatctaatgcgcctcttttttggttataaataccaggaaccgccgggcgcagtggctcacacctctaatcccagcaatttgggaggccgaggtgggtggatcacctgaggtcaggagttcaagaccagcctggccaacgtggagaaaccctgtctctaattaaaaaaaatacaaaattagccgggtgtggtggcgcatgcctgtaatcccagctactcgggaggctgaggcaggagaattgcttgaacctgggaggtggaggttgcagtgagccgagattgcgccattgcactccagcctgggccaaaaaaaagagtgaaactccgtctcaaaaaataaataagtaccaggaacccaccttaacttaaaaaaagaaaatgtattggcatatgtcactggaagcccaagggctagatccaaggggtcatacaatgtcattgagacctacctctgtggtaccacttctgagatgacttcaggcataacagacaggctttctccaaggtgaagacccccaggttcagacagcccttgggcttaccagccctattggggcactccttttttttccactcaaaagcactctccttggttctgtttgcgtcgtgagccgatccctgagccaaacactgtttccagggggtgaggtacctagactagaatcctgggcctgggtccctcacatgtggcacagagggaatggcagtgttaccaggtttggagcaagagtggagacagttcctgaaaacaaaagttgccggacaggcaaaaaataataaacaccccacaaaaaatcatgcaaagaaaacaccggttagaagacagcagaatagacttgtcctcaaggagggagataagagaaagcatgaaggaagagctgtcaggtacagggataaggaaccaaaaactcagttgtttaactctctgtgagtccaccttgttaattctgcttcatctttccattaatttttatttttcctttattaaaaattctactttgatggtagtgcttttggagccaattattcctcacagcctctggatgagagttggccaaggtaagcaagacatactttaaaagatatgatgggcatgtgttatttttagataatttcactttatccactttgaatgttgtttagaaatttctaatataaagcatagaatcctgttttctcttataacatttaatttcagtgggaggatcacttgagaccaggagttttgaggctgttgtgtgcgatgatggggcctgtgaatagctactgcactccagcctgggcagcatagcaagacgccatctcttaaaaacaaacaaacaaacaaaacaacaacaacaacaacaacaacaacaaaacaccttattggccgggcatggtggctcatgcctgtaatcccagcactttgggaggctgaggcgggcagatcacaaggtcaggagattgagaccatcctggccaacatcatgaaaccccgtctctactaaaaatacaaaaattagctgggcatgacagcacatgcctgtaatcccagctacttgggaggctgaagcaggagagttgcttgaaccagagagtcggaggttgcagtgagctgagatcacgccacagcactccagcctggtaacagagtgagactccatctcaaaaaacaaaaacaaacacctaagcatttccaatgataggctaatatgaaagtctaaaatgaaaagttatttaaagaaatctagatcttcatatttaaaaccaaatagaaacacttttggaatatatttaccagcagaatactcagatatggcattcttatgtttgagacttagaaaaataagcatcttggccaggcacggtggctcatgcctgtaatcccagcactttgggaggccaaggcgggcagatcacaagctcaggagatcgagaccatcctcgctaacacggtgaaaccccgtctccactaaaaatacaaaaaagtagccgggcgtggtggcaggcgcctgtagtcccagctactcgggaggctgaggcaggagaatggcgtgaacccaggaggcggagcttgcagtgagccgagatcacgccactgcactccagcctgggtgacagagcgagactccatctcaaaaaaaaaagaaagaaaaataagcatcttttctcagagtgtcttagtaagctgctgaaaaggacaaaagactcttaaaatggtaatttgcacagtgtatttgatttaaggtctctttgagtatttttgtacccaatacagagggtaacaggaaatagaattaactgagaaaaagcccctgctgcatctgttgtgtgcctagtatcattttcagatcaccaagtcagatttaggacacatttaaaatgtgtgtatcaaaaatatttagctctccggattgaagtctactctccatccattctctgggcaaatactgactgagaacttactgtgtataatgtagtctggatctgggaaaggaaataaagatgggtaacagtgggtccccacctcaggtaggttttcagctgccctcaagaatcttgggatccagggttgtagaataaatacaatattttattacatcagtaaaagtcatctccaaactgttatttttcttttatgtatccaagaaatgtcttctgcttttcagagcaccaggactggttagacttaatattttcataccctgggcaactgtaacaattctattcctcttcatggccattggtaggggaatgcaaaatttttgcatccaagattgccacggcgccccctacatgcacactgaactcctcatctgcccagctagctaatcctgtgccttatgggtttgtagtagtttttatactggaaatcagagatcacaggactggaaggatcatggagtcttacctcattttaacaatgatgagcaaaatgagcgaggtgtggggtatttttaagtaactcttgcagagcgaggtgagtagaagagccagttctcaaatgcaagtgctgaggccctcctttgctgtctgtggattgacttcttttccttttatgttgttctggtttttaaaggcagcagcctccttggaaagacgaaaagcatcctgggttcaggctgacatctgcacttaacaggtacatgggttgtttcctggtaggagtagattttaaagcaatttaactgtcctgatattttttacatagcatccagttgccagagtgtgtttatgtaagctgtgttgatatgacatgttcaaaacaaaacccaccattttttgagtgtctacaggggaaagtatagagcacacgaggtctgggatgagactcccagggtttgcatcttgctgtatgaccttgagtagatttttaaacttctgattgcctcagtttactcatttgaaaaatggagataatgctacctagatcatgggttggttgtgagggttgaataagataatacctgggaagcatatgtgctgaataaacatcagctattatcatgatcactttgggccagactccaggagtaagagttctacctcagccattttttttcaatcctgacaacaccctacaagaatgagtattattttccattctaaaaggttaagtgacttgtttaagggccttagctaataggtgaaggactaggatttgaaaaaatgcagctgagcatggtggctcacgcctatagtcccaacactttgggaggctgaggccagaggatcgtgtgagtccagcagtttgaggccagcctgggcaagatggtgagaccctgtctctatgaaaaaaaaaaaggcgtggtggcacgtgcctgtggttcgagctactcaggaggctgaggtggggaggatcacctaagcccaaggaggttgaggctgcagtgagccatgtttgcgccattgcattccagcctgggcaagagagagacgctgtctcaaaataaaaaagaaacccgatgaatggtgcaaaattttaaatatactcaaacagaagagttataaaaggcctgtggtgcccatcctcagcttcactcattatcagcattctgccagtctctccaaacctacctcccacctcagtcccgtgactggctagtatagtattgtaccttgaaatgtctccagcagtttaaggccgacgagaaccttttttaaaaaacataaccacaatgccgctattacacttaacaaaattaaaaataactccttaatataattcaatgcctggtcggtatttagattttcccagttggctctgcattcgtttgatattctcttgagtctctttgaatctgtaaaaagaggctggaatctgaacccaggtctctctgatctcagcggccacgctctttctgttgcactgtgggttctgcccttgtctgcctcttccctcctctgaagccacgtggcttcatagccacctgaggctgtcactggaatgaaccacaaagaagcactgtaggctaatgaagttgcttaccgtaaagtcctttctatggccgacagtttgaccttatgatgagataaatagataatcatctcttgcaaccaaagctgtgtagacattgaagctatctgggagaatttcagaaatttgctatacattagtggctcccacattttcttttaggactactttacagccttaaaaaacatggaggcctggcgcagtggctcatgcctgtcatcccagcattttgggaggccaaggcgggcgaatcacctgaggtcaggagttcaagaccagcctggccaacatggtgaaacaccgtctctactaaaaatacagaaattagccaggcatggtagcgggttcctgtaatcccagctacttgagaggctgaggcgagagagtcgcttgaacccgggaggcagaggttgcagtgaacaccactgtactgcagcctgggcgacaagagtgaaattccatctcaaaaagtaacactagtaaaataaaataaaataggccaggcacagtggctcatgcctgtaatcccagcactttgggaggctgaggcaggtggatcacccgaggtcgggagttcgagaccagcctggccaacatggtgaaaccccgtctctactaaaaatacaaaagttagctgggcatggtgacgcacgtctataatcccagctacacgggaggctgagggagaagaatttcttgaacacgggaggcagatgttgcagtgagccgagatcacaccactgcactccagcctgggcaacagagcgagactctgtctcagaaaaaaataataaaataaaataaaaaaaatattgaggccctcaaagagtatttgtttatgtgagaatatctattgatattagaaattaaactgagagattttttaaagatactagtgaattaaaaaaataataagcccattacatgttaacataaattatatctttttgaaaagaaacacaaaaaaagtattgaaaatagtgacaatgttcaccttttacaaatccctccaaggcagctgggtggtctgtgcctgcgctcagcggtgggggcatcacacctcacgtggccgctggggaagcccgccgtgcttgggagagagcgagagtgaaaaaacagaggacactttactatcattttgagaatagtcttgatcttaccttctccctggaagggttttgcaaaccactgctctaagtgatcctttacttagaaacagctactctcaggtggagaaaacctagtgcagccacaggctaaactggccacagccagcttccgagctgggaagaataggaagctcttagacggaagccatgaatccgaggcccaccttgttgaacttgatcgccatgccatcagcttcagcatataaggctatatgagtctaagttaaaatattctggagtgtgggcgatcctcagaggctgttaattgatataaagaacttcaggtaggtcctaaccccttatttgatggttgattataaatcagttattcttgccttctttcctgttggtaatattcaacaaagactattgcattttcactaaggaaaacggattttcagccagcctctctcctcccctccttaggaccaattctgattctgctcttcacacgagtgctctgagtaccaagccccaggacccctatggaggagggggccagtcggcctggcctgccccatacatgggtaagacacacaggccactgctgacagcagctgtgcttgctcattctgtcctaggaaccaagggagagagaagctgaagtggtgtttgcgcttcccggttcagtgatcttagagaggcagctcgtggcagggaagcgtgtgtgtccatgatgcagtcaggatggatggagctcccagcgtcccctgcctctgccctgcttcctccacagcacgctctccctcttggtgtctcttggccctcttctgggcacccgtcatcttctaataacttcctgactggtctcctgatttccagtctcacatcccttcaatccagttttatgttaagttccccaagagtcctctttccccacccaggatctgaacaaactgagaaatacaactagaagtgacagtcagagctagatatcacctttattactactaagaccaggttggaggaagtgactgtctctgtaggttggtgggcctgctgagactgaaccccagcatgaggctgactccccctgagtggctggcagcactggccagtgtggtcccctgggaggaggggtcaggcaagcctcggggagggagggtggagcagaggcctgctgccttgagatgggggaagaggaggtcgggctggaactgtgcatcacctgctcagttgccccctggccactgtgagtaaggggatggagagaggccaggagtaacccggagtggggaagaggcccactcatgccatctcacagctctgcttccagagcgaacccaaacctgatcatcttgctctcccacttaaaatcctcagtgccacccctcaccttcaggagaaagagcccagatcttctttggaatgacatgagccccaaggcctggctcctgtctgcctctctcccttttctctctgctcccccgcctcacacccaaggtagccatgcgaaccactttgggttctactggtgtttcttcctgttcctgtctcttcctctctctctcactcctggccagcaccctctccatccgtaagcctcagcttgtgtgtgtcctcatgtctgtggagccatccttgaccttccttcctctcagctcagagttatcgtgtccttctaacatcccagactgctctcttagcacctgcaatgcttggctgcttttttatgtgaacatgcatctctttctctgctcagtgtagatttcttgaaggcagcatcttaatggtcttgttctctccagcccctagcacagtgcccggcacagaggagcccgtactgatggagaagtgtgaagaatcacacactggctcacatgtgcacggcatttgccaaaacaccctctcggtgctggcacctgacctgtacatgaagtgaggctggtcattcagacacatttcaagcctacctttctggggtttataatctagaaagaacaatggtcttgaattatccattccatatgcagattgactcttgcccagaaactttcagggctgtgtatttgttcttgaaacaggaataaataaatctttagccaagaaaccagcttttctggttttctttgctttttggacaatttaaagcctaaatggcctctgttccttccaggagaacacttatgatcgtatttctttgtatatagcagggatagtactgaataataattgttgctatatttgttctattggtgcaattcagagaagactacatttgcttaaatgattgtttgcttgtaaactatgggagctttcagaattggttagggacatctacccatgcttccatacatgggaatatgaaagttggcagtgatgttgaaattgatgttggaattggatatgggtgcactgctcactgcttagaggagtggggtgtgtgggaagagggatgagtttagtttcaggataggtagagatgggaatatgtaaacaaagcctaaaaaaagcagaggctgtaatcagtgggggtgcctgtgagcacagcaggatcctaatctccatggaccgggagccagctagacagacagatttttaccctggagctcctgcatttctgcctctgccgatccttcatttacattaccctctgcaaagtttacacttctctagaaagggccaaaggcctagagaaacaaggcaatcacaggtaattcaagtgaggattttttgaggcttgcatgctaagaaaaagaaagtaactgaagaaagaaattacctgagctgaagtattcattcttagcgatgtagcctctgagagaagaggtgagaaatgtcagaaggggtaagtgaggatggaataagaaaagcaaaggaatgtaaacattggtccaggtagacagagcaatgagaaaaacaggaagaaagaaagaaatcctggatcagggttcctgcgttgacttgagaatcgtggtggtctctccttttcaaatcagcagttagaaattgttgggctacaatatctgacaaccatggagggtgggctggcctccaactcagatgtctgaactgtgtgcctgctcctgcagttgccttgcaagtatagcagaactcagaaacacatcctaatatggatgtgtttacatgggaaagccagtgtttaaaatattattcaagtctccaaggatggaaattatttctggagaattatatttgttggtgggagctattttaaatagtttcatgtattttcctcctgtgtttcattaaagtttttcattttctttccttttggattttaaaactatcaactggctttgcaaaaaggtatttcttataggaccaaccaaagaaagatttaaacagtgatgggaaaatataattgaagcccagaactgggttctatgttcgaagcaataataactcttctttccctgggaatctctcctaggcagaatgatgcagccacacttttttgttattgttgttgctgttgctgtgagcccatgaggagagcatctgctcacggcttaactacatgagcaataaactatgatacattcatgagtggagatttgtgtcacaagaagacaaagcctgatacatgttgagtaattttcataatagctattgagttccatgacaattaggcataaatgataagcagttggtataaatgacagaaataaatttttatggaaccaaacaggatttttataatttctctctttttgtttaattattcagaatctataaagagggaatgttggccatttccctggcagcatgtgcaccttaatgaccatttcacacttacatgcagatagggaagcacaggactctgtgggacacgtgccctgtcccatagcctaggactgtctcctaacacccctcctgacatcgggcatgtggaggagggactggggtggtctcttcctttcagggaacagtctagagctaaggggagcagagtgcgtaataggtgtcttctctgcatccagggctgtagatgctgaatattgccatctttggggaccacagtactcagctccttagcgtggagggggcttggcatgccttggacctggtgacctttcacctgccaataagctttgacctgcagagttaaggagaaggtttacaatgcaaagaaccttgaaagatgtaagcctgttaattgcatggattgggcgggggtacagtggcaggtacaagcatcccagatctgaagaggggcaaaaagagtgtcacccagggacaggagggcccagagtggggaggctgaaacaccagaggcctcctttaggacaatggttaaggggtcttccccttgccttcccttctacttagcaaatcaaggctgtgtagggagttattttagatttgccaggcatgggagcacacagaaggaacatggtctcggttcccttagttagaagagaccggccctcggtggctctgaggtttcctggaacacagttgcagccttggtcatcgctgtcccatccctgtgggactgataaaattagtgtcctgtttccagagagccagtcacaactcattcctttttctttttaaccctttatttgtagtgctatcttgtgggtttttaatttagcagtaaaaatccaggcttggatattttgatgatatgttagcttggtgccagtatatcagtcattgccaccaccatccttctggtcaccgcagcccagaccctgagagttgcatctgattactcccattcccatgcccctacgcccattcagtagccgagtcctgttcattttatcccagcagtatgtctcaaatctgcctctggttttctgtcctcactgccagtatcctacttggttcctgtttgccttggactattgcattggttttctagtcggcctccctgccttaaggctttctcctttcaatccacctcctactctgctgcaagagcagtctctgaagcttaactctgatcatgtcacttctccaactgaaaccttccatcccctacatcctgccaaatgaccagcagcctgcttcggtccagcccatctcccagtcctcccaccatgtgctgcagccacactcttccatcttccttctccttcttatccttccccaaccaccccccactcctcctcctcctcctcctcctcctcctccgcctccacctcctcctcctcctccgcctcctcctccgcctctgcctcctcctcacactgggcatccccttcagcttcgcttccggttgtctaaatcttccaggtactacagcaaattggttagggacatgaacattctgaagacacacgggccagagttctagtcccagaacttactagcagtgtgatcttggggatgataatagcatctacgtcgcagagttgctgtggggatcccatgagatcacctgtgtaaagcgcctggcacatagtaagtgagcagtcaggttggctgttggttatcctcttcttcaccattatccttcaatgaatggcgcctcaggtgccacctactccatgaagccttccttctgttccagtctgaggagagcatgcactaatggggctgtcacatggggtatctgccagccactcaggcagtttcacatggtagccctcagttgagtcctcatgtttcagggacaggtcaggcttaataattaaacctcgagtgactggtgtcttgatgatgaagagatgcttcagcacgccataccagattgctatataaaacctagtttttagtttttaacaggatagtcactttttagtaatcagaatgaagttccctgccctttcttaatatgagggtctcaggaaagccaaaataggaatccgcaactcctgtccttttgacgttgctggttgtagagccacagcttccacagcttttctctctctgcacctcagtgttcacctgttcacactgcctgtcttttgatgggttaaatggctgataagtaagaatgggccaaggaccttctgcaatagagtctcctgagacgacaattaaaaatgtaggctgggcgtggtggctcacacctgtaatcccagcactttgggaggctgaggcagacagattacctgaggtcaggaggttaagaccagcctggccatcatggtgaaaccccgtctctaccaaaaaatagaaaaattagccgggcctggtggcacgcgcctgtaatcccaactactggggaggctgaggcccaggaggtggaggttgcagtgagccaaggtcacgccaccgcactccagcctgggcaacaaagtgagactctgtctcgggaaaaaaaaaaaaaaaaaaaaaaaatgtagattccttggccgactctcacaccttctgaatcaaaatctttgagggttgggcccaagaatctgcattttagcaggctcacccaagggctctttatgtgctgtaaaataaagctttcagtcacttacttagagtctggttctgtgggcctgaaagaaattctgtctttgtgtgtctgcttcatttatcgacctcttcgtattcctgggcactcttcctgttgcccctgggctctgttaaaatgttatatcttctacctgtgttatagaatgtgctaccgtgttaccctgatctgtcttctcacctacactgtatcacccggccccacctagcacttaatgcagaaacttattaaatatgggttgagtgaatggttattagacatttcattcaaattgtatagactaatcaggttaacctataggttaaccttagccaaaaactcatctaaaatgtaagtaagctatacttaaaggcttagaactttataataatgtatcctgattctgtactgaaaacttatttggtatatttgattgctcttaagggaatgctaagatattacattcttggcacggttctttagttttagcttagagcaataggaaatactatgctttgtcatctgcagtataatttatggattaaaaatacttcattcagccagaatttattccaagtcaaagttttaaaactttgtgaatagctatctcatgtaccctttaaattaacttagactccagataaatcttcttcttaaaataacttcactgcataagaaatatatataatatcctacagcatgaaacttcggatttgttcctgtagacacccatggtaagtatcaaacagtgatgtaggctttttgagttacctgctcttaaccccatgatgaagcatttggaagagaatttccatctatacttctttactttgtggtttgaatagagattctcaggctttgtaaaaattgttctcctctcaggacagtgacagtaagaaaatttcagacagacaattttaaaggaaaagaaaaaggaaccaaatttagtttcaaattagctatacctatttttagtataaatgataaagcaccttaaatgaaaatcagtgtatcaaaagtgccttagaattttcaaaattctatttcaaatcataaagagttactgattcataaattcatgaaaatgaaagtaccacataaaagtgttttctttttttctttttcctttcccgctaggtttctgtgatggtgagaataatggacatggggaaggtatgaactgattttacctacctatattggagtgggatgctgattagtggacataacctttcaatacctttactaataaatattcatgttttcaggactcccccaaatgctgacaactgctgattggcttacttttcagagagcctctagaaaattaaggctagccatgttcagggccaggagaaaggaaatatgtggttgcattacaaaggttcctttttatctaggtccccacagtcacaaggttgagcaaggaaccaaaaattgtaatcacatgaaaatatgaatgaattggcctggcacagtggctcatgcctgtaatcccagcactttgggaggctgaggtaggtggatcacttgaagtcaggagttcgagaccagcctgaccaacatggtgaaaccccgtctctactaaaaatacaaaaattagccgggcgtggtggcacgtgcctgtggtcccagatactcaggaggctgaggcaggagaatcgcttgaacacgggaggcggaggttacagtgagttgagattgtgccactgcactccagtctggcgaccgagcgagactccgtctaaaaataaataaataaataaataaataaattaattaattgatcacttaaacaattagttattccagtagtctacccatttagaacgtcttcgttgacagataacaatgccaggaaaatgcaaattggttatgaaatgaaaatgcaaaccttacataagatactgagtttcgtaaagccaattaaaacattgttggagatctatggaaatgacactcaaagccattgacaaatgagggtcagacacagttcatttatttactcagtaccagggactgttttcttttctctaaatctttataatctggaatttaatttttataatctaaaaataaacaactaaattaggtttatatgtcacagaggtgagaccctaggggggacatgatgaatgaggagcatcttgcaagacgcacagctctctgtcatcatcctgcagctccttttctgggcaagcccttttaggccatgaataaaatcacaaaaaggtaaaacatcaataaacatctaatccactagaacagaaattaataaatggcttcaaggttgactgcattccttcagtgcttcgaagaattcccaacaaatcttggatatgaaaagggactaaaaacaatgaactctaagaaaacagtccccattaaggcactggagtctgccccaaccatgttcttataaccaacctcttgtgagaagtagccttgagctgtgtgtgatgacaccttactcagtccttcaaacttttcccagcatttgacagtacctttcagggcaatttttatttatttttatttatttttatttttattttttttttggagacggagtctcgctctgtcgccaggctggagtgcagtggtgtgacctcggctcactgcaaacctccgcctcctgggttcaagcgattctcctgcctcagcctcccgagtagctgggactacaggcacccaccaccacacccagctaatttttttttttgtatttttagtagagatggaattttgccgcattgtccaggctggtctcaatgattatcattatattaatgattaagtcaggtaacatttgaagaaaagagaatcaacaaggatgttgacaaaatacgctcttcaaaagagagtgatgtaaatatcaggattaagagagacacctgggaacactgacaaagcatggcctggtttagcagaaatgactgctgccctggtggtactggacaggttgcctgaagagcattgtatcctccccttaccgtgctgtcaaataagttagaccgctacccatacttaattcattctagaagtccacaactgcatttatatcatcagttttattaaatacaagataaacttattttagagtttttgtttcaaagtcttttctcaaaatttactaggaaagtttgggccctgtgtcatgtgacttctttctggggtccattattcttgggtacccggccatcttgtgtggggctaagacaggatagtcatgacagtcacactggagcttctgtggccactggaactcaacagcattcctggttctgagtagtcactggtgtccctaacttggaatccccttcctgacatcagatcacttaactcctgagggctggcccttgttttctggtctctttctgagaataaaaagtatttacttgttctgtgacccagcattcttgttttacctggcacgactgagagagttaaagcagaaagccctggaatggtccctttatacaggttgtttcatagcattaaagagccaacagccgtcccggcagctgcccagcctcagatcctcttggttgttggttcctctttgtcccccatttccatcccacaaccaaggagcttcactgccaccatgtcttccagctaatactcctcttctcaatactttccccatttcatcgttgttgcaggttctctcctcatccctcttcttccattctctcctttgccaagcctgcagagcccccctgccctggcctcaattgtctacattttacttcctaccatccccttgactcagcctacactccagttgaaaagagttgctccactcttaccttcccctctcttggaattcccttctcctgtgtctctaaagggctccccccagtgcccagctccaaagccctcctggcctcttcctcttctgcacttcatctctcagcagcatcataccctcggctctctcgggcttccactcgttttttccttcagtgatcgttatttatgtgttgcccttatccactgactagattacacattcgtgaaaggttgaatccatgtcttactcatttctgcaactcccacagtagtgcccaaagtggcttccctagtagacagtccataaatgagtcatttttgtgtgttaaataagtcaaacattttatttgttaaatcagtttttacaaagataatttgttcagccaaaggtaggtaggatggatgctttctctttttgttgttgtctttgtttttttgggacagggtcttgttctgttgcccagcctggagtgcagtggcaccgtcatgactcagtgcagcctcagcctctcaggctcaaggagacctcccacctcagcctcccaagtagttgggactacaggtgtgagccgccacacccagctaatttttaaattttttgtagagacgggggtctcactatgttgcccaggcttgtctcaaactcctgggctcaagcgatcctcctgcctcagccccataaagtgctaggattataggcgtgagccaccgtgcccggcctggattcctgccttctcatgcaatgactgtgctgctttttttttccctttagtagcatctttccctggcccattgaaagaagagaatctgttaaatgttccgaagccactgccaaaacaactgtgggagaccaaggaggtgggtgaacagtactcagctatgtttgttgtcactgaatgtttgtacttagaggtcattgaaaaatcctgcagaggtgaaagcaagaggaactgggggaaaaggagaagatttgtctgagaacagagataagaatatacaagggaaggacgtttcaagtaaaaattatcgcgcttgtgtcaatgaattagcacattgatctcttggcttactaattttcatatgaattgacttatttaaaaaaaaaaaaaaaaccctgctaagtcctccatatcttatttgttttgctaaaagctctgaaacctggttgtaagtcataggcagatttttctgtttttttagccagcactttataccagtctccagcttctgtccagaattactggtataccagatagctctttttaactcaagggcatttgacctgagtcctccaagagtcagtagacaagtcatctgttttactatgatttccatgcgcctttgagaatttgtatctaaaattgtgctagctgacctccacctcggctctctaaacctcacccactgtggaagaaaggggaggtcccacggtacttgccttggcctttcttcccagagggaagctgtgttgactttgaaagaaaacagttaatctgttccagcccttaaggatgctctattgcaattgtttgtattgcctgtgtacttaactatccccacctgtttaggatccctttggcccagttccattttcttctgccaagtctaccagagtcaccattagcattagttgtcttaaaaggctttttgtaaaagcaagatgtatttgatgtttaatcatttgggaagtaaaaaagagatatgatttaaaatttacatatttaaacacaggagaagcaaccacactgtcttttggctgtgagaggcacatgtggttgtggaggcttttatcagaggataactatgtcttctccaccaaagagggcagtggtgtgccctcctccctgagtaccagggactggtctctggaaagagatgttcatctcccttggttcttgtggatttgtaatactcattcctgtccgtctggagcttatattctagttgaaatagcttagtttcttctgacattcatttcttttttcaccctgcttttttcttttatttatttcatttcctctcaagccaattggaaaagaaatgtttatttaaaagctctatgtcgtccagacccagtggctcatgcctgtaatcccagcactttgggaggccgaggcgggtggatcacctgaggtcgggagtttgagaccagcctggccaacatggtgaaaccccgtctctactaaaaatacaaaaattagccgagtgtggtggtgcatgcctgtgatcccagctactcgggaggctgaggcaggagaatcgcttgaacccaggaagcggaggttgctgtgagctgagatgtgccactgccactccagcctggatgacaagagtgaaactccgtaaaaagctctatgtgtaaaacattggtcttttaatgttaatccagaaggtaaattgataaggcatcaaattaggaaaatgtattaatattatgcctcccttaggcctggaagtttgagtttaaaaaagtcatgccaaaacctaaaaggctgctgtgtgaggactctgtcgacacgcaagctctcacttgcgcccactagagcctcaaggtccttacgaagacacttttcaaaaacttgaatttggctttacagcgagtaagcccagctttcattgtctcttctcagattcagtccctgtcaggacgccctcgatcctgtgatgttggaggtggcaagtaagtaatattctttctgttcgtgtttcagggactatcctgaaggtttttcccaaaagtctcgctgctttgttacagaactctcagaaacgtaacttgctatgcataaattgaaagtcaactgcattttcataaaaacagccactctcttttgatactcatatttcatctgtttaaactaattaaattacatgactataataacaaacaaaacttacataagtatgtttgagaatcacacaactgactcttggtaaatacacaactctccgggtagaagcagtgtcagaagcagaaacgtgcaggaatcgagaggagcctaccagccccgagctgtggcaggctgtgggcatcggtgacatcctggccaggggaaaagggaagcatcagttcacctggcagcttaatggcacagaagttaattaagagagtttctgtgaatgtacttaatgtcactgaactgtacacacagaaatggttaaaatggtaaattttatggtatatttattttacaacaatttaaaaacataaatggaagataaatatattttccatttgcaatacaaaaaagtttctatgaaaccattaatttgttagtggatttaatagtatgcaacttcactccctaaaaggtttgagacaacttacaaaaatatagtacaagcaaatgaaaaaggaagttcatgaggaagttgagtctaagagagaacgaggagatgagagagataatgaggcccttgccttaacagaaactgccttgggagggccggctggtgtgctgcgtgggacggtacagacagctgctggggaggttcacagagaggaccccttggaactcgatgggctgtgtcctgagagagccccaaggaggcttcctggggctgtttatcatagtgtccgtgagagcagtcccaccacttggaactgaagccaattcagaaacagcaaggctgcagggccaaaataatgtggtttggaaatgggattcttgcatgatctgacttagtacatacaatcaccagtgggtcagtgggtgaactaaatccacttcaagcagtcattgaatgtgatttcccccaacagagcttcctgtgagtatctcacagcagcgcagtcaaggcactctctactgagtacctggagctcagacattctttctggcaggttaaacgtaaactcaggtgatttgctgagctgcgccacgggttgatgtttgcttcagaaagtgggcaagcctgccaggacgcatgcccaacaaaagacaggccgccgagaggtgcaggacattcccatggaaggggcaagcttttcctcaagggagtctccctcaacctagtctggttcaggggcttcctggtaaaatggaaatttggaaacaaaaacaaaaacaaaaacaaacattttcctcaagaatcaattttggcttaaccatcagataaccttcaggctctgaaagcctaacattatagaattgggctgcagtactttagccctcaagaggtttttgttgttgttgtttagttagtttgtttgtatttatttatttatttgagatggagtatcgctctgtcgctcaggctggagtgcagtggcatgctcttggctcacagcaacctctgcctcccaggttcaagcgattctcctacctcagcctcccaagtagctggaattacagacgtgcaccaccatacctggctaatttttttatttatagaaaagatagggtttcaccatattggccaggctggtcttgaactcctgacctcaggtgatccacccactttggcctcccaaagtgctaggattacaggcatgagccaccatgcccagcctgttttgtttttaaagatagatagggccttgctatgttggccaggttggtcttgaactcctagtctcaagtgatcctcccaaagcactgggattacaggtgtgagccaccatgcctggccaacctggagagttttaaagcaggtgtttcttaggtagagaaagttgctttcttgctcttactttacagatagaattccattcagtgacttctagtcatgcagatatttattgaccccctaattcttggcactgggttaaacaatgaacaaaacagatcaagttcctgctttcgaggagctaataatctagtagagcaagatgggcagaaacaaataagcaaagcacagcaaaagtcatgtgtgggtaaatgcactgaaggagacgcaactgtggcaggtggacaggcagccaccagcgggcgttgaggaaacctttctgatagtgtgaagcgacgcagagagggctccaggcagcaggaacagcaagtgcaaagaccccaaggcaggagtgggcctggagttcaaggaggcttgtattgcttggatctgacgcagagaagatgggagtcgttagagggtcttgaaccggggggcgcattactttccttagatcagtggtgactccgttaggtagtaactatatttggaaaggaaccacctgtatttctcccagctgcagaggaattgtgtgaacgttactaatgacctgtttcacagtggtcacattttttccatccttgctctgtgctgttggacgcttctccctgccgcgcccctgctctctctgccttcactcccacctgatcacccatggatctttcttctcagtcagaaagcccatctgctgtcacgttgagggctctgaggtctcaattttatttttctagtccttgatctttaaccctataaacagttccatacttccagccatctaagacaaaattcaggctgggcgcagtggctcatgcctgtaatcgcagcactttgggaggctgaggcaggccgatcacttgaggtcaggagttcaagaccagcctggccaacatggcgaaaccctgtctctactaaaaatacaaaaatttgctgggtatggtagtacatgcctgtaatcccagctactcgggaggctgaggcaggagaattgtttgaacccgggaggcagaggttgcagtgagccaagatcgcaccactgcactccagcctgggcgacagagcaagactctgtctcaaaaaaacacaaaataaaataaaaagacaaaatttatattcagtttttctacaaccaaaatgagccttcttcctcaccctccggttggacacctctcctgctgcctcatttctttccaaaactccacagttcgcccagtcctacttttaccaagaaaagtgaggcgaggctggcaggagtgagtgctcagctctcttctgccactgattcccccgtcaccacccttctctggtcctagggacaccgaggtccctcctagtcaggccggccactttaccactccctggccctcctcccgctggatttgtggaggcctttctctgctagttaactgtccctcatctccagaattctccgccatgctttctgaaagcatatttactctcaggtgttccttcctgcttacccatcatcagcccaccatgccctggctgccacctctgctgttcagtggaaccttgagaatgtcggttgcctcctgtacgtaactgagagagaaatatccctgctgcatgtcttcctagtgagcagaaactcaaagccaaaatagaattcgtgatctcatccatacccctgccctcattcccaatctgctcacatcttcagtgtcccctgtctcagtgaggggctccaccagtccccaggctaaaggccccagagttgttcttgagtcctacttccctgtctctagagtctagcctgcctctccctccctgcgctcgtggcctcctgctggagcgttcagcagagtcatagcggcctctccacctccaggcctgctccgtgcaccccaagaccccttccccaagtctgttagccacgctgtcctaagaaaagctgatacctctcccccaccacactgcccaccccgcgtccagccttccactggcgtcgtgtcagcctctcatcagtcccagcctcgggtgctctctacctgcttttccacttccatctcccaccactaaccagccctcctaaactcaacctcccgtggtctgaatcctcacagttctgagggcacaccatgtggtctcacacctccctgcttttgcgcatgctgtgagctttgcctgaaatctttttcctgactagatcacctgagttctttagcctttaaactaagctcagatgtcctccaaggaagcctccccaggtcagctgggcttccctccacatggcctccctccaggctctatcactgcactactgaattgtattatgttgccggttatgctccttatggctcagtctcttgaagccctgatgccagtggctggcccctgggaggtgctctgctgatgtgtgcaggagggaatgaagtgtcctcaggattcgtgacttccctctgctcctggctggtggcaccttctcccgcattctcctccgcgtcaccctcactgctcttttcctatatcacccctggaccactgcaggtggtccttctaattggttctccctgcctctccttctgcctgctgaggccatcctccacactggaaccacagtgacatttctgaaacgccattctccagcttaacctggcctccctctttccacagtccctgatccagactcctgagaacagcacattctctcccgcctgcctctccctccccatgtgccaccctccctcctcaccctctgccctgacacctgacacctcagccatgcccagctactcttaattccacgcacacactgtgtcacatccatggcaaacccgtcccctccacagcccatcctgacatggacaactcctgcttttttgctcccggtgtcacttatatgcactggttacacacaccccttctcaaacccagcatagcgcgcttcctgccacgttgcagttacttgctttcccaggctgtctctcctgcccatctgtgaattccaaaacaaggtcctctcagacctggctagcaggcccctccctggggccccgcccttgagagggcttcattcccaaagggaacgtaccaccagtgtatacgcactaggcctggggggtggctagagagtcagcagggtgtggacagagtttggctgcataggctgggatagctatgtgcgtactgcagtacagaacagaactagggggaagagaaggggacgtggactgagggccaggctgtctccctgtgcattctggcacagaactccaagaagtctgagaattctacatgtaaatctggcttcacaggctattatgaaggtataatatgtcaggatagacacatagaacaaagttcatgtaagggtttgttcatttgatttataacttttaaaaatggaaacagatggtatgcgggccttcttttatactcttgctccaggcctgtacatttcaggagtaggcctgaccccggcggacacactcgccctgcttgttcatcatggtgccgccaacatgcggcccgctgcctggcacacagtgcctagcccatagattgtgatgaatgaatggcaacatctctttgtcactttaaagtttatgaagactgtaattttaaaaatatatcttggaaggtatattggaaggtagctagttactcagagatactttttctggtagcaaagataacttaaaaatctagcaaaaagaactacataaatagcagtgcctcacattttatagagtggtttataattttcagaatacttttgcatccataatctaatctggtcttgattattctagaccctaatctagtattcctgtaatgtgggcacaggtagtgggtgaggatatgtgtttcggagaggttaagccgagcaccagtgttctcagaatcagagaggccgcaccaggacctcggtcttttgtagccactgctcttatttgacaaggaaaaggtttcagccatgtttggtttcccaacagccaaatacattgtagaaagtcattcttaatctttcttttttcagtgcttttccacataatggtcaaaacctaggcctctcacccttcttggggaccttgaacactggagggtcattgccagatctaaccaacctccactactcgacacccctgccagcctccctggacaccaccgaccaccactttggcagtatgagtgtggggaatagtgtgaacaacatcccagctgctatgacccacctgggtataagaagctcctctggtgagtatctcctgcttagcagtgacctggtggcttaatcataggtggtccccacccatgtggcctgttcagtgaatcattgaatgagaatgactgcatcccagttagagatgataatgtaccttcttgtatctcctgaccctgcggacatttttcttggatgtttctgtttctcctgggttgatgaatttggggcagctctgctgaacctcattccttatcatcctcactcgctgctctatccagggacttggggaataagatatgggagccaagaaataagcatccactccgtgttggctgaacagtattagtggctgtcatcaacatatgataatttataatttaggccatctctctggattcctttcattttccattagatttctaaaggcaatattctgcattttagaaaatttacagtggatatgatgaaaatatttatacttaatatctgtgtgtgaagtagaaatcccccacagttccagttaaagatgtagcattagctatataaagatgctacccataatgggacttgggtgttactctctgggtttgattgtccacagctcagaccccatattgaaattatgactacatttgtttgaagcctgacacttttttttttttttttttgagatggggtcttactctgtcacctaggctagagtgcagtggcacgatctcagctcgctgcaacctctgcttcccaggttcaagcaattcttctgcctcagcctccagggtagctgggattacaggcatgtgccacgatgccgagctaatcgtttttgtatttttagtagagacagggtttcaccatgttggccaggctggtctcgaactcctgacctcaagtgatccacccgccttggcctcccaaagtgctgggattacaggcgtgagccaccactgacatacccttgtcaatgtctagggcaggtgataatcctcttactcccagtggtgcagtacagcccctggccgtaacagtcctacccagaattgtgttgtggagcatttcatttggaagggatgctcagtgatggtctccaggtgaaagcagtgtttgctgcctttcactctgagactcatccatgcaaatcagaactcaccacccaaatgagagtggtccccttcagggggggtcacctggaagtttttctaatgattgcagtgatgctgcctggtgcaacacaatcttaggtttgaagaattgatttcagagaacacctttatttttgttttttgggtcattttagtatccttaatagtagcaggtttttcatcgactgagtctcagttttgatatttatacatttgcttcataggagaaatttgatatttgcttcacaggagaaactctcgaaacctttatgcccagattcagagtctgggcaattcaccttttgggtgaatcctcaatgtatgaagatatctagggtcccagaagtaaagcagcatcagcacatagctcctttgggtctcagggaagctggcattttccagtacagcctttgacactttgcttcaagctgaagatcttatgtttagtcactggttgtcttctcaaaaaagcactattttatccagaacatgtcagaaccaatgtcagtttctgtattttcttttttttttttctttttgagacagactcttgctgtgtcgcccaggctggagtgcagtggcgccatctcggctcactgcaagctctgcctcctaggttcacgccattctcctgcctcagcctccccagtagctgggactacaggcacctgccaccacgcccggctaatttttttagtagagacggggtttcaccttgttagccaggatggtcttgatctcctgacctcatgatccacccgcctcggcctcccaaagtgccgggattacaggcgtgagccacgcccagccggcaaaattatttttaagaattttaggctgggtgcggtggctcactcctgtaatcccggcactttgggaggccgaggcgagtggatcacgaggtcaggagatcgagaccatcctggctaacacggtgaaaccccatctctactaaaattacaaaaaattaaccaggcgtggcggcacatgcctgtagtcccagctacttgggaggctgaggcaggagaatggcgtgaacccgggagacggagcttgcagtgagctgagatcatgtcactgcactccagcctgggtgacagagcgagactctgtctcaaaaaaaataataataataatagtgataataataattttgccagctgctggatttttgtcatttcttccttttcgtaacttttatcaaacacttaaattttttgtcaacacgaaacaacacatagttctgcttaccccacctgctggtacaagaaagatgggctgaaggttaaaacgtaggtattgccagttgagatacacacagcagcagcagccgaataattgattcactgggcgaacctgctccatgccaggccctgtgccaggtgctgaggatccagcagggcataggacaggatccccagtttctgggagctcatgccctagcagcctatgctgcaaagatctctctcccaaatttccttgctcatgatcaaattcacccctgtcccccaaataaagcaccagcaaaaacttccttttccctgagttggtatagactgtgatgaacaatttcctgggaaccagaaaatcaaagagggaccctggggtgggagatacagggaagtgtcccttcctgtgactccctagtgtgctaagggtaattaaagaccaccaagacagctccccaagggccatgactcgccgtggaaggatgttctccaaaggtagcaggggatgcaggcagtgtgcttgggacagagaccttccggggctctaaacagaatttgttgtacagccctagggtcctttccctgggtctgggccgagcacctggaatatttgcctctgttaccccggtttacctagttttgctcacctaggggttgttgacgtgatctccctcctcatgggaaaacatcgttgtcatctttgtggccccatctctgttagtgcaggggcatcttttccttgccattggtgcatcggatgcagtccctgtaggagagctgtccaggagctcctttacctacagaatcatcatcgcatgtgacagtagacagttttctttcatttttggaatacaaaagatttggtctgaaattataagtaacttgtgaatttgttgtcttccaggtctccagagttctcggagtaacccctccatccaagccacgctcaataagactgtgctttcctcttccttaaataaccacccacagacatctgttcccaacgcatctgctcttcacccttcgctccgtctgttttcccttagcaacccatctctttccaccacaaacctgagcggcccgtctcggcgtcggcagcctcccgtcagccctctcacgctttctcctggccctgaagcacatcaaggtttcagcagacagctgtcttcaaccagcccactggccccatatcctacctcccaggtaaacacacacagacagaccaaccactacagtgaaacagactgcaagatataggaagtgcattcctcctctttactattttgggttacactcattattacaccaagcacccatgaggtctcaagtgcagtctgttcgctcttatatgtgaaatcagagcagaagtgtcaataatgcagaatgaattcatgattttcttttctttttttgagaaagggtctcactctgttgcccaggctggagtgcagtggcacaatcgcggctcactgcagcctcacctcccgggctcaagcgatcttctcaccttagtcttcggagtagctgggaccacaggcatgcaccaccatacctgactaattttttgatttttttgtagagacaagttctcgatatgttgcccaagctggtctcaaatgcctggactcaagccatcctcccagcgtggcctcccaaagtgctgggattacaggcatgagccactgcacccagcctaattaatgattttttattataataatagcagatttgctgtgttgattactctttaagcaaatgttgaacaatctgtagtcactaactcacaaacttggggttgagaggaacggtaggatatagagaatgccatccaggtaagtctaaggcaactgagggaaaccaggttaggatttcaaagttggcatggaaaatcagtcattgactctctaagtacattaagccataggggaaagccaaagaaaacatttaataccttcctgaagctttgataatgaattagacctcttccctaattgtctacagatttgagaaacaatacttttattgttcatgaaatgctaagtatgttgaggattatatctcttataaggatgaaaagaagtctgttgagaaagaggcacatttaaaagtcacccacccatacaaaaaatggaaaaattagctgggtgtggtggcacacgcctgtagtcccagctactccagagcggaggtgggaggctcacttgagcccaggaggtcgaggctgcagtgagccaagatagcctcactgcactgtagcctggcaacagagtgagaccctgtctcaaaagaaaagaaaagcccattatagaaacacaggggttgaaacatcctataaattctaaactcagaggtggttctccttataccataatcatcgaggaatgtgttttcaaccttttgtcacatcctctgtctattacagcatcattttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgtgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctattacagcatcattaactactcaccacctcgccataaattaatgatttagaaggaagagttgacagaacacaacggagagttagaggatcttgttattggtcactctttaccaattactagccgtggcgtgttgatcgtatgagtgatctcttttgggcgagggtgagaggacatttcataatttttaagtctcactctgtcgcccaagctggagcacaatggcacgatcgcggctcccttgccttgaattcctgggcccaagtgatcctcctgcctcagctgggattcttcaagtaaatgtgactacaggcccatgtcaccacacccagctaatttttttaatttttttgtagaaacagggtctccctgggctgggtgtgtgcctcacacctgtaatccagcactttgggagtccaaggcagacggatcacttgagggtaggagtttgagtccagcctggttaacatgacgaaaccccatctctactaaaaatacaaaaattaaccgggcatggtggcacacgcctgtaatcccacctactcaggatgctgcgacgtgagaattgcttgcaccctggaggtggaagtttgcagtgagccaggattgcaccactgcactccagcctgggtgacagagttactctgtctcaaaaaaaaaaaaaaattagaattaaaaaaagaaaagaaagaaatagggtctccctatgttttccaggctggtcttaaactcctgagctcaagtgatcctcgcacctcagcctcccaaagggctggaattagccagtgtgccttgtgccaggcatgagccactgtgccctgccataatttttatttttttttagagacagcgtttcactctgtcacccaggctcgagtgcagtggcgcgatcacagctcactgcagccttgaactccctgagctcaggtgatcctcccaccttaacctcccaagcacataggactacaggtgtataccatcacacccgactaatttttgtatttttttttttttgtagagatggggtttcaccatattgcccaggctagtccataattattgttttcgtggttcttatgttattgaattacctttaattttattttgcaagattattttataagatctaaaagtattcttgctttttagctacattttaaggagactgtatggccagagtgtcccctttcagatgtgtttttaatttgtttaatatttagattttttttaaatgaatgttgctggacacagttgttctgactgtaatcccagctactcaggaggcagagactggaggattgcttaaggcccggagttcaagaccagccttggcaacatagtgacaccctatctatctcttaaaaaaaggaaattttaaaaagtgaatgttattcatgcacatagtttaaaaagtaaaatagttctaaagggcttgttatagaaaaacagctgtctttccctctcgttaggcatattcctcactgcctagagatggctgtcaaccattttaactaatctctttggtataaccatgttattattattttgagacagagtcttgctctgtcacccaggctggggtgtagtggtgcgatctcaactcactgaaacctccacctcccaggttcaagcgattttcctgcctcagcttcctaagtagctgggactacaggcatgtgccacgacgcctggctactttttgtatttttagtagatacagggttttaccatgttagccaggctggtttcgaactcctgacctcaggcagtctgcccgcctcggcgtcccaaagtgctggattacaggcatgagccacctcacccagcctaaccatgttgttttatgctttttttgttctacatttttggtgttaggcattatctaatgacatcctaccaatgaagattagaatttaattctctttccactctcccacagactccaccacacacatatgtgcgcacatgtgcacacacaatttcctacccaccctcctcatttattataattttggttagagcaatactcaatatttagtgtttttatagttacaatgtagtcagagttgacatatagtatactatgaaacaagaaaatgagaattttttttcctcttgggagttaataaatgtctgactttttttattagcctggttatctatatgtatctatgtgtatgactaattcagtccccaactcttggagttgggcagatctcctctcgacacattcaaaactaaattctctagtagctctatagcaaagagtgcctgtgactttgtatgacttaaaatgtctttatttgatctgccatttaattattatttggctgaatatagaattctaaatttgaaataattttcccttggcatctattgcctattcatttgtaagttgcattgagaaatccagtgccattcggactcttaacactttgcatggaatccccctgctccaccccaggcttgtgagatctttttgtccccagtgttctgaaacttcaagatgatgtggcttggcgtgagtctgcatatttggtgggttccttcaatctggaaactcacagccttcatttctgggaaatgttctttatttcttcaatgatttcttcccttcagttttctctgttctttctctctggaactctacgaatgttgactatcctggacttttcctctattatccttatcttctctctctcctcttttgcttctctgtggttgcttccttgtttgtttgttttgctttgctttctggaagattgtctcagctttatcttccaacacttctgttgagttttccatttctgctctcatttttaaattgctatgagttcttttttgttctctgagtgttcttttttaatagcatcatacttattccacagatgcaatatcatcttttatctctcaggtttttagtggtctttttttttcgaatttatctttattttctataatagaattttcctaaattgcataaaagtagagaacataatacaataagtcctcctatacccatcatttaccctcaacaattaattttttttttttgagacagggtcttgctctgttgcccaggctggagtgcagtggtgtgatctcggctcattgtaacctccgccatccaggttcaaaccattctcctggcctcagcctcccgaatagctgggactacaggtgcacaccaccacacctggctaatttttgtaatttttagtagagacgggatttcaccatgttggccaggctggtttcaaactcctgacctcaggtgatccacccacctcagcctcccaaagtctgagattacaggcgtgagccagcacgccagccttgttatcttgtttcatccataccctgcttttaaaaattgcagatattttaatatgtatctctaatagataaggattttcttagtagcctaaatattgtcatgctgattttggtttttcacaactacttcttcctgcacacatctttccaagattgtgtgtgtctgctctggcctctgactttcacggcagatggtttcctcagggcctggtgatcctcagtgctctgctcatgtttaagaacaggacactgaggggctgtctccttgcggctctacactagagcggagtatgagactgaggcgaagggagtcatggcaggacaagcgtgtagaaagttttttccactctctgactgagtattggttggaaggagcgctgctaaaactgtaaccaaaggaggcattttgcttccagaaaaatctcaaggaaaagtattgcaagcaacagtagtcactgttggatcgggttctaaaggtaaggctggagagattcaaccagttagcgtgaaagttggagataaagttcttctcccagaatatggaggcaccaaagtagttctagatgacaaggattatttcctatttagagatggtgacattcttggaaagtacatagactgaaataagtcactactgaaatggcatcagtgtgaagctgcccattccactgaagttctgaaatctttcatcatgtaaataatttccatatttcttataataaactaatgataactaatgacatccagtgtctccaaaattgtttccttgtactgatataaacatttccaaataaaaatatgtaaatgagaaaaaaaaaaggacactgagaagctggctggcagctctgtgtatgtgggcaggcctgctgagtgtggtcttcattgtagaatgatctagcttggtcatttccttgggaaactcctggtgtcataagttttacattcttctctggccaggcgtggtggctcacacctgtaatctcagcactttgggaggccgaggcgggtggatcacctgaggtcaggagttcgagaccagcctggccaacatggtgaaaccccgtctctactaaaaatacaaaaattagccaggcgtgttagcatgctcctgtaatctcagctactcgggagactgaggcaggagaattgcttgaacccaggaggtggaggttgcagtgagccaaggtcatgccactgcactccagcttgggtgacagagcaagactctgtctccagaaaaactctgtctccagaaaaaaagattttctctcttcaggccttgtcaggttccctaaaggacactcttccaatgtcgcacctcggcatatcaggattccggcatcctgtgagccgggttgggaaagaaaggtggagatcttaagattcgatcgtgaaatttcttctaaagaataaaatacctaggaatccaacttataagggatgtgaaggacctcttcaaggagaactacaaaccactgctcaatgaaataaaagaggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccgaaaaagagcccacattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagatataatgccacatatctacaaccatctgatctttgacaaacctgacaaaaacaagaaatggggaaaggattccctatttaataaatggtgctgggaaaactggctagccatacgtagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattaacaaatgggatctaattaaactaaagagcttctgcacagcaaaagaaactaccatcagagtgaacaggcaaactacagaatgggagaaaatttttgcaatctactcatctgacaaagggctaatatccagaatctacaaagaactcaaatttacaagaaaaaaacaaacaaccccatcaaaaagtgggcgaaggatatgaacagacactcttcaaaagaagacatttatgcagctaaaagacacatgaaaaaatgctcatcatcactggccatcagagaaatgcaaatcaaaaccacaatgaggtaccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattccttagggatcttgaactagaaataccatttgacccagccatcccattactgggtatatacccaaaggattataaatcatgctgctataaaaacacatgcacacatatgtttattgcagcactattcacaatagcaaagacttggaaccaagccagatgtccaacaacgatagactggattaagaaaatgtggcacatatacaccatggaatactatgcagccataaaaaatgatgagttcatgtcctttgtagggacatggatgaagctggaaaccatcattctcagcaaactgtcgcaaggacaaaaaaccaaacaccacatattctcactcataggtgggaattgaacaatgagaacacatggacacaggaaggggaacatcacacaccggggcctgttgtgggatgcggggaagggggagggatagcattgggagatatacctaacgtaaatgacgagttaatgggtgtagcacaccaacatggcacgtgtatacatatgtaacaaacctgcatgttgtgcacatgtaccctagaacttaaaaaaataaaatattaaagaaaaagaaatttcttctaaaccctgtgttttcagtaaagtgcctcaccttctaatatccagagacccttagttttattatctcgaaagtagaaccttccagtctcctggcaggtggcaggatggtgggggccagtgcgcagaagcacactcaaggcaagggctctgcaggtccaactgccccttacacaaactgtgaccagaatctcctggttttagcttcaccgcctgctccctgctgtccccagtcccagagccctgtggggactgagtgctgtcagtgagattgcctcctggtttttcctcactgccagcctagcatcgggttttctcagctctgctaagccagctgccaccgggccatctgctgctcattttccagcttttgttgccattttcttctctcccgttatctttgtcctcgtgttgtttgttatcatttagtgttctgtgctgttgtttagtgttttttattaatgcttattgcttgttaatgttgtagtgtcttgttttaacaggatttggggatgacagagctaagggcctttttcaattttccacttttaaccagaagacacggctataaaacaaaacaaaacatgattttcacggagaaaactgaaaggaaattggttaaattggctgttttcttgtttagttcttttaagacaatagaacttgtcattgaatggaacatgctttgtggggaagtaaaatttgagatatactttgaaggatgagaaacgggcttctcacagcattgcacagaacaccgcggtgaggaaaatctcaggcttcctctcactctgacatttcctaatcctaaaggacttaacgccagaaacgcagaagctcattagtggctttgtgtgtttgttttgcagatggtgtcctcagaccgaagccaactttcctttctgcccacagaagctcaagcccaggtgtcgccgccacccccttaccctgcaccccaggagctcacccagcccctcctgcagcagccccgcgcccctgaggcccctgcccagcagccccaggcagcctcctcactgccacagtcagactttcagcttctcccggcccaggtgagttctggcaggagcgttggtgcagagggaatgcttgttttgctctgagttccaagctaaatgatcatctccttattccctgaagggctcatctttgaccaacttcttcccagatgtgggttttgaccagcagtccatgaggccaggccctgcctttcctcaacaggtgggtgatcgcccctgccttctcctcccttggtgcataaactgtaccatttaggttgttcattctgtagaattcagaactgagcagaccagacatgccactttcctggttctggttgtgttctgtggctagaagagcctttcatcttctttggccctaaaatgctttctctggctgccttatttagtatcaggcttcagcagaggaactattggaacaatcggcaggagacttttgatgacactctcgttgtagaactgtaaaatcatgaacactggaagggacacagcacctgcctcctcagcgccctcatgttgaaactgaggcatagggagagtggcgcctgctcccaccgcagagtcagaaggtggcgccgcatttggcctgcacccaggctggtgcacccagcacagcgtggggcctcctggggagagctcagtcctggggagtgaggggagtgcgttccgtaaggtattttcaactcggccactttcttttacagtttagttttttcctaacattgactatttttaatattctagattttatagtattcaatagtattcaataagtatggactgggccctccgatggattaaggagtggaagaagggttgaacaggttccagaacttttttttttttttttttttgagacagaatcttaatctgtcgcctaggctggagtgcagtggcgtgatctcggcttactgcaacctccacctcctgggttcaagtgattctcatgtctcagactcctgagtaattggggttacaggcatgtacccctacacctggctaaattttatatttttagtagagatggggtttcactttgttgaccaggctaatcttgaactccggacctcaagtgatccacccgccttggcctcccaaagtgctgggattacaggtgcgagccactgtgcccagccaagaacttaataaaatagctgggcatagtggctcacgcctgtaatcccagcagtttgggaggccgaggcgggcggatcatgaggtcaggagatcgagaccatcctggctaacacggtgaaaccttgtctctactaaaaaatacaaaaaaattagctgggcgtggtggcaggcacctgtagtcccagctactcgggaggctgaggcaggagaatggcgtgaagccgggaggcggagcttgcagtgagctgagatcgcaccactgcacttcagtctggacaacaaagcaagactctgtctcaaaataagtaaataaaataataataataaaataaattaagatagctgtttcctaagcaggccacagatgaagctttgtggcaagaaccaatcctccttgcctccctgtttcccaaagagccattttagtctaggtgggaatcaccgtctccctgaaaaatgatagacacttcttttgagactttttttaaaatggcttagaaaattaatttcaggaaaggaacctaaaattggcactggttataaccagtcctcatagaggctttctcatagggaggagcttgcctgagtttcctccttctgagtgtgaaaaggaaagccttcccctttctcagttttctagaaaccagggaagaggccaggtgcagtggctcacacccataatcccagcactttgggaggccaaggccagtggcttacttgaactcaggagtttgagaccagcctgggtaaaatacagcaagaccctgtctctaaaaaaaatacaaaaattagccaggcatggtggcatgtggtcccagctatttgggaggctaaggtggacggattgcttgagcctgggagctggaggtttcagtgagccgagatggcgccattgcactccagcctgggcaacagagaccctatctttaaaaaaaaaaagaagaaagaaaccaaggaagaagagtccatacttccttggttatagacagagcctttgaagggttcccacagaaggcagtttgcaaaggccttggtgaggctgaggacagatgtctgaggggccacagaaaccatgagcattggtgtctcttgggatggtgtagtgggctggggaaaagtcaccacgctgtggacctcagggacccctcctccaccccagcgtctgcctgcctgacaagaatattgtgcatgcattaccataagagcaaagcactctgggatcctggaaagaagggaatatggattagtttgcaagtcaggttttgctctgggagcacattgcaatactcacttcctccttggaaacagaggtgtggccttcctcacatgaccttcgatgcttccaggtgcctctggtgcaacaaggttcccgagaactgcaggactcttttcatttgagaccaagcccgtattccaactgcgggagtctcccgaacaccatcctgccaggtgagcgagctatccctcagcttctttactgcttttatgttgttgtgtgttcaggaaccttcataagagagtttaaacaacataatattatataaagcaaaaagttaacgttccctgggtcgacttgactttttgagatgcaggtgtccagcctcagagaccgtgacacagggcggtgggcctggtagtcaaagccttttctgaaagatttcatctggcccagtgcggtggctcacgcctgtaatcccagcactttgggaggccgaggtgggcggatcatcaggtcaggagatcgagaccattctggctaacacagcgaaaccccgtctctactaaaaaatacaaaaaaaattagctgggcatggcggcgggcgcctgtggtctcagctactcgggaggctgaggcagaatggcaccaacccaggaggtggagcttgcagtgagccgagattgtgccactgtactccagcctgggcaacagtctccaaaaaaaaaaaaagatttcatcttaggtgactgatgactgttcaaaaggaaaaaacctgcaaaaattgggagttgtgcaactgactgacaagaatgtagattccagggcaagaactgtgggcctgggggtggtcaggatgtgtgggatagcagtttaggggactgtcatcagctgggtttgcttagtagcctggagccttcgcgcctcctaaccgcactgttttcccctctggccactcctttcagaagactccagcaccagcctgttcaaagacctcaacagtgcgctggcaggcctgcctgaggtcagcctgaacgtggacactccatttccactggaagaggagctgcagattgaacccctgagcctggacggactcaacatgttaagtgactccagcatgggcctgctggacccctctgttgaagagacgtttcgagctgacagactgtgaacagaaggcagtggaacagaagaatgtttttctgcaacagccaaaatagaatggaatagaatgaagccagctgataccacgggctttcgttatcttgacatagaaggaagcaatgccacggctccagggtttcagatgagatcccatctcagacactgtggcttcctccagatcacacagctttgtactgcctctcccgcctgtggccaaagtcgtgttgcagcaggcaggctgcttggagcttcccatgaactggaaagctcacctccactgcatctttttactggccatccagtcagccgatgtgtaagagtaggaaatactgtgtcactggaggcctccgtagcattgtgtagtgtgctcagaaccactgatctccgtccgcaccgaaggcgggcccggagtgggaggctcggcctggggcggcggcaccggagagggcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaaggagagacggaagatgccaggacctttgcttggacagccattgcccttccaggagaccctggagtgtactgagggttgctggactgttccacccagaggagcaaggctgtacaatgagggtctgaatctggcacacctgtcccttatgtaaaaggagtcgtggtcacaagaccctgggctggttagcctctcccgacctcattccatttctatcttctgaccttgcctctcatctttaaaataaccctcatggggtgcccctccaccttcctctggaatccaagtattcctgtttcacatttgccccaaatctttgctgtggaattgggaaatcaaaccagagtcctcctcgcctgatttccagctcaggaagggcctgctggcctgccctgttcccagttacactttcagatccctttgtgctcaagatctcagagggggtggctttttgttaaagagccttcagtcgcaatgctacccagcaccccatgtgccaaaagaaaccagctcctgtgtcaaagggcttccaaacctgatctcactctcaacaggcgatggtgctgatgtttcaagaattgtgtttttataaaacagaggtctcagcatagtcactcttcacatagtgccttacccatgggtatcgtcatatccgggtcccagttcagtttgtctgcacagcagccaccctgcctggcaacagagaccccaagacctacacagtgaaccctactgccccaaaggcgttctccaggtgacttgtgaaaacagacctccggggaagtgatttattgggggtgtacactgggggcaatatggtttagcactgaattcaatttgtccttaggtctatgagtgagtccgatcttttcttgtgaaaggttttgggcatcgtacaacccactctgcctagaaggtgtggaggactcaccacgggcagggtcgccctggcccacagcacgtgagcctgcactcactgcggcctttgtaacaaaaccagttgtggtcctcagcatttgaagcagctgcatacttcagagtaaactatttttcattatttagttttgtcacaagaaatcgaccattgtactactctcacttacagcagttaaacagcatagaactaaaaacctgtctgcatttccattttttctttctgtatggttgtgggttttaggacatagggggttaggagaaggggtttcttgatcatgtcatgaattctcctttgtcctgtttctcctgtttcatttctcctccgcctgctgtatattacctgagctggtgttgtatcttcaagtccatatgcgtatttgcagacctttcctgttcccactcttgttggctcttctgatttatgcacagatggttcccagcatgtgtccagtgcttcatggatgggaccatcccagcaactaatcagacttcctgccagtgtcctaacccccagggcaccctgttcaaccatatttaaaaattggaatttgtataaagttgcttccaagttttataatgcatcattttacatcttttgtaattaaaagcatcacaatgaggttgtctctgca

SEQ ID NO: 1643 - DNA, 115460 bp, Homo sapiens; identical to SEQ ID NO: 1642
  source 1..115460: mol_type = genomic DNA

SEQ ID NO: 1644 - DNA, 17272 bp, Homo sapiens
  source 1..17272: mol_type = genomic DNA
tacacccaagagtgtctataaacaacaacaaaaactgcaaaccaaaaactagtttacaatactgaagttataggaaacaagcacaaaaggccattgggtggggctggatggagcatgatctggtccttaaagtatgcagatcgcctgggaggcccagcctatggagattgggaggagagggagatgctggtgactggagatggtgagagcctgggctggggtagtttttagtcatgggcttatggaccctcccctcttctccagctagctcaggcctttaagaggcaggcccaagaagggaaccccaggaagccctagaagctccccagcgcctccatcccatggacccggatcccctgcaggagggggaagttgagcagtggcccaaagacacagtcgtcctcctggcttggggctggggttaccagggtccccaaggggctggcctggaaccagaggttctcataggacttggggctgggggtgaggcccgccaagaggggctgagtggagtcacagcggagatagtgccctggccctgggcttgtggggctgcccagcagctgcccataaaggacctgatcgctggtgccagactgggattggggctgggtggaaactgctcttgggtccccctggagcacataggtctggaccagagtggggaggccacaggtctctgagctgttatgggactcccagggcaccggcttcttttcatcctcctccagcactgtgagcttggtgatgggtggcgtgccaaggccgggcagctggaaggcatcctgcacacaaggatgtggggtgagagcacggctcatttcagatgtctgccccagccactgtccctgtctgggtccgggcagctgtggggacattcaactgttgttactggtggaacacaaagggtaccacttgcaaagcactagtatgttcctcacacatgcctgacacatgccatgcaccgttcagactcagcatggtcagtttttccatatcacagggaggtgactgaggctttgagatggacagaggtgggattcaaagttgggtctgcttcagtccaaagggacgagatgttgccggaagtgacaggaaggcctgagtacttggcttcagaaggtgtcccttcactgagcctgggccgacatccccatctcatttccctctccctcctggattctcacctcctccatgattgtgggcacccaggagcccaggctgctgtgagctgggtctgggacacttggccagaggggattcttcctgctggagaagggggcaggtggaggctgagtcagacacaccctccgatctttccattttttgtcccacccaccccacctgaagaggtgcagctgcccttagtgcagagagaagaagctgggggctgggactctcagacatgggccccaaagtttgggaaggctggaagggacttagatgggcccatctggacctgaggttccctgtgggtgggggaagcaggatctcaggtctctcaaagggactcacttggggctgcaacagagccaggcagttccacagaggcaggtgagcaacagcaggaggccgaacaggcccaggatgatgtgtagctccgacccctctgcagtgagggcagggccggaagaagttagaatgcatgttgggaaggctgggtctcctccctccgaccaggggattcaaagtcagtccccagctactctcaaaatcagcatcctttgggtggggtaccctccaaacagccatctctgcccagcccccgtctccccttacctggggtcaaggtcatcagggtgaggactgtactgttggtggccccagcctggctggcagccatgaggtggatgtgatacagactggcgggctccaggccatggaggacaaagccacgggaggaggcattcaggatggcggctgggaggggtgtacggtcagcataggcctggatggtaaagctgcctccgtggcagctgagcacccccttccaggccttctggggctgtgggggaactgaggatagactcacagaaggactggttctgagcgttggtccagaagatggtgtagtgggtaagggggctcttccccagctcagggggctcaggcacccactccagctgtgcccaggtcttgccaatgtgctttagatgcagctctggggcatgggagggagctatgggaagagagaggtgcgggggctgaagggagtggggcagagcaagagcccggttggacttcttgtggcttcccagacactgtggggtgggtgagaaaagagtccaaggggactcatgcccaagcctcatttttcccagggatttaatccagattccatctactgctaataagtgtctgagccaggatttgaacctggctctgcttgactctaaagcctcactttctgatttctaccaggcctgatttcatctgatttactctctgatttctgccactcactctccgaatttatgccaggtcctctgtccaatttctttttgtttttgagacagggtctcgctctgtcacccaggctggagtgcagtggcgccatcttggctcactacagcctcgacctcctgggctcaagccctccgatcctcccacctcagcctctcaagtagctggggttacaggcatgtgtcactgcacccagctaatttttggtttgtttgtttgtttatttatttatttatttatttttctgtagagacaaggttgcctaggctggtctcaaactcttgaactcaggggatctgcctgccctggcctcccagagtgttaggattacaggtgtgagccactgcacccggcccctctgtccaatttctgttacatataacaccttatttttgtctgggaaatggtttgatttttgccaggtttgctccttgaattgtgccaactccctactcaatttctatcccagcacctgatttctgtccagctgtagggatccagtgtaagccaggggattgggagagatcctctccagggctggaagtatggtaggaaggcaatgttccctatacttctgattgctggggaccaggcagagccttgggagagagaggagaggattctggaaaggggcctgatagttgacaaacccatttcttgagagtaggcatagacatgctgggagggtcccatggtgtcctggtacaagggagtcacgatgatctcatagagctgaaagggcctgatgttctctgtagagagaaaatggggtaggcacttctgttagggcctaacctgtgctaatgatcaggagctagcctcagacctctagtgagggctaacctggcctcatgattcagggttaacctccacaatatcttctttagatcatttgatgagaattagggaagaaaagtggaagagagagctagaagggtggcagagtcagggctatagaaaaaggatcaggttagactgtaggaagaacttcctgattatgaggatatgaaatgagaacaacgaaggatcaagaaaggctggagaatccatgtctcttgggcagttcaggttgtcccatgcctattgtcagataagcactgcctccctttgtccctggccctgcccaactttccaggccagcctcacccttcagcagaaaccccgtggctctcccattctgttccatcctccaggtcttgttgctattgctcgcgctgggggggcccaggccccactcaatcacatagccctgaggccatggattggggggctcccagcctacccagaggctgtgagggtctcgggccatggcatggagtctggtcagagctgggcctggagacagggtgggaaatggtggaatgaaggtgaaaagaatgcaggcccttgagccagaagcctgggttcaaatcctggctttgctatttacaggctgggtgacctttggtaggtcaacatcttagcctcagtttcctcatctgtaaagtagaaatgatgataaaagttcctaactcatagggtcttagtgcagattaaatgacttgatgcacgaaacaagcctggcatagcgcctggcatggagtagttcttgttagtgataacagctaacactctattgttcttggtatgtgtcaggcgtagtccttgatatattttattttattttactttactttaccttactttattttattttttatgcagagacttgctctgtcgcccaggctggagtgcagtggcgccatctcggctcattgcaacctccacctcccaggctcaagtgattctcctgccgcagcctcccgactagctgggattacaggcaaccgccaccatgcccggctaatttttgtatttgtagtagagatggggtttcactatgttggccaggctggtcttgacctcctgacctcagatgatccgcccgcctcagcctcccaaagtgctgggattacaggcgtgagccaccatactggactccttgatacattttaattcactgagtcctctaatagtcatacccaggaagtactactcttttccccattttactaatgagaaaactgagagacacagagaggttaagaaacttgtctaagatcacacagctagtaagtgggaatattagctatgattattgttattgtgattattagtcccaccttgcgaggaccaatgtttagggaaagcagtgggtggtggcagctgatttcctgagaatgagcaatgaactcatagaccaggttccaagtggaaaagcctggggctttctctcttggctttcttggcagaatgggctgtgagtgtgtgtgtgtgtgagagagagagcttaacctggtctggctaatgataataacaacagcagacacatgcagagcagttactttgtgccaggcacttgtcttaactcatgtacaccccatggcaccgctcagtaggtgctgttatcatccccatctgctggatgtgtaaacagaggccggggatgggaggtaacttactcaggtcacactgttagcaagtgataggactcgttttttgtttttttttgtttttttgagatggagtctccctctgttgcccaggctagagtgtaatggcgtgatctcagcttgctgcaacctctgcctcccaggttcaagcaattctcctgcctcagcctccggagtagctgggattacaggtgcccgccactatgcctggctaatttttgtatttttagtagagacaggggtttcaccatgtaggccaggctggtcttgaactcctgacctcggatgatctgcccacctcggcctcccaaagtgctgggattacaggcgtgagccactgcgcccggccaataggactagatttaacccaggcagtctagcctttgaattgatgcgcttgacctctgtgctcttctggctgccagccccctttacctctgctttctgagaagaccaccggagtgggacgagaggtcccggctgagttataggccacaagggccacctcctgggcttctgaaggcaggtggaaggtgcagctgagctctgtggtgttgcagaggggcaggatggccccagcctggcctgagggtctccaagaaaccacataaccttggatccgtccgctgtcttcctccaggggcactggctgtggggcacaggaggaaaaagagaaggggatgtgcagctcatcttgagtcaaggagagcctctaggtggggtggatggatcatacaaacggagcctccccaggctggggtccaggcttctcacccccctccccttttccctctgttcccttgtgctaggttctaggaaggagggcaggaagaaacaagttggtggacacagcaggctcttaactattcactgaaccacactgtgacgtgcgttacagtctgtccaaaagctaactcagctccctaggcacatgcaaagtgcatgcaaatcacatataaatgcgtccacgcctcccagacctgttggagtcctaagccccggtttgtagggatctgtttggactgcgggaggtgtcgaggtggagggatggccttcagagggagtcaccttccagaacagctgcactgtcctggggtccagctgcctctgccgccaccatgtgtccagtctgacagtgggggctgtggatggaacaagaagagggggtgccagttggggaggggcctggggcctggactggatactgttggctgctcccagcctctcatcacctccttaccccgttcggtagttctcagctccaggctggggctccagtcgctccagtggccaggcaggggccagcggatgcagcgtatctgcagggtgtaggccgtggctgggaggagcccgcagagctcatactgaagggcctccaaggggagggggcccacctggtgaggggtggacaggactctgagccttggatcgctgggccattctagggccagctcgagcccgacttaccctgccccctgcccccaccacctcaggctctccaggttgccctctgcctcaccagtgcccagctggcttctccacgctgcggcttgtggcgcagctcacacttctgatttatgtgcaggcctggctgccatggctcccagcacagctgtaggcagcctgcctggggaggggccgcttcagggctggggtccatggtccgcagcatggggggctccagtttcactgcaaggagtggggctgtcagaaggtctccctatcccaccctagagggctctgccttagctccctcttgtctccctgtctgtggttcaccatctgtccacgttgccaatgacacgtttctgtggttcgatctctatgtgtctttgtttctctctaggtctctgtttccgctcttgccccagggcctttgcactggttgttacttctgcttgaaatgttttccctccagatatccagcggcttgctccctcatttccttcaaggatctgctcaattgtcaccctcttagtgaggcctttcttgaccagcatattaaaatagccagtgctccccttcccccctctctctctatgcccttctcctcctttaatttctcctttctgcttattgctatctgaaattctatcttattttcccccccacttgaatctaacattctgagggcatttttgatgctttgtatccccagtacctagagcagtgcctaacatgtagtgggtgctttaggaaacacgctgaaagcatgactgaatgtgtctctttgcctctgtgtctcttcctgtctctgggtctgtgtccccatttctctgtctccagctgcacctttctttgtctctgtccctcttctgtgcctctgtctctaggtcttccagtgtcttcttgtctgtcgctagttctgtgtttccctctccattcctctcagtgtctgcccattttggggatcccctccctcccctgcatcacccaccaacatccatgggatcaagacacagttgtggggacatgctggtccccagcgcattctctgcctgcacccagatgcccatattctggtacaacagcaggtgtttgcgtgggatgcagcagtggctctgcccgtccttgggcacgcagtccaggatggagtccccttgggtctgacagttgccccggctcctgccaatagtccaggcttgggtgccaagcagaggaagaaagcgaggctcccttctccctcccagaggcatgcccagcatcctacccatgccctaccccagaatccaaagggaggggaccaaggtgggggcccctcctcacttgaaactcttcagagtgaagctggtgggtaggtgggtctcaggtcctggctcccactggcagatgaggctgctggttgtgaggttcatgaggcaggagaggttgtggggtatggctggagggtctgcatgtgggtgggaagagtgtgagggctttgggtgggaccactcagaaagcttcctctgggaccagctggccctgttgccttgccctggcttggttcctctgttgtcaccttgtctgtccccctgtctccaggcagagtggctctggaagggcagccctgggggaagctaagttgcaggcatgcaccggggcaagcatcacagactcccagcagcccagtggtggcccacttccaaggcccccaactctagaccctttgtcagtgacagtgtagtgtttgagttttcatcctggtcctgccattcattagccctgtgatcttgaagttatttaactgctccatgcctcagcatcctcatctgtaaaatggggataatggtaaaatcccaccccctagcgttatcacaagggctaaatgactcactctacatgaagtgctcagaacagtgcctaacttacaggaaatgctatgtaagtgttagcagtggccattactggtgctttttttttttttttttttttttttgagacagagtctcactctgtggcccaggctggagtgcagtggcgtgatctcggctcactcggctaatttttgtatttttagtagagacggggtttccccatgttggccaggctgttctcaaactcctgacctcaaatgatccacctacctcaggctcccaaagtgctgggattacaggtgtgagccactgcacctggcccattactgattcttaaacaagaacctcggtctttgttttttccttatgcctcagcttggcacaaactccatcctgctcagtttgaaaggaagtttgaaactggggtgggggacaagcccagctggtagaggatgttctccctggagacaccctcagatggctgaggacttgggctatgtagagtagtggtcacaacactggctttagagccacactgcctccatccttattaatgtgtgataagggcaagtcacttaccctccctgaacctcagtttcatcatctgcaaagtgaggctacatagtagtaccaactggtactactgttacctgatatcatgcccataaagtgcttattagataagagctcaataggtagtactcttttttttttttcttcttttttttgagaccaagtttcgcttttgttgcccaggctggagtgcagtggtgtgatctcagctcattgcaacctccgcttcctgggttcgagcagttctcctgcctcagccccccgagtagctgggattacaggcacccgccactatgcctggctaatttttttgtatttttagtagaggcggggtttcgccttgctggccaggctgatcatgaactcctgacctcaggtgatccgcctgcctcggcctcccaaagtgctgggaatacaggcgtgagccaacgtgcccggctggtaatattcttattagtattggcaggagggtgttggaggcagagtagttggatggctggaaggacttacagcctgcgcgcagctcaacctggtccaggatctgcaggctgttgccccagttcaggcagcaggagagaaaggcctgagtgtggttgaggtggggcagggtgatgatagattcctgggtcccatcagacagacgctgctgcctgcccccgggctgaagctctgctcccagtctccacagaatctgtggctccgggtccagatggctgcagttctgcttgatgatgcaggaggctgtgatgggatcccccaggtggacgatgggggctgagacactgatgtgcccgcactcctccagacctggggtggaagagaatgggccaggaacgacgcctctgcctagcagagctgggctataatctaggcctttgtactcctagactcagaggcctcaccttcctgtctcacccttcaagatatgggggctggaaatggaaggatggggacggagacttcgagaggctacgggggtgacacagagatagtgatgtgctggtaaccgtttatcagccagcttggcagagaaaagcagaccctggtttgtagtgtgtgcctttccgcggtgtaagtgctctcactgtagctgatttcagcctattgatgtgacatcattgatcggggagttgggaagagatgtgcacaattagtttttgcaagccagcaccagcacaccaccagatggagactgttaactccccagtgccctccccaaggatggtgcaagcagtgattagagtgataagaacccatagccacagcaatcttttcacaattcaaatctgattctgctaccccatctccatcgcagcacttcaatggcacattattgctctgaaaggcagtgtggtgtgatggatgagtgtggatgttggaactagactgcctaggtttaaattctggttctattgcttattaattacatgatcctggtatatttctaagacttcctgtgcctcagttttctcatctgtaaaatggggataaaaatcgtccctaccttagtgttgctggaaggattacatgcgataacatatggaaggcatttagagcagtgtctggcatgtgagtatttgctgccatcattaggataaacactcaaatccttcaatagctcctgtggcctggcccctgcctgaccctctcagttccagcttataccggtctctcagctccagctattctggctcattcttgctattctttgaaaactccaaaatctttctaatctctggatctttgtccctgctgtttttttttttttgttgttgttgttttgttttggttttctttttcttttcttttttttcttcaagttcttgctctgtcactcaggctggagtgcagtggcacgatcacggctcagtgcacccttgacctcctaggctcaagtgatcttcccacctcagcctcctgagtagctgggactacaggttcatgccagcacaccttgctaattttttgattttttttttttttggtagagatggggtttcactatgttgcctaggctaatcttgagctcctgggctcaagcaatcctcctgcttcagcctcccaaagtgctgggactacagatgtgaaccactgtgcccggcatgctgttctttttggagggactcttctttctctctcccacccctgtttcacctggttaacgcttaggcatcttgaagaaaccagaccaggcactaacgaactggaggaggccaaggtccctgtacttcctcaaagctcttattatccttcataattatagagtcttatgattatttacttatctatcactccagctagactataaattctgtgaggccagcagaccttggctgtttgcttattactgtattcccagtgcctagtacagagtaggaccttggtgaatatttattattattattattttgagaaggagtttcgctctgtcacccaggctggagtgctgtggcacaatctcggctcactgcaacctccgcctcccaggttcaagcgattctcctgcctcagcctcccgaaaagctggggctacaggcacgcaccaccatgcccggctaatttttttttgtatttttagtagagatgggttttcaccatgctggcaggctggtctcgatctcctgacctcgtgatccacccgcctcagcctcccaaagtgctaggatgacaggcatgagccactgcgcccggccgatgaattttttttgataaataaataaacaaacaaatcaacatacactttgcccgcaatgctttctgtcctctctcaggtgttcttaggcccgttttactgatggggatgcgaaggccctaagaggagaagcagtttgcccagggtcacagagcaagttcatgattctcaacaaagggcttctactgcttcacaggctcaggatttcttttttttttttgagacggagtcactctgctgcccaggctggagtgcagtggcgtgatctcggcttactgcaagcgccgcctgctgggctcacgccattgtcctgcctcagcctcccgagtagctaggactacaggcacccggcaccatgcccggctaattttttgtatttttagtagatacagggtttcactgtgttcaccaggatggtctcgatctcctgaccttgtgatccacccgcctaggcctcccaaagtgctgggattacaggcgtgagccaccgcgcccggcccagactcaggatttcaggctggaagaaactttacaaggttgtttgcttcaaaactctacctgatgctctgccctctacagcagggcttgagtggcctatttttgtatagcctaacaactaaagatgtttcttacattttaaaagagttaaaaacaagcaaagcaaaaaccaaataaaaacatgccacagggctgggcgcggtggttcatgcctgtaatcccagcactttgggaggccgaggtgagtggatcacctgacgtcaggagtttgagaccagcctggccaacatggtgaaaccccatctctagtaaaaatacaaaaatttgcagggcctggtggcaggtgcctgtaatcccagctattcgggaggctgaggcaggagaatcgcttgaacccggcaggcggaggttgcagtgagctgagatcccgctactgtacttcagcctgggcaagagagtgagactccatctcaaaaaacaaaaaaacaaaaaccaaaaaacatgcaataggcagggcgtggcgggtcatgcttgtaatccccatactttgggaggtcagggcaggtggattgctggaacccaggagtttgagaccagcctgggcaacatggcaaaactacatctctacaaaaaaatacaacaacaaaaaaaaattagctgggtgtggtggcatgccctgcactaccttggaggctgaggcgggaggatcacttgagcccaggaggttgaggctgcagtgagctgcgattgtgccactgcactccagcctgggcaacagagggagaccctgtctcacaaacgaacaaacaaacaaacaaacaaacaaacaaggaacagagacagtatgtggcctgcaaagcctaaacattactgtcagaaaaagtttgccaacccctgctgcacagcatctttatcaatcctggctttagcttgcatacccctggggatgggaagttctctacctctcaagacagagtttccatggttggaaaccaagctctgcctgggcttctttatttcaggatgaaacctgtccccttgtagcttccatcctgatccctttgctgcccaccaaggctgcataggacccatgggttgcttctgacagcttggtagagatttgcggacaagatctgcgcctcactggccttttccaggatgaccagcccgggtcgtctcaccattcctcttgggtggtggtttgcctgtggaagtctgtgggtgggagaccagctaccccacatctgtggctcagacttgaatcttgtgggattctctgggaatcccaggagccatgtggcagtgcaaggaaattcccaatatctctccttgtagcttcccctccccactgcaccctcatccttggccatactcacttccggggagcagcaggatgatcagggcagcccaagtcaggctgcagtttcccagccttgccatagcaccaacttgatgttcacctgtaggcagaagggttgtttaagaccatgggctttggagtcagagctgatcttaatccttgtctgtcactgtgcagctttgactaggttgcttgacttctctgagccttcgtttctttgcaaaatggaagtaacagcagcctatactgcatgggactttgagaggaagacacaaaatgatgcaagtcaagggcttttcacagtgcctggaacataggaaatgacagtgacagccacagttattatacttgccttccaggaaagagcagggaaaggagcagtgaggaagagcattcttccgccttcccagctatctaagctaggctacccctagagagcagaacctgagatgaggaattgcatgctggtagtttattttgagaagatcctagcagcagataagggactggggagaatgaaacagggaaggagagaaagccagcacaaagttacatcatcatgttggtcacctctatggacaactggggctctatcctgctggaaccttccaaagagccatgtagaacacttctcagagctgtccactggagggtcaatttatcccttggatgggagggaagatggaaagatttacccactgactcctgccccccattggtcaagggatgcctcttggggtgttcattccctggcacatccaggttgggcatgcatgagtactaggcaggttctcctggggaagccatgccagtgttgtcagggacactccctggaagaaagggagaactctatggagcagctgaggcaaggggctgtcaggttatgcctgcaggaagctggctgcctcagccatgtgggctgagagaatatcaagtggggcacccgaagggtccagtgtgcccccaattttgggcacagacctctggtggccttctggggtcaggcatcatgaggtcacggccatagcacctggatggagggtgccttggctccagtcttaggaagtatgcagaggtttctaccacttgggtgggtgtccagcctcatcttcaccctgctcccattggggtcttggagccaacacctgatcctccagcacgagttggtgctcttggtggcagatcagtgggaatcgctggtcagcttgcacgtacatatctggacacatacacgcaggtggtgtcccagcagatccctcgtgctcagcagggagaaaggtaggagaatccttttctcttcctcccagacagaggtgtggataagaactgcccagatacccaaggttgttactgctcacaggggtcttacccaaacccccagtctatccatgtatatattgcagtatcggaatacccagtgactgctagcccgtaagtctcctttgtgcaaatcagaaagaaagcaccccttcctctggatggatgcagcaccacactaggacctggcaactagggaacagcctggatttcggctccagttactcctcagttttgtgcagtgagaaacctgtacaagtatcccgagcatctgtctacccatcggtggttggtaaccttcttactatagcataccagtttgattatccccccgcaacactggttggggaagatttagcctccaaggcccagattttgggacactggttttcatctccatgtgcttttgatcctatcccagccctgttgccctagccagggtcagcttcaggcccagcctatgccccgtgcagtaccaccctatccgcctccactggctcctgtccagagtagacaacctaaccccaagaggccccggcatccttcccctgggtgctgggtgttggcctgcttggcctcagtctctggtcctccactgcagccctggacgtcccccagcctggttaagtgggcctaggacctgttggagcatggtctcactctctggggggccgatatgcagagaggtttggagcccagctcagattcaggtcacctgacttgatctccagctccgccacttaccagctttgtgatcttggacaagttacttcacctttccgagccgagcctcagtttccccatctgtgggaaagaaataacattagcactcactcctcagcgttgttgtgaggatgaaatgagattattttggtaaaggcatttagccctgtgccttgcatggagttggcactcagcaaccataggttattttcacgagccataaatagcaggtcagcagctcacagaatccagcacagttcagttttcccctcacccctgcctccctcacagcctgtgtggtcacacctcccaggactgccaccttgcttttgtctgtgccacactgcgcagttccaaagccccctttctggatcctctcctcctaactcctgggccccctggccctcctgtcactgcggccatctctgctgggctctgcaggtgctcactcctgtggcccagcacagctcgatgtctcctgggctggctgccttcacattccctctttctgtttctccctcatcacgctcagccctctcccctcacactctcttccccacttcacacccctcgctcccttgctgtttctactctcacctcgagattctttctgtgggaagggtggggagggaggagggggctgggaataaacagaggggagaggcatttccagatatgctgcagataaagaaaaagagagagcaacaggaagagtgacagagtgaggcggtgactgaaatccacacagactgaaacgacagagagactcgccaagaggacgattgaggccagagagatatcgagagacagagaaaaagggcccaatgtacgccgacccagagagtgggcggggggggggcactcggaggcctggagcccgggaagcgtctgttaccgagagtttaagattcaagagatagcaggaaatatgcgagacagagaaactcagagagatagcaagccagagagaagctgaggaggaaagatggaaacagagagtgaaatagagacccagacggggaggggttgcgcggctggaactcacagacacacacgtcctgagagacagaggcatggggaggggagaatgattatgcctgtccccagcccagctcagtgtccccaaggagatacttggctgtgagtgacttccctggtgcaatacccccaaaagtaggggcatcctgtgaaaagagactcagtgtccagggctggggttccaaaggacgaatcccgggccccaggcctaggaccccggacatgaacacttggcagagctgtggggagtggccccaggattccagctctccatcaagcccaaggctcagcccctctctagggatcccctactcacgttggcacctctggcccagcccctgcttggcctccttggtctctcttctcgtcaagagaagttcctgaaaccagctgcagtccagcttctctccccgagctctgtcgttaatggctcagcctctgacaggcccgggggctggggattgcaacaccttccgagcctccctcctgccctcccttgcgccttcgagggcacaggcagccccttcctcccaggaaggagcctgtgagggaagctggtgaggcccgggcagccttcctgccttgggggtcttaaagggctggggaatgtggcaacgatgtccccctcccctgcctccggatttcctgagctcaaagctttgaggctgggcagggcccaggctcccacctggctgggtgccatccttatgccccctgccctgggggagcatcacttggaggcaggccctggctggaaggctcacccggccctaagcctcttttcagctctagccttggggaccacatcttcacagtactc

SEQ ID NO: 1645 - DNA, 17272 bp, Homo sapiens; identical to SEQ ID NO: 1644
  source 1..17272: mol_type = genomic DNA

SEQ ID NO: 1646 - DNA, 17272 bp, Homo sapiens; identical to SEQ ID NO: 1644
  source 1..17272: mol_type = genomic DNA

SEQ ID NO: 1647 - DNA, 6173 bp, Homo sapiens
  source 1..6173: mol_type = genomic DNA
cttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaaggtgagtgagacttttggagcatgaagatggaggaggtgtttctcctacctgggtttcatttgtttcagcagtcaaaggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggttaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgatgagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctgttatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattacaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgtttt

SEQ ID NO: 1648 - DNA, 6173 bp, Homo sapiens; identical to SEQ ID NO: 1647
  source 1..6173: mol_type = genomic DNA

SEQ ID NO: 1649 - DNA, 33229 bp, Homo sapiens
  source 1..33229: mol_type = genomic DNA
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggcacagttcagcggaggcggcccagcggtcctgtcccgcgcctgcgcactccaggccccgccccgccccgcgccctccaggcccggcccgccctccaacctctgcgtgcgcacagcctagagcccgcctccgtgaaagactgccgggcgcatgcggtcggggttgttcactggctgtccggggctccgcgcgcgtcgccggcccagctctgtcgctgacgggaggatctgaagccggccgcaggtaggctgactccagggatcccgggggggatctgttctcccgcgcaggagtcagcggcgcgagctgagcccggcgccgaatagccccgccgccgcggtgacggacgtcgctcctaccaatcaggggcgaggtgactcggcgtcctgcccaatgggctgtgtgcctaacgggagtggggcgggcgccccggccggcgagctgccggctcccgcgcgcgggcctcgtggccgggcggcgctggggagaggggccaagcggggcgcggggcggcttcagaggctgcggggcctgcgctgccgcgctgggccgcgccgaatcagctcggccgggctcgtcggacggagaaggccgtaggggagtggagcggcgcccccccccacaccctccgcccttgctcttcgtctgcgaggaagcccggcagtcgcccatccattcaagcagtgcgggcctcgggcctccggcctcggcgcgggctcagccgcccggggctgggcgcggcagctccgcgccgtaggacgagggggcctgcgaactcgccggccctgggccccgcggctggcctttgggcctcacggcttcctcccttcccggcggccgggggtcggggcgctggcggtgtatagagctcaccacgtttgcgtggcgcccttccgtccacgctcgttacagtttcgaatcctcagcggccctgtgacgcgggcggcgcagagattctcacccccattcccctaggtgagaacccgcgttgcaggcagctcaagtgacatgattgaggtctgcacactagtgatgggggctggcacttcatctcataacattgaaagaaaaagcatttcccccctcagtctttgttgaatttctctgatgcgtcttgatttacgttacttctgtgccggaaaaccttcttgcgccttccgtcaccttcaggattaagttcagattgggcatgccagtttgcacatgatctggcccttgcctacctttccagtttatcttccactgtatatccctgcttccccgccttccccctcacggccttacctctgttctctgtagctgccctgcacctgcctgttcaccctgttccctttcctgtgctctgagtcgtgcagtcagtccttcaaggcccattgcaagtcatatctacaaaacaggagccgcctggatccgcccactacccccaggacttgtctcaccttcctctgatggccatggtactgaaagcgtctgctctcatcgtccccctttatagtctaaacatgttttctgtctgcttccaccgtcactgaattactcatttatttgttaatgtttcatctctccaactggactgccagaaagttgagatatgggcccaaatctgattaatgtttgcagtccccaagcacagtagctgtcatgtaagtcagtagcccataaggatgaatgaatgagcctcccgcctgatctttatgtacactggcatatgtattgccaggcactgagactgcaagaatctaaagagagaaactaaagaacgtaaagagagatgttaaactcttagagtaaaattgggacaaatcaaatgtaattggatgagatgaatcttttgtagaagtaactcactcggtggcagaggaatttctaggatcatccaaaacttagggagaccagggtatagtctcagtaaggtatatgtctggttagaacatatctaaaatgtacctaagactgattttcatgtgtcaataaggaactgtaaagtgagagacttagggtcagataagcttggagacaccgcatactgtatagcagtgatcacagtgcgagtttacttgctaaacactcccaggattcttgcgttaaatgacttggtttaatcagcgtttctctgatttatatccataacaccctttttgagaatcccatgtgcattttgttgaaaccagggagcatgcttttggaaatgctgcagcagaggatgcaaagagcctttggagcggggaagacttctgagcattcttccttccctgccaagtgtgttctttcttgctctggggagggggtggggcgggggaatgcttcgagcacaactccttagttttcttgttccttagtttatttttatcataatttggcttcacatggaacgttcctgaggaggaaaatgtcctgaccatgccaaagtaagcattttctgctactttctaattgtgtttttcattttggtcacatttgggtttgctgaccaaatggacgatcctggacctctgaagctggggaccagtgataaatcctccgtggtgagcctgtcacggtctcctcacctcttgtcgatgctgttttcacctgcatcttgactctgctgcccttatatcttatttctcctttccctgccaccgtggcactgctttttggatttaatctcatctcccctctctttgagtcctctgcccgtcatgtgcttcagactggtttcttatctgatgtccctctcccccagtatttacagtctctcttcattgcatgcctgggagagatttctgacaaggagcaagttgttgttaaattatagaagagaactactttttctttttttttgaggtagtcttattctgtcgcgcacgctggagtgcagtggcatgatcccagctcactgcaacctctgtctcctgggttcaagcgattctcctgcctcagtctcctgagtaactgggactacaggcgtgcgccatcacagccggctaatttttgtatttttagtagagatgcggtttccccatattggccaggctggtctcgaactcctgacctcaagtgatcctcctggctctgcctcccaaagtgctgggattacaggcatgagccaccatgcccagccagagaactacttttaattaaaggaattttggtttagctgcaaccacttttaaatgttgatgttctttccttttagtctatcttttgtaacctagaggagctgtgttttcttgatgatatgttgtagtttagccaaagacattatttatttcctggagaactggagtacttatccaagtttgaatttttttcccatgtagggaaaataatgaggcacctgcctggtatcccagtgtctggcagtgatgtcagcaaacatttggggtgtagtgttctatcagccagcttagagctggttttattaggttgactctgaaggttattagttgtcaaagctttaaacaaaagctgtgttattagagtagcagttgtttttctacacgtatttgactaaagccattcagtgatccaagaaatgtttgttttgatcctatttaaacctgacgagaaccttctgaagtcctgtgacagagaaactgaggcttcaagagggttcatagctaataattggcagagccagtgtttgaacccagatgagtttggtttgttgagatacatttatatcatctgtaatttttccttcttccaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtaagcacagtggatttcttcataataattgcatgtggcagaacatgtcagcacttgggaattatgtgcacggtttgcataacttttattttctgccttctaacaggtcccttaatacagcagaatgatacttttctcacctagaaaggaagaagcagaattctttttttttttttttttctttgagacaggatcccactctgtccctcaggctggagtgtagtggtgtgatcatggctcgctgcagcttccacctccttggctcaagcgatcctctcacctcagcctcctgagtagctgggactacaggtgtaaatcaccatgcctggctaatttctaaattttttgtacaggtggggttccactgtgttgtccaggctggtcttgggtcctcccacctgtaatcccaaagtgctgggttttataggtgtgagccaccatgcccgactgccttttacttctttgttgttattgagaacctgtcaatggtgtgacatacagctgtggctgttacttcaaagattaattgcttaaaactgggagagatgttaaaacatacctcttaagttttaaaattctgcattcgtactcctactctctagcgttgaggtgaaaatatgcaagcattaaatgtcactagtgcagaaatcctcgtaacaaatggcatcaggaaaagatccatatacctgagtgatatttaatacagaattcttgagcagaggatgagttatctctctgagggagaaaatgagactttttttcctttcctgtgtttgagcttgtctcctattgtgatggtaggaatgaatcattctgggcaaaatttctagagtgaagtttcatggaatgaatgtgcaacaaaagaatggggtaaatatgtgcagtttcacaaagttgtttagaacaaaagcagagctcggaagctgatttttataatcagcacaagcttaatatgcatatatccaggttttgaatcaaatattgttatcatactttaaaccatattatgctcaattaggagacgtttctgaaggttctttttccctaagcagcagatgctgtatactactgtaaagtcctgtatgcacagcccactgggctgtcatttcttcccatcccatgctattttataactcttcttaagaatgagtttgttgacaggctagaagtatgaggttaccttttagagaatagctggtaatttttctttttgtgtgtcatatttagtcttctagaagtgaatttctgtgcttcctattacgtaattgcacaccttgttaatgagtgttttatttcaggattgcagttgtgccatggtataggtatttttcacttaacgtaaatggtttctctgttcactgcaggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaaggtaatactggatttacctttaaagcttaaaagtcttaaccagtttaatttcttctccctcccacctctacacagatgtgtaattcccttttgagtacagaagtttacattgtatgtgatttcagcatgaaactctcaaggtattgttactgaaatatgccttcagttgaaaaatcagaattatattgttgtttgctaaaaaaaataatttgaagaactacttcttcgttgaagcttgtcaattctgctaaggcagcatgatacgagtccagagagctgttgtttttacacagtaatgagtgtgaaagtggtaaaggcaactcgattagggcattaagccagatggcatgtatgtgtgcatctgggacttactatgtatagaagtgagaaggaaatgaacatctattgtgtatactggtttccaggccgttcatcagtgccatatggcctaggaggagcctgagaagtgggtttctgggtcctcccaagctttcactggcacagcttcgcttacatctatttgctgttttggggttttgtacaaacattcatttaaggaaaatgttttgctgctttaaaaaggtggggatggaaaactactgatctagtataatggcagtggcccaaatttggagaggttgctgaaaagtggctttaatctgagttatgagagcagatctgcttttggctttagactttactggcctgaaagctgagggtcacactgacagctggctctggtctggggctgccctggcaagattctgggctaattgggtcatgtttggatcttagcttcccctctcaccagctttgtgaacatgggcaaattaacctcttcaaaatgtggattccttttctgtaaaatggagacaataacaacacctacctctctaggttgttaggaagattaaagaaactaaaagtcagtgaagtgtttccctgacttcctgacacatagaaaggaatcagttaggaattagaatggttttgatcttacagtttgctgtttatttattcatcatccatcaaatttgcattgaatgctcactgcagtcagaccctcactggtgctggtgatgcatgtgatgagcaagaccagagaagtcattgcccacatggaggttacctgtgggggaggcaaacaacaaacatgaaacaaaacgagacgtctgtcagaagctgtgaagaaaccaagtggagtgaggacagagtgactggggaaagccactttgggcaggtggtcggggagtctcccaagagaggccatttgagctgagaggccagtcacagcgagagtggaatgagaagtgcggaggcgcagggctacgaaggcgtggttggtccgggaatggaggggaggccggcatagctaaggcagagtgactgagggagatggtcagagagcgggggtggtagccacagccaggttctacccagtcgctgggccgcagcaagaagctaggagtgtactcggaggagtgggaagccaccgaaaagttgaagtgtgggagtgatgaattctgacttgaattttaaaagatcactttgacgccatgtgtggagtagataatgaatattcttctgcgtgaggcaaatgaatatccttgtgcatgaggcattgctgtaactggagtaacctggagttaaacagtaatcttcaccttttaggaacttgccatctgtgcccaacaactatgatttttgaagtgttgagcaattgctggcattctttgagcattgacatggcaggcactttaccgagcattttacaggtgctgtctcacaaaatttccacagcttaacaggtggggaaaacaagcttaaaatggttctataattggcccaaagatccacagctaacgagtcatgagactaaggtttgaatccagacattctgaccccgggtgctgtgcttctaaccactctgctgtgctgtgctggctcactgcagtggattgtctaccctttggtaaactggaaacatatggaacagggtcccagaagtctcttgttcctggaagtgcactgaagtgtaatgtgcctaccttcagctgtgagcaatagggttggctatactggtgtgtggccaaaagggtagactctgcacaggggcacgtgcgcctgtgtggctcaggacactgctgtcagccttgctctgttgcagggcttccagcaacaacttagacatctggctgcaggaagtgtgagctcagagatttgttgaggccagttaaagggggcctcaaaagtatttttatgaccctattgctactctctccaggcaaagagtgctgcagtttgttttcacagtaagtgcatttgtctcaatcaatgtagatggacaagcgtaagttccctgtttgttttctttttcccagttgtccctcatatcacagatgcaatccaggagtgggtgatgagacaggcgttaatacctgtagatgaagatggcctggaacctcaagtgtgtgttattgaggtttgtatgattcctgcacatgtgaacaagtgtactcatctccttagtcagccatcaataactgataagacagttcccagtggagcccttggccttcctatctctggtgcagtatgttgcaatgtggcaggtaagggcacagttaacagtcatgtggaatggccacgcaagggaaaaccgtagtttgcccagtgttccttttttgtagcatttatggtacaatcacttagtactgattgtccccatgagtagtgtgacacattttcatctgtctcttgagcaagtcagcagatcttttgctttcgtctggcaagagcattcgtctccgaatgagcttcatttggtttcagtatctgtactcctgctgtgctgatcctagctgttggatctcagtgttcctcagataacaggagactcaaaagttccagcagtttgtttataactaatactttttttttgagacagggtctcactctgtcacccaggctggagtccagtgcagcagtcatggctcactgcaaccttgacctcctgggctcaagcagttctcctaccttagcctcccaagtagctgggactacagtgcgcaccaccatgcccggctagtttttgtacttttttgggagaggcagggtttcgtcattttgcccaggatggtctctaactcctgaactcaagccatctgcctgccttggcctcccaaagtgttaggattacagatgtgagccaccgtgcccagccaactgatgctttttcagtacaaaaattatttatggttaactaaggagataagatttaggtttttcttttttttttttttttactttgtcactgtgatagagataacattcctggcacctctctcatctgacctttttcttgaaatgatgtggaaagttccataataacctttgggaaggatgagcctgtccaaaagaataaccttttagtacaaagagttgtctaattcctgttaactgttaactaacattatacagggttagagagtccgtgttacataattactgatactgaatcaggaagacagaacagttgttagaaaactaaactgccagagaagggtttagtgcctaacctctgaaacaactttgttcttctagcttggtggaaccgtgggggacatagaaagcatgccctttattgaggccttccgtcagttccaattcaaggtcaaaagagagaacttttgtaacatccacgtcagtctagttccccaggtaagtaagacattgaaagttttactttgggggagatggagaggagggaggaaaggtaaaccggaatgattttcactcattgtctagtagttttcacttgaggtgcaggaagcagagaataaagaactttgtaagtttaaatttgttacaatcatacttttttgaaaagatcaaatagaaaacatttgaaaaatcagggcagttgcatttgcagatgtagattggccgtgtgcatttgtctttactatatggtggaactagagtaaagaggctgtttttaaagacaaatcttgtggagaggagtcaatagtaacaaaaattgggaagccggaaagcagatggatgcatagaaccgactaagctgaccttgagtgccggatcttaagcccgcagcagtgaaagcagagaagcagccctgtttgccctgcagaaccccaaaagctcaggagtgggatgagggtgggcctcatgtaactactgcttcagaagactcagaccctgacatctttttcctacagtgcacagttgggcgttagcctcctcccaccttggcagaagactggaggcttgttctctggggagggttcctggatgagcagacagtagggacagttgagggcagtaacactggactacaaacatggggttatgtgtaatgttaacgctgttgacagtccttgccttcttccaccatttggttcccagaatcatcatgtttaggcttggccattccacgtaggaggttgtaagattgtcttctggggtatggatagcccaggataaaagacactggctctggcggctccccatgaaataagccagccagattttcaccatgacaagcctacacactcacacataacttataggtagcatttaagcaggcctccatacacttggagaaagcatctgataggtaagagaccaaacaacagaaagaaagaaacttacagggaactgaggcgctacaagcagaggaaactttaaaaaaacaccaaaaaaccaaaaatgacctgtcattactattcttagaaaattagaaggagataagctatatccgttaggtaagaactggatgctataagaaagaaacattgagagaacagaaaagaatccttggaaattaaaaattagatagcagaaatgaaaaagttaagagaaagtaagttgaggaaatacccaaggaagtacagcaaaaagaccaagagatagaaaataggagagaaaaggtaaaattagaggactggctcagaagttctaatgtccaaataataggagttccaaaaaataagaacacagaaatggaggtataatctgaaccccaggggtcagcaaatgatggcctatgggccacatgaacctacccccccgtatttggaaatcaagtttatggaaatacagctgtgtctgcttgtttatgtgctgtctgtggctgcttttgctctagaacagtagagttgaatacttgtggcagagactgtgtggcccacaaaacctaaaatacttactatcagggcctttacagaaaaaattttctgaccccttatctgaacaattcaaggaaatttctagacatcagtttctgggttgaaagggcccccttggtgcctatcatattggatgacagatgacctacaccaaggcatattattgtgaaggttcagactaatggggcagaagttctaaaaggctctgaagagaaaaatcaagaatcattgtgccactggaccccttagcaacaatactggaagctaaaagacattgatgctatttcattaaaaattctagtggaggctgagcatggtggctcacacctgttatctcagcagtttgggaggcagaggtgggaggactgcttgagcctatgagtttgagaccagcctgggcaatgtgacaagagcctgtctcgatttaaaaaaaaagaaaaagtccaacagaaaatgatttccatcctacaagtccatgtgtaacgtgtatctgttaagtgtgagagaagaataaagatgatttagtacagaaaggaaaagtgtggcacatggtttgggaacagtatttaaatacttaaaaagtatgtaaacccaaaagaggactgcaggcacaggaaagtgtctaatgggggcaggatcctcatttaacagggaaatcaatagaaaatgcctccaagtaaatgtggagaagtagcacaccagcaagatcagttaagagttgaagagcggttgtttctagggattggaaaggggagagtgggtgagggccgatactgcttacaagctcggttagaaccatttgattctaaaatgcatgcatgtgtaactttgacaaacataaaagctaaattacacaagtgaccaaatgatctatttccttattaaaagaggttcaaggaaaagtcatacttgaaaattccttatcagagggaaactaacttttttttttttttcttttgtgaaatagccaagttcaacaggggaacagaagactaaacctacccagaatagtgttcgggaacttagaggacttgggctttccccagatctggtaagatttcctgatagctggttgcagtgtaatcttttatgtctagttaagatcactctatcatgacagacaagacctttgtcttgttgggttgcttttgataattgatgatggagaaaataggattagttctttgaaccgggctgtagtttgcaagatgttcatacttagagcgtgttaggtcttgtactccccagaccttatttttcctctcagtctttttactctcatttttactcctacttgggaacactaatggaggaaaatcccagagctcttgtagttcattaatgtattcatttgtactgccattctcttatgtttctccagtttggcgtttacggattttagctttgaaacgagtcataatatttttatggattatgtgcctggtgctgagagttaacgttttcgttcatcttaacaatgtgatgtctgttttaatttcagtcaggagaaacccctacttctgtcattttttccttctgtctaagccatcttgttctctactgctaggttgtatgcaggtgctcaaatccacttgacacatcagtgaaggagaaaatatcaatgttctgccatgttgagcctgaacaagtgagtagaaattcccatctctaataagttgttttttgcttctaattgtcctaaagcctcttgatcagtttcgtgaggcttgttattttctaattagagatagtgggctgttccagaagaacccattgccatcggccattccctgcctctcctggttccccaaacaacacctgtgtccctcctgcctcttctccgtgcctcgttgtactttgtgcttcagccgggtggagtatctttcggttcccctagtaccctccactctccctatgattgtactttttcactggctaatttctgttaagaacccatgtccccctcttcctgttggcttggcagtctcctactcactctcatccttcaggttctagcgaagacatagtgttgtctgagaagctttaactgccaaacctcctggcccttggccttcagggttaactgcgtccttcactgggctcctgtgtggtgtcgcatgtatgctgctgatgggcccatctttctggtgtgtgtgtgtgtgtacatgtgtggtgtgtatctcccttcacagactctaagcttctggagggcaagggccacctcattcaactttctgtttctggtgcctggtgtctagggtgttgtaggctgtcacagagatcttagtgtttttgttactgtacctatgatgcaggaaatccaaaatttggaacctgtaatgtatctaagtgtggtgcttagtatggaaattctagtggtgatacattgagcatgtagctttggccaggttttagatatttctggcctagcaagtgaaggaaattcaattctgtagcagaataggttgtcattaaaattgttcaattttttttttttttttttttttaattgagacagagtctcgctgtgtcgcccaggctggagtgcagtggcgcgatctttttggctcactgtgacctccacctcccaggttcaagcgattctcctacctcagcttcccgagtagcttggattacaggtgtgcaccaccactcctggctaatttttgtatttttagtagagatggggtttcattatgttggccaggctggtctcaaagtcctgacctcaggtgatccacctgcctcagcctcccaaagtgctgggattacaggtgtgagggcgcccggccttaaaaatattcactattaaaaatgtaacaagtatttccacatttaagtttaagtttcagattttttgctttttttttgagatggagttttcactttttcatccaggctggagtgaagtggagcaatctcagctcagtggaacctccacctgctgggttcaagtgattctcctgcctcagcctcccgaatagctgggattataggcacctgccacgatgccgagctaatttttgtatttttagtagaaatggtgttttgccatgcgggccaagttggtctggaactcctgacctcaggtgagccacccgtcttggcctcccaaagtgctaggattacaggtgtgagctaccacgcctggccttgccttttttttttaagagacaaggtcttgctgtgtcaccctgactagagtgcagtggtgctgtcacagctcactgcagcctgggcttaaacagccctcctgcctcagcctcctgagtagctagtaccttaggcggacgctaccatgttcagctgttttattttttgtagagatgaggtcttgctatggttgcccaggctggtcttgaactctttgggctcaggcagtcttcttgcttcagtcttccaaaatgttgagattacaggcgtgagccggcaatgcccagccttacttactcttttaattggaatgtttatcttactgagttgacttgatatagtctgaatacaagtctttcatcaggtatgtgattttcacatattttctccctatctgtgccttgtcttttcattttcttctctcttttttttttttttttttttttgagatggagtcttgatctgttgctcagactgtagtgcagtggcatgatcttggctcactgccatctctgtctcccgtgttcaagcgattctcctgcctcagcctcctgagtagctggggctacaggcatgcaccaccacacctggctaatttttgtatttttagtagagacggggttttgccaagttggccaggctggttgcgaactcctgacctcaggtgatctgcctgcctcggcctcccaaagtgctgggattacaggtgtgagccaccgcacctggccttcattttcttaatagtgtcttttagagcacagacacttttaaatttcgatgaagtccaatctgtttttttcttttatggattgtgctttcactgtcgtgtctaagaactccttgctcttaaccaaggtcatgaagattttcttgtaaaagttagttttaggtcttacatgatccattctaggttaacttttgtgtgtagtgtgaggtaagggttgaaatttttacatgtggatatctacttgcctcagccccatttgttgaaaagactatccttggatactattctgtactttttaaaaataaaggtacattatagatttactaatcttcataaagttgtttagacttatttatagctattcataatttttattactaccgtgtatttttaaaaattatattttctgattagataataccccatgtgtaggagaccctgctgacctctgtccattcatctacagcctagcaaccttactaaaattctattagtactgattgtttacctgtaaattcttttggtttttatggataagcagtgatattgtatgcattattcagtggcaaccgcttcttgttttctggttcatttttttttcttatctaatgataatggctaatatcttcagtacatcattgaatagaagtactgaaagtggccattctggccttgttctggactttaaatagtaaacattaatattaaaccatgtgatgtttactgtgggttttttatattgccaaattttccctaatcttaatttaccaataatttttattatgaatttggttttgaatttttatcaagtctacatctactgagggaattgttttcctccttaatctgttttctatttatgtggtgaattccactgttaaatttcctaacacagtagttctcaaacttgactgcacactggaatcacttggggagctttaaaaatactgatgcctgcctcctaccccacaagatcctaattcaagtggtctggggtgcagcatgggcttttgaccttttataagctctgaatgattccaatatgcagctgagtttgagaaccactgttcctagttaagccattcataggttcgtggacatgatttttttaaagctacatttgtgatttggatcatgaattattattattattatttttaagacaggttctggctctgttgcccaggctggagtacagtgatgcgatcttggctcactgcaacctccaactcccaggctcaagtgatcctcccacctcagcctcccgagtagctgggaccatgggcacatgccaccacacccagctaattttttgggtgtttttttttttttttgagacagagtctcactctgtcacccagactggagtgcagtggcacaatctcagctcactacagcttcaagctcccaggctcaagtgattctcccacctcagctaccccccagttagctgagactacatgcacatgcccaccatgcctggctaaattttgtatttttttgtagagacagtgttttaccatattgcccagtctggtcttgaactcctgagctcgagcaatcctcctgccatggcctcccaaagtactaggattataagcataagccaccttgcccagccatgaattttttttaaaggacttttgcatccatgttcataatagattggccactaattttctattctattcttgagtctgttttagtagtttatctagaaaattgtccttttttctgttttcaaatacataatatttttacaaggtcacgtagctagtaggaggctgtaagcctggtgagtttttgcttttatttaataacttgcttttttctaaacaggtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacaggtttgcctgcaatgaggagctgggagtgctagcctcctttactcttttgtagggctggtgaagccgactctagccctagcacttttgtacttttgcacttctgccatccactcattagaagagcctttgtagtaagagatgttcagaaaggatcttagctgtcacgtagctgtggcacagatgaggagatcctgatagggccaggccaggtgccgggcctccagacaatgagttcgggttatgtcttaacacgcttgtctcttaccaactagatcagtgcagatgggcgtcctggtggcagcgggtgagtgtgcatatccaaagcccacacgaatggctgacagtggctggagcactcctgggtaccactccagagttctgagctgtgtttgggaatgtgtctcaccccacaccagaaagggatcacattaggacggggatgtgttgctgcctactccactacatccttttaaggctcggtgatgctgtcacattccttcagaaatcttcacttcgtgtcttagagcaatgggcaggccttatcttagttgcaagatcaatatgatggcctagaagcatttggagagggcatactcattccgttgctctgtgagaatcatttttcatttcaacattttcctttcagtctttgtctgcttacatatagctatcagaatggcagttttatcatcctttttcataaaacattataagcattttgctctgttattatattttacaatgaaaacttttaatgagtgtggacttttctattttgtgaatgtcccataatttgtttgacacttgccttcaccccattaattcttgtgaattgtctatgtctgttattttttttggtctttggtatgaaaaaaattttttgtaggcaaatttgtgtgagacgttgaaactctttgtaagtttcaaaacaaaaacaaaaaaaaaatttttctttacaaagcctgccatgttgatctgaaaattacttcctctttactggtctgtacacagaactcagataatagctattcccgttatattcttcccaggtgtgtttttgttgttttttgtgggggttttttgaggcagggtctcacactgttgcccaggctgtagtgcagtggtgcagtcagctcactgtaacctccaactcctgggctcaagatccccccgcctcagcctttcaaagtgctgggattataggattatgggcgtgagctcatcctggccagacgtggttttttttcccttgaaatagctattttggtctcatgatagcgtgtaccttctgagtaattgggtttttcttgacgtttatttgatagatatgatcgcttgctggagacctgctctattgcccttgtgggcaaatacacgaagttctcagactcctatgcctctgtcattaaggctctggagcattctgcactggccatcaaccacaaattggaaatcaaggtaaggagggtggcacaggtacagccaaaggatgagcagggaagcagtctgtagtctcgtaggtgctgtgtcatatctgctttctgtttggagctcagaattactttttaaggaattactttttaaggattaaaaagatttgtggttgcttcgtggctttgagaagacagtagagcattttcaggaattaatgaaggggagagatggctagaggagagggtgagagagacttgagttcttggctatgactatcaggtaaccaaataaaatgccctgtggaaatggggaccactgatggaccacaggcatgctgcacagttgatagctggaggctcttggagactttgttggcatgtgggctgcctttcctaacctgtgcttatcacttattgcagagtgggaatgacagtattgacctcacggagctgtgaggtttctctgggatgcagggcaggcactcagtaaatggtagttactgtgttctggtctgtgccatggcgggcagcagctgagctggtggaatggtggggcatggccctgcttgtctgtgggtggcagtagagtgtcatggttaagagcatggatgccgtggctaggcgcgttggctcatgcctgtaatcccagcactttgggaggccgaggtgggcagatcacgaggtcaggagattgagaccgttctggctaacacggtgaaaccctgtctctacttacaatacaaaacattagccaggcatggtggcatgtgcctgtagtcctagctacttgggaggctgaggcaggagaattgcttgaacctgggaggtggaggttgcagtgagccgagattgcacctctgcactccagcctgggcaacagagtgagactctgtctaaaaaaaaaaaaaaaaaaaaaaaaaacatggatgcctgagcccggtgaccagggctcagattctagctctgtcatctacaagcggtgagacctagacaacttacttaaccctctttgtgcctcagtttccacattgttaaaaagggatggtgatggtgccttcctcctagggttgttgtaagaagttcatgaatacaaagtgctgagaattatgcctggcatatggtaagcactatgtcagctgtcgttaaaccctcccttctgcctgtcccctttattccttttcttcctggcccatcagctgaagcttttcaggaagagatgaaggtcagaggtaaagttggggctcagtgctgaggttgttaaacaggccccatgtagctgtccccacattggggtttgctttctacttcccaggtgtttctcagcgtgagagtttagtttgctttgtgctgctggacaggttcctgcagaatggcctgttgtacgagttttaagaatttaaatcccattacacagccctgacttcttatttgctagttctttccatcattcatttattttatccacttggagttagtctgtggctgccatgtgtttgtcaggtggcagaggatgagagatggatgaaaaggcaacggtctccgcctttaaggaatattgagtctcttaggaaggaaggagcacataggagaggctgaacctgctgtggcagacacatgaggaaggcagacttcctcatggagggacaccaggttgggttgggtaggatggagaaggctcggaaggggcattcctgttagaatagatagagcacgtccaagggcttggagatgtggagcagttggaaacactgtggatggaaattgtgaattggaggctgtctggagacaggctggtgagggcctgcccacaattccatgaactgggccaaatctgggtcttaccctgaggttcaggaaactaactgcagggtttaggtaggagattgtagaaaagtggtgaacaccctaatttaaaaagtgggcacgagatttgaacagacacttccaaaaaaagatgtaggtgataaacacgaaaaggtgctcaacacctctagttagggaaatcagtgcagatgaagtcacaatgagatagtgacacaaaccccctagagcggctgagtgttagagaggctgtggagctcttaccttgctgccgggagtgtaaaatggcaccaccacactagaaaacagtctggtagtttcttatcaaggtagagacgtgtgatccaataagtccattcccagatactcacttgagagacttgaaaacgtccacaaaaaaagatttttattcaaatggacaaattattcgtaatagctgaaatctcgaaacaacccaaatatttatagcctgtcaatggatcaatttgtaatggtttatttatatagtagaaaccactcagcaatgaaaaggaagaaaccaggctgaacactgactggctcaagcccataatcccaacacttagggaggctctgctgtgggaggatcgcctaagaccagtagttcgagagcagcctggtcaacatagcgagacccccgtctctgcaaaaaaaagttaaaaaagaaaaggaacaaacaactgataaacacagcaacatggatgaacttcaaaaacactaagcaaaagaagccagacacaaaaggttatatactatttggctccatttatatgatgttctataagaggcaaaacgaatctgtgatgatagaaattggatctgaggttgtttggggtaggaggtagaggggcacattctgggaagatggtaacttatgttttgttttgttttgttttgttttgttttgttttgttttgtttgagatggagtctcgctctgtcacccaggctggagtgcagtggcatgatcccagttcactgcaacctctgccttccaggttcaagcagttctcctgcctcagcctcttgggtagctgggactacaggtgcatgccaccacacccagctattttttttttttttttgtatttttagtagagatggggtttcaccatgtttgccaggctagtctcgaactcctgacctcaagtgatccacccgcctcggccttccaaagtgctgggattataggtgtgagccaccacgcccggctcattctatatcttggtgtgtatgtttgacaaaactcttcaaagtatgcacttaaaatgcttgtattttattgtatgtgaattatgcttcaatatggtagaaagaaaaagaaaaaacccacaaaagctgggcggaagatgggctgaggaggctgtcattgaacagaaagccctctagagtctgctgcagaggcttagctgagacccgatcctgaacacagtagagtgcagaaagagagagatttgggaatttaatgattttgaaggaaactgttgtattttaaaacctcatatttaaaaaatgtttaagttattaaatatattaagttgatcactttaaagccagtattaagatgatcactttaaagccagaatcaagaaagacaactttgataaaatgataatattatttaaaaattaagaacgcacagcctggggtcacgagcctgcttttctcccctgtctgaataacatccagtacatagattctgcggacttggagcccatcacctcgcaagaagagcccgtgcgctaccacgaagcttggcagaagctctgtagtgctcagtgagtagagttcgctgccttgggtttccagagttcttttggtttgttttaatgaaaaagtcctcttgttttcatgtgccagtagtaggtaattgacttgttaaaatattttttaattgttgaaaagactacatgccatctgatttaatccttaaaaaatgcagcttgtcaatatcattggatctgaaaagctgctctgattttgatattgtttgccatatgcatctattgatgaggctcatttaaggatttttcatccagaacatttgatgagtacccatcagtagagtctcatcagttgttttggcagctgttatttataatagtaaaacattagcaagaatttctggttcactagaacagttgaatattacggaggtgtacaccttcttctgagtgtcttggtcagtacggcacacagagctgatgaagaaaggcccccttaggggagcattttaagccaagaggtaagataaattgttaatattaatatatgtatttaaaattttgggctgggcacagtggctcatgcctgtaatcctaaaactttgagaggctgaggtgggaggattgcttgagcccaagagttcaagaccagcccaggcaacatagggagaccctgtttctacaacaaaaacaacaaaaccagctgggtgtggtcccagctccttgggagatcaaggctgcagtgagctgtgatcacaccactgcactccagcctgggtaacagtgtgagaccctgtctcaagaaaaaaaaattgtgaacaactcagtaccaaagatagtgcagtggcagtattacaattatgtatactatctttttcacttgcaataagcatgttcttaagttactaagaaaagtccatagtttcatatgcagtttctaagttgatagtgtttacatacaattcattgtcacagtagcacaatgtatggggttaattcatggcttcagtgtcttggtaatggcccgttaggcgattattgcaagttggactggtagaaaaggggaattgcctttgtggtttgttcttttgtgcagtggagtgctggttccaggaggatttggtgttcgaggaacagaaggaaaaatccaagcaattgcctgggctcggaatcagaaaaagccttttttgggtaaggagctctgcagtgcagtcttcacttaagagtaggaaagagtggggaacggtgccacgtgggagcctatgaacaaagtggggggattactgaaacatgctgtctttgtggataggagctcaagtagaagccttcatgttttctctttagagacaaattcagtcttggaaagcttatttatgcttatgagctacatgtagatgtcgtggaattttgagagaatgaattgtgaattcctgtccatttaatgaacccagctgtttgtagcacacgtgaggttgagttttatatctgctcacttggcacaacagctgactgtaattggacaaaatgattttgcatgcctcctggtgctgtacattttagtaattttcaacttgaacaattataaataaaaacttaatgagagagggtaagaaaacttgaattttaaagtactgaggctaggcacggtggttcacacctgtaaacccaacacttgtggaggctgaggcaggagggttgctggatcccagaaatttgaggctgtagtgagccaagatctctccactgcactccagagtgggcaacagcaagaccctgtctggggggaaaaaagtactgaatagaatatcacttacttctaaaatcggataactttgcaaatctagaattttcatctactttacatgcagtttttgaaatctaatacaagtaaagtgtaacagcagagagtacttgttcatagcaggaagttatgagtttgcaattataattctccaaataaaggacacaaaggccattgcagaggctgctgggaaaagtaggagctgccttttcaatggagttttgtttgttttttccccccgactggaaggcgtgtgcttagggatgcagttggcagtggttgaattctcaagaaacgtgctgggatggcaaggtaagcgtgcattaagacactcattcaattcccgcttgtgtatttctggaggatatgaggcctgttgccgcctgggtgatcaggagctttggagaagggcaggcctgggttcctagcacctcatggtgtgccgtaagggagctgccttgcctcttgaggaacagcacggctcctccatgcaggaaggagggagcacagccagactccctcctttgccttctgcctctgtgttcctgttcttgagattctgtcactttgatcaccgtggccaccatcctgaagctggtgcctggtgtgaagtccttgtcctaagtgaggcttgggcagttattatgagaacctgggctctggagctattgaaactgggctcagattccaaccttaccgcttatgggtgattttaagcaatttacttagcctttatgggcctccgttttttctgtaaaatgggagtaataaaggtacgtacttcacatgattaagggagataatgtatgtaaatagtctctagtagtgcctggaaaatagggaaatgctcagataatatcagctcttcgcctagctgtgtattactatgtgacagacctccctaaagctcagtggctcccaacagcagtgacttctcatctcagtattctgtggtttggctcagtgcctgggtttcagctgcacgtggtgtactatctgagatggcacactcctgccttgtgttcagctgtgagctcggcccagccgggacgtcaagatgctgtctccacctagtggctcatcattcattaatccagcccaagcttcctcacacagggtgggcagctggactccaaaatgacaggcctgttatgcaggcacttatcaggcctgctgatgtcccgttggccaaaacaagtcacgtggccaagccccgagccggcaggggaggagaacacacatgggtgtgaagactgagcatgctgcactggggccaccctggaatggtccaccacagcccatttattctctgtagcccacccgacaaatactagattttcagaaagaccttgtaaattctgtggaaaataaagtaacctgaaggaatgtaaaagcagtttgactttataaagaacaagtgactctggtggccagcatatggtttagggctgggtttcattcaccctttccctgagaggctgcttcacagtgacctggcggtgtggcttagtttggtagacagcatgcccttgagtgctggcttctgagtcctgagaggcactgtcttatcacccgccaccccagagctggctttctggtctccctggatccttcacagccccagacctctgcctctcacttaggttcccaaatgggtaggtgctttggtgatgagcttacacttcagttgagactggaccctggttcaggccaggaggagaacagtgcccagcgttcacatagtaccaggaacttggtcctttgccttttggtctttagtggttttgctttggttagacggtaagttcaatgaaggttagaaaggttgagttgaaatcagttcatttctgactgagctattgagtgaaacagttgagtagggctttgtattagctgctgaagatgaaagaagtatagaagaaatagtacttgtttatctcagagagacaagagtctgaaacattaagacaatataaaaacttggctgggcatggtggttcaggcctgtaatcccagcactttgggaggctgagttgggttaatcacttgaggccaggaggtcgagaccagcctggccaacatggaaaaaccccatctctactaaaaatacaaaaaataaccaggtgtggtggtgtgcgcctgtaatcccagctacttgggaggccaagacatgagaatcacttgaattctggaggtgtaggttgcagtgagccaagattgtgccactgcactccattctgggtgacatagtgagactcttgtcttaaaacacaaacaaacaatataagaactgtcacaggcggggcgcagtggctcacgcctgtaatcccagcactttgggaggccgaggcaggcagatcacctgaggtcaggagttcgagaccagcctgaccaacatggagaaaccccgtctctactaaaaatacaaagttagctgggcatggtggtgtatacctgtaatcccagctactcgggaggctgagacaggagaatcgcttgagacctggaggtggaggttttggtgccgagatcacgccattgcactccagcctgcccacacttgttgcccacaagtgtgaaattctgtctcaaaaaaaaaaaactgtcaaagatacagtatctaattaaaaattactaggttatgccattagttttgattttcccattttgtactgattgactttccagagagttatacttaacgtaaaaaaattcacgtgtgtgtgggttgagtattttatgtcttaaaaatgctatttattgccggtctggtggcttgcacctgtaatcccagtactttgggatgccaaagcaggaggattgcttgagcccaggtgtttgagactagcctggcaatatagcctttgtctctccaaaaaatgaaaaaaaattagctggatgtggtagtgtgcccctgtagtttgaccttcttgggaggctgaggctggcggattgcttgaacctgggagttcaaggctgcagtgagctatgatcgcaccactgcactccagcctggacaacagtgagatctcgtctggggatgaggtcagggggatgctatctttagtttttgttctaatcactgatcttaaactgaggagggaagttgtgtttagagcttagcaatgaaactattaatcactttcgtttgtaactattttcataacaagtattttggtatttcagatgccaattctacagagtttgaccctacgaccagtcatcccgtggtgagtcaagtgtttgaacctccacagggcttagaagggtgtagaaggggcatttatgaacgtgattgatgattagagacaagaagtgagactgcttgagtccatcccaaagaaccctgaggttttgggcactcagacctaccagagaggaaaaacttttctttttcattatgtaattcctccctaatctttcattgaccacagaaagtttttaagacaggtaccagcccaggaaactggaggggattcctgattaaaattcttctccatccctactcccctcaactcccagaacacagtatagatactaatatgagaccctggcatgtgtacttactgtgtgccagccgctgctctcactgctttcatatgtatattttatattaattcatgggatccccagccatagtcctgggagaactgctgggttggagcactggttggcttaaccgtatccaaagattttccaggctggcgtaccttgcgttagatttcatgccgagggcatgtggcattctcagcccgctgtactgttaggcacatggaggagggacgatgcctttaatcacctttgaattcccagcccagggtgacagggatgtaaagggaagggcacttatttacgtttttcagcagtcagcaaatgtgaatgcgtactatatgctgggactgcccttgtcactgaggacaccgtgctaaatgagacggacaaagttcttgatctcacggcacttagacagcatcactgtgtttgttgacctgaaattgaactttgctgatactaaggcctcaggagtggaccagcaaatgttttgcagcatggggctttggggtcaggaggaacagggcacagagagcctggaatcagaaggtgcctgggaacgctgggctgagaggtggactgggccatcagtgcatggcccacccagtcctcagatgcttgctaagctgcagggtgctagccctgcatcccttgcctttgagcagtcatcaggctagctggggcgatgacagacatgttatgacacatccagtccgtgtctgtgctactgtatcagtctttctaaggaagtgatgcttaccgtccacagtgctggggcgggactagcctgaggaggggctgctgtggtcctgtctgcagatcaggaggacaggctgaaggacggagcctccacccaaccgaggttacaaatgccaactgggaggcattttcttctgtgacaaaatgtctcataaggaaagcctggagaattagagcttacttacaagcctttgccacccactcagcgagggaggtttctctctagcggaagcagagttctgtagttggtgtctgttttctgaacatctccaggtcgtagacatgccagaacacaacccagggcagatgggcggaaccatgaggctgggcaagaggagaaccctgttccagaccaagaactcagtcatgagtaagagctgcctcacgctggcccagcctttggctctgcgtgcccaggacgcgtgtcttagggtgatgctgtggcttcgaggagcaggctggctttttttggtttcgttcttgcttttgaagttcattctttcctctcttattcatacccttttaggatgcactgtgatagccatagaagcagtgtgggtcttagaaaggacactggcagtgcagtcagactcctaggcatgggcgcctcaacagaatgaggcagtgaggttacattcatccttatcggttactttcctattaagaccagccatatcaattgctgatgtttggcaatttttgtcacacaaagatggcaatttcatatgattcagcctaagtagattctgttctaataaagtactaatagatgctgaaggtttagggtagttttcggaggaaaatagttaagaaaatgactattacacagatttccttcttgtctactgggaaaattctgcctttactgtattagcagaggcacccttgtgtctgtctgggcgttctgtagcagcatagctggagtcacttgagtatcggatctttctcttaccaactctgatgttctgtggatttggggatctcgaggcaactgtgaaatgagtcagtagagcagcccgttcgcaaatgtccagcttgttcacatgcagccactgagggctgatgacctttgatgaccatgattggaactgaatgatcatcagaggtcatctgtgcagctcttaaaatgcctcccatcctgccacgttcccagggccttgccgtttcgtacatcctgatttgctttccaaggcagttttctagcagcaaagtgcccatactttgcaatcatgtgtttgagggtggtggtgagagtcttgtttctgttacagctttctgtagtgttgtcagaaagagtcaaaagcccaagaattagtctaaactgtgttgttaagagcaggtgaccttagcagattcatagaaatagccctcaaaagacctggctgtgtggatgatgaaaagtaaagcaggaaggaggatgtctttgtgaacgcatcatcctgtgagataaagttctttacatacagcccgtttgttttgccagggaaactctatggagacgcagactacttggaagagaggcaccgccaccgatttgaggtgaggattccagcttgctggtactctggaaagatagtgagctgagagaccagcagaattatttttcatgcctcaacaggtgaatccagtctggaaaaagtgtttggaagaacaaggcttgaagtttgttggccaagatgttgaaggagagagaatggaaattgtggagttagaaggtgattattcgggcagttttatttaatggaaaacttagtaaagttttcttggcatatgggaaaatataaaaatgttatcttgttgctcctgacctaacagaattaggaagcagcactgtctcatgagggaaggggtcttgataaacatggggtctggactctagaaacttctttctggtacatggccttcctcggggagccatttaacttctggccgcagtttctccttctccaaaatgcttggagttggtactaaagccacttcagccctctcctgaaccgcaagactcagtctacagaaatcctgggagccagggtcttgggcgggaccctggacaggaggccttcagccaggaggggacagcacaaaccgtgctgagaaagggtatcagatcactcatgctttgaggttccctttatctagattcaaatgagaaagtcattttcaaattattttagggcctatggaaacaaacatttaagcagattttgttcttttacactttgtgcataaccttcacaatgaagctgtttcttttgaatctctatttcagatcatcccttttttgttggggttcagtaccaccctgagttcctgtccaggcctatcaagccctccccaccatactttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgcagtgcacctcccagtcctgccctggggatgacagcttggggagcatggtcactgggcagttgtctcaatactgattactacattctggtgccagtctgaccagttctggggcggggaaggggagggtctgaattcttagaccctattgtttgatgtagctgtaaattttggagatcttgaaggaagggacagatacaacaatgtggcacttgtcatttctgcagagcctcaggttttcatcaggaagtactttaaaactgacactgcttagagaacttttttttgttgattgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaaga

SEQ ID NO: 1650 - DNA, 16961 bp, Homo sapiens
  source 1..16961: mol_type = genomic DNA
tattacataacattctttattttacaagtatttattgaaggcttattattggtcatatatcgtgtaatacatagggaatcaaatggttagtaagatggagttgatccttgccctaatgaagtttaaagaccagagaggaatacaaacaggcaattatgacacagaatactaagccttattatattcagggatcttctgacacatgtatctgcaattttgtactcactgaatcttctcttccataataaaagcatgttgatgcaaaattactcagataaaagaactcattagtaatttttaaaattccatattaaatatatatacatatatattttaaattttttaagttccagggtacatgtgtaggatgtgcaggtttcttacatagataaacatgtgccatggtggtttcctgcacctatcaactcatcacctaggtattaacccatttatgccagaggttgcaatttgttgaatgtgaaaaatcagaccttggcaatgaccttgagcaggatataaagaacttccacatgcttagcattccagaaatggaacactaggcataaatgggttaagcccagaatgcattagctattttttctaatgctctccctcagcttgaccccccaccccctgactggccccagtgtgtgttattcccctccctgtgcccatgtgttctattgttcagctcccacttataagtgagaacatgtggtggttggttttctgttcctgcattagtttgctgaggataacagcttccaactccatccatgtccctgaaaaggacaggatctcattcctttttattgctgcatagtattccatggtgtttatgttccacattctctttttccagtctatcactgatgagcatttgggttgattccatgtctttgctattgtgaatagtgctgtaataaacatacatgtgcatgtatctttgtaatagaatgatttctattcctttgggtctatatgcagtaatgatatttctggttctaaatccttgaggaatcaccacactgtcttccacagtggttgaattagttgacattcccaccaacagtgtaaaagcgttcttatttctctacaacctcactagcatgttgtttgactttttaataatcaccattgtgacatgagatggtatctcattgtgattttgatatgcacgtctctaatggtcagtgatgttgagcttttcttcatgtttattggccacatgaatatcttctgggaagtgtctgttcatgttctttgccaactttttaatggggctccttttttcttgtaaatttgttaagttccttgtagattctggatgttagacctttgtcatatggatagattgaaaaaattttctcccattctgttggttgcctgttcactctgacagtagtttcttttgctgtgcagagctctttagtttaattagatctcatttgccaatttttgcttttgttgtaattgcttttggtgtctttctcataaaatctttgcccattcctatgtccagaatgatattgcctatattctattccagggttttataattttgggttttacatttaagtctttaatccatcgtaagttgattttcgtatatggattaagaaacaggaacagtttcaattttctgcatatggctagccagatatacagtaggattaattgaatagagagtcctttccctattgcttctttttgtcagctttgtcaaaaataagagaagaatcaaacagacacaataaaaaatgataaacaggataccaccactgatctcacagaagtacaaacaaccaacagcaaatactacaaacacctctatgcaaagaaactagaaaatctagaagaaatggataaattcctggatgcatacacactcccaagactgaatcaggaagaagttggatccctgaatagatcaataacaagttatgaaagtgaggcagtaataaatagcctactaatgaaaaaaagtccaggaccagatggatttacagttgaattctaccagaggtacaaagaggagctgataccctttcttctgaaactattccaaacaattgaaaaggagggactcctccctaactcattttatgaggccagcatcatcctgataccaaaacctggcagagatacgacaacaaaaagaaaacttcagtccaatatccctgatgaacttcgacgcaaaaaatctcaatgaaatactgataaaccaaatccagcagcacatccaaaagcttatctaccacagtcaagttggcttcatccccaggatgcaaggccggttcaacatatgcaaatcaataaacgtcattcatcacataaacagaactaaagacaaaaaccacatgattatctcaatagacacagaaaaggccttcgatacaattcaacatcgcttcatgttaaaaactctcaataaactaggtattgaaggaacgtatctcaaataataagagctttttatgagaaacccacagataatatcatactgaatgggcaaaagctggaagcattccccgtgaaaactggcacaagacaaggatgccctctctcaccattcttattcaatatagtattgggagttctggccagggcaatcaggcaagagaaagaaataaagcgtactcaaataggaagagaggaagtcaaattgtctttgtttgaagataacatgatcctatatctagaaaaccccatcatctcagcccaaaagcttcttaagctgataagcaacttcggtaaagtctcaggatacaaaatcaatgtgcagaagtcaccaggatccctatacaccaacaaaaggcaagcagagagcaaaatcatgaatgaactcccattcccaatagctacagagagaataaaatatctaggaatacagaagaagtgaaggatctcttcaaggagaactacaaaccactactcaaggaaatgagagaggacacaaacgaagggaaaaacgttacatgctcatggataggaagaatcaatatcatgaaaatggccatactgcccaaagcaattcacagattcaatgctattcccattaaactaccattaacattcttcacacaattagaagaaactattttaaaattcatatagaaccaaaaaaaagctcgtatagccaagacaatcctaagcaaaaagaacaaacctggaggcatcatgctatctttcatactatactacaaggctacagtaaccaaaaaagcatggtacaaaaacagacacatagaccagtggaagagaatgaagatctcagaaataagaccacacatctacaaccatctaatctttgacaaaccgtacaaaaacaaacaatagggaaaggattccctatttaataaatggtgctgggagaactggctagccatacgcagaaaattaaaactggacccctttcttatacctatacaaaaattaactcaagatggattaaagacttaaatgtaaaacccaaaacaataaaacaccctagaagaaaatctaggaatgccattgaatatattttttacatatcagttgctttggttatatttacatcctgaaagtcagcttgaaatatgcaattcttttaaaactctgcaggaaggtaacctgataatattctttagagcagggaatcaaaaaagatgtatatggcaccattcctgatttgtctttctagaatcctacaaaattaattctttgtaagttggtaatacttgtgaaaagtctgcaaaaagaaaagaaaactgtggtgcattttccaggtacctacaaagttctatgtgcattaggtgttgaagatatacagggagaaatacagattttcaatctggaaagagatgaaaacatgctacccaatcactccattacagcatggcatgaaagcagaggtacctgcgatatgcaatgggaaccaaagttctgatgtttctcacggtaatagagagagctggggagggtttcagagagcagcgtcatcaaggtcctgagtgataaagaatttatcaggtccagaggtgagatagataaaagtttccaggtgggagcagtccactgtactcttaattcatctttctgaaatacttcttctcagaatagcagaacagtatacctctcagatcatacaaagagtcatctgaatcaacagagtaaggatgacaaactactctctagagaaaaattcttctattcaagcagaaatgcaagagaggaaagtccacccagacaatatgaattaaacataaccccataatttcaggcttaccaaagctgaaagaagtcagctctaaaccaacagagcaggaaacaagaccattattcggcaggaaagagctagaagatagcaatcagttgaacaatactgtaattaagattagtaaatttgactatgacacttagtttgtacttaatttgaagtttacaaagctcttctaccaatttccaaactacaaactgaaggagaaggtaagttttggtcttcaatgaaaaaaccctggtttaggcaagaaagtcagtagcctaatagctaaggaaacctaagcttcaaggcagttcttctcttaaaacttcaacatgagcccatgcaacattaaactaatattcatgatgctcacagactggaatttaccaggaaatccaaatatgcctctaaataccatttacttatttgtgaaatggcttttttcactatttagccccaaggaagtctttaggcttgaaagacaagttctagcattttacagttagaaactctgtgagcttagcactgtaagagattaattttctctatctataaaatgaaactagttatatctactttacagaacttttgtagcttatagtatgtcaacttcttagcacaaagcttgtacctaatgaaaaaagaaaagaaaaaaaatagggtgtttacgataccatctttctggccagaggtactggaggtctataatctgtagaagtatactatagcagtctgacatatctgagaaagcctcttttttcccttctttaaatatgtcctccataggaccatcttcccttcaataacttatatctgtgaatctcaagagatccaagggccttattttctccttacaacaggctcttgggttcctcaaggtaattagagaaaggaaagacactcaggcagacagttaaactgtgaataaaatttacgctgtgaataaaacaaaacatacacttcaaatcctgacaatcttagaaaaaaatcactgtaatagaagggatttcaaaagagaaaaagaacaacgtgttgtatattgttccttttattaaaaaactgaacggtgaagccacccaagattttgcatcttcagaatttttttttcctttctcctgtgtagtctctggttgttcacattccaaaatgatgtttactgttttccaagggagtgttcaggagggcagctgccttggaggtaggtcaccaggactcctttgcattttgcatgcaaataaagactccagaagggactgtagctgctagaggcctttgctagctgctacaggtaggtccacactgtcgcaggctgctctgtctcttagccccaacgtctgttcatggctgtggttttaaaagagtccctcaacagatgctctatttaataactacaagacaataaaaactagggttacaagccaacaaggatcatattgtctcttaatatttaatcatatcagtttctttaagtaaaaaaaaaaaaaaataccagcactgatatttgagatcctggtatatttttgtaaatgttaagacattcacaggaaagatgccattctgaagctaaatgcttaagcaacatgtactgcacatgcaaccaacatgctttagaagcacatgcatctgaaggtaactgccactgaaaaaaacgaatatgtttctgaaacatacttaagaaacaggctaaatatagtaacttagatacattaacatgtataccttgcaaactttaatttaggctcagtgctgcctgaatccacatgactaggtactaggctatttatcccatttacacaacaaattaccagggtttatcttttctactggtggagcggtctccctaactaggagaaagagtgaagagttaaggataaaattttgtaaactgtattttgagaacagcttatttttcgtggaaaaaaaaaatagtgaacctatctgggaaaagtttcctattgcatcttcctcctaagctaccaccatacaatatattacagactctgagaagttctgaaataaagaaaactatttaatacattctatatttattcaactaccagaaagaactgagaagaaacagcttactaatttcaaccctaatgctcactttgatctgttattagtggctgtatggaacattgctgaagcttaacaagataacgcgacacaactgatgagcaattcctacctggcagatgtgtgggtcactgctggttcattataaagtttggaaaatgctaatataagataaacctatggtgctttcaatacttgttcccagttccctttttcatatctcacttctggtatttaagagccaagtaacagaggaaggaaaaggggaaagaatattatgttaaaatgcaaggaagggtaagtctctattaattttactctctaatcacctatttcttcatcaacattttagacatttatggatccagtgtgagcaatgatttaaacatctattctgaaaatgtgaagagaatgtaaagagtgaataagattctctcctcctcagtgaatagtctattaagactattttaatagaagccagttttacaaagctgggtcatgtcagataagtgatgagtatgtcaatttctctgtaaaagccaccttctctgtggaagacagatctaagctgctgtggcctcacatgtttctctcttgagggattcttttcaagaaaagaataagcaacctaaggcagcctaactactttacgaatgtgaactgaacttgagtcaaccttttttttagctgggtctttacccttttcggttcacgtctacttaggttacaagtagcattcttgggagagctgatttgacatgtgaaaacagaacataataaagtagaaaattactcacataaaatagtgcagacaacttagaaacagcagacaagcaggctcaagcaagaaattcataagaaaaccataatctctccagtcaccctctgatgaataaataggcattaatttgcataagccatcaggaagtgaggaagcttgcttttaataagaaagttagaaatttttcaatggagctcacccagtttgttcctcagatgtggcaaatcatatatccccacagttcccagctgcatgaacaaatgactgataaaatcagtgacatcctacaaagagtttacaatggtaaactgagtcattatgttgagattaagcatcatcatgaaagaagacataaaatagttaggcaggcactcagtgctaaacttctgatacttttcctccactgaaatactcttacaagtaaacccaaagttgtttaaaacaaaacaaaaaaaagacaaaatgctgagcttgatatattgaatccaaattttaaaaagtatacctatctcaataagtcttctaaaattgttatatcttaataatgaacccagaaggctcagtgaaaaaatgtcacaatattcccaaatcttttattgtagaaacacaggcgacatttctggctgtgtgataagcttgaaatttattaatcactagcacacaaagtgagaaattaaaccctctagtatggatttctcaacatagagttcttgtttctgtttgttttgtttttgagacagagtctcactctgtcacccaggctgaaatgcagtggcacaatgtcagctcactgcaacctccacctcccgggttcaagcgattcttctgccccagcctcccaggtggctgagactataggcgtgcaccaccacacccggctactttttgtatttttagtatagaggggtttcaccatgttgaggctggactccatcttctgacctcaggtgatccaccagccccagcctcccaaagtgttcttgttttgagtagcaacttgctttagaaacactgatggtcattttttttagcttatagttctattaagattggagcctttcaaacaagagctcaattagaaagccctaagatttgcttcactatcaccaaataaaatttccagccataatgagtctacttcccctctacatatttcctcagcccttgagtagcttaatcttcaaaataaaatctgagttccttctctactgctcccttttagagtcagtttcttttactgcctcagagaaagtaaaatgagaaacagtaggttagaaagcctattcaggctgggcgtggtggctcacacctgtaatcccagcacttggggaggtccaggcgggcggatcacttggggtcaggagttcaagaccagtctggtcaacatggtgaaaccccatctctactaaaaatacaaaaattagctgggcgtgatggcgggcacctgtaatccaatctactctggaggctgaggaaggacaatctcttaaacccaggaggtggaaggagcgagggcctgggagacagagctagactccatttcaaaaaaaaaaaaaaaaaaaaaaaaaaaagcctattcaacaggaggtcattttttggagcttagtttgttttacaggacttcctgtctctgggcaatttggtggagagaatgctacacagaggagctttatacatgatcatcattaaaaatgaacaaagtacataagagcataaagaagaaaaaataatcacatatccagccatcatgtaaagtcagacataattaagcattttcacagtattctgtttcgtgttgttacattgtgtgtgtgtgtgttttgttttgtttggagacagagtctcacgctgtcacccaggatggagtgcagtggtgcaatctcagctcactccatgctctgtctccagcgttcaagtgattctactgcctcggcctcccaagtaactgggactacaggcgtgcgctgctatgcctggctaatttttgtatttttagtggagatgaggtttcaccacgttggccacgctagtctccaacttctcaaagtgctggaattaaaggcaggagccaagctagcctgcattgtgtttttatataggagattgcctgcaggtacttttaagaagtgcaaatttgctaaagtgtgccaagtacaatgaaatggtaaatgctactaaaatctgataatcttagaaactggcctgtagatagtattgtcttttgttttggccagcccagtgttttaaaggaaatttgaatttgaatgcctctaagactgtttccatcttgccacaggcctgattactccttattagtttacataaggttatttcaaatgcttagatacccacccacctgagtgggccctaaatgtaatatgcaactcccataaagtgctcagataataaaatgcctggaggatgctgagtaagaaaaaatctttcatttttttattattattattattttgagacacccaggctggagtgcaatggtgtgatctcggctcactgcaacctctgcctcctgggttcaagcaattctcctgcctcagcctcctgaatagctgggattacaggcatgtgtcaccgcacccagctaatttttgtatttttagtagagacggggtttcttcatgttggccagactggtctcgaacgcctgacctcaggtgatcgcctgtctcggcctcccaaagtgctgggattacaggtatgagtcaccgtgcctggctgaaaaaaatattttaaaaacatacctagtacctcctgctcaactcaaactatgcaaaaactttagatgtcaaacttttattccttccaaacttttatctagcttgaagtcacatccaaatatatgtatctccatccctactatacccccaatttctcaagctgttaaaaccaagttttaaaatggcttagaaatctcaaatcataaaaaatgtttctctttcagataagccctgaataaacagaacttaataaagcaagtttctagcaataggagctattctgattgattccgaagtggaatgccgagaatggcaaagaagctgtgtctctcctggtgagatgcaggatgctgagggaagcagaaggtaaaagcaggagcctaaaagaatgctgtggtgtggaaaaactactcaacgtgctttttcctattctcagtcagcaacaacaatcaatacaaaagacttcggtgaccccaaaatatgtaggaagttctccccaccagcaagcaagcaatcaattctgcagcagacaccagctcagtgccctccagtacaactccaatgctacctaccaggagacagtttcagatcccgtaggttgagggcttagtccccaagactgcctgcccactttagacaccagtctcaagtccaggcctccagaacttctgatggactggcttcaaattggggttcccataaccccctctttgggttcaattaatttgacagagtggcataaaaactcagggaaacatgtttatgatttattacaaaggatatttgaaaggatataaatacacaggcacttgaagagatacatagagcaagttctggaagggtcccagacacaggagcttctgtccctgcggagttagggtggaccacccttccagcatgatgagttcttcttcaccttcctgtcagaccctacatgtttagcgcttcagaattccctcaaatctgttcttcttgggcttttatggagcgttcattgaatacacatgattaaagcatggataaccatgttaaaatataattaggttataaggacatgatctaaacctaacaaggcctgtctgttcagattcttcttggtgtctctgtgcagtgttccttctgctatggtatggggcagaatactctctggtatgagggtcttagaaaccataatcagattagagttctgcagtgggcagatgaaaggagggtaggagaagatcagagagagagattctggtttctgtaacaagggtcttgggagtgagttatgagccaggaaccatggacaaaacctatatatgtcataacatacaaatactctgcatgtaccaactactcaacaaactcgagcagcaagaacaataagaaacaatctacttcaagcatatctgaagcatatataaagaggataaaaggaagcaagttgtagggttccagtcagtggagaggcgtgaaaatccaattgatttgtaggataacaacaacgatggcaggtaagcatggcaagaatttgtcaaatatttctgtaatggcagtaggttgagtatgttttcgtttatgtaagactctttgaatagcaaatactactcaagttttgatgttttctctttttacaaaaataaattttaatgtaaaagatgctttctaattctataggaacaattctcacatgcaatacttattacatgggcttgtgttttccttgagttacgcatcctttcaagcacggtttccccagctgcaggaaataccctgatgcttatggtaaaatctgtaaactttctgtattaataaatgtcacccatcaacagtggatgactttattattcaaagtcaactccatcttaatatctttcttaagtttttaaactctgtttcccatcactcttgcaattggatttactaaaataacatggtattttatcactttgcaagctatgtttatctggaactacctgattatattaagtttcaaaaagaagtatcctattatattctactctgcctaaggaaattatggtgcttgtcataagacctaactactgaccagagtggttgatttttctgcagaaaaagaaaacatggccctgataatggttttgtcaaatgggcactttaaaatagacatatcctgaaatcagtagggcaggagtattttttctattgttattcctaatgaaagaataaggattcgatcaatgccatccagaaccatatgattaggcagggttctaccctccaacagcatatatattaattctttccaactcatggttgggaacacatataactttatttggctttaaaaagtgattttctattgacctaatgtgactaatgttcttaggcaatggcaaaacaccaaatgtgcttacaccgtgattcacaaaaagtgatacaattcctcattcagccaccagctaattccctctgtccctaccagctttggactactatttaagctaagaactaactgatgaaaaaataataaaagaagaaaactgcttttgtctatatctattacatctctggtaattaaataatgattttagaagtttccccaccagtttctccaattctgcagaatttaagaatcaaaagttttctaagtcaaaagaataaactatgtacttgtctctttttacctattcctcatctcctaaataatttatttaacctatttcccaactgaattccacttcattcattcattttttttgtaataaattgactaggtgtctattgtgtgtcaaagaagaagggatagagacagaggaaaagaaaatgacaaaaaattatgtacaaggtttatggtacatggtaacaattgccttgaatatctcttcctttgcacatgcattccacatgcaattgattcttaatctgaagtcaaagaacctttgaagggctgtgacagagtaactgtaagaggtctgcaaaggcctaggctcatcaacgtatacaccaaagattattttcaggttaaatataccacatatacattacaattttaaaaatttatatagatactattgtaagtatgttttttacaaaaaaaatgcgtagcatctggaaatgatactaaaaatagttaacaactggttaagcatgggtttccactaattcagtggactggtggccatcaacagctagcatggacaaactggtttccaccagctgcatatcacaccagcaaatccagttgaggaaaggcaacctcttcctctctatttcatcttttttttttccatattaaagaaaggtccttattttaaaaatatttctgggagttattattctaaaaaatattgtaaacttgcttggaccgccataaccttgtgacaaaccacaactcccatgagaaattataacaagtttagaactaggcctttgttggtgctttgtcttttatcatatttaacagagttattccctactttcccacttcttcccagatgttttaaaggctgtaaacctttcaccatgaaaaagtctgtcttaatttatactctatgtataatgagaaacgcctagtttcaggcttatgtatccaatttacttgaaccatttaatatttagcttacaagaaaagttccagcttgtgaagaacaaatgaaatgggctgcaatttgtgctaaactattttaaccctgagtatgtttgcaattggaaaaagtgtgttatgagaatgaacaatagttctttcctaatgagagaaggaaacaagctgggttgacttggctacctttcactttaaccagcctaagggagtaactcctaggttctctctttctgttagtttagaagaaaaaattactcaacatatttagtacatttaagataatgaatcatttaggcctatcactacctcagccaacaggtagtgataggaaggacagcatagtaactgcaagaaaacaaaatgtgtaatctctctatctttcctacagatttagaacaaagccaaatgactatggcaacatttagaaataaagtggtagtaataaggaaaataaattaagaatttagtcatacttaccaaaatgtaaattttaaacataatttatacatattcaaatgtagcactggtattttgtaaacctactaaaatcataattttaaataaagtggcaaaattataccaactactactactcttgggaagagtggtgtcaattccggtcatcttcttaatctaaaattaaaattctgagggtctactaatcagaagaggtttcagatatcaaatcattgaaaatgtaaatccaacttccaacaaaactaaccttaaaaaaggcaaaccacttgtagtcattcaacacaatctcaaagccttggttgtaaatgatggtgaaatggccagaattgccaaggtcatcatatgctgtatccagcttctgaaggtacaccactacttttttttcttgtggtcctaaagaaaaaaaaaaaaagcacaataaaggaaaattatttggatttcaataggggaaagaatcccccaatttcaattttaattgtgctgctttcctttcatgctacccagtttgagcacagtctgcctagtgaagaaaccagaggctccatcttgttgcctcaaacagttcctgctccgaggcaagactgtgaagttaggctctaaaaatttgagataatgcaagcagaagcagtggctcacgcctgtaatcctagcactttgcggggctgaggtcagaacttcaagactagtttgggcaacatagtgagaccctgtctctacaaaaataatttttaaaaattcgctggttatggtggtgcattgcctgtagtcccagctatttgagcggctgaagctgaggtggaaggattgcttgagcccaggagttggaggctgcagtgagctatgattgcacaactgcattccaacctgggcaacacagtgagaccttgtctcaaaaaagagagatatgctatgcagcccagcaggcagggagacccccaaaactacagtacctttccagagcatcccaacactgaagaaatttttccactgaacaaaaggagaaatggggaatgttgaaaattacaggcttccagaaacggagaaaaggcaaaatgctagtcaaaagtgggaaatgcaagaataaaaggtatgacaacaaaaagataaataaacagactatcagatcctaaggaagacaatgtgctaagcccaggagaagacacaaaatgatctattcggagaagaaatggggtacctttctcctcaaaggctctacagtttagaacctcataatctgaatccttccaaagtttattcagcaaactagaggtctgtatcctataaaaccaattagtgctgataggaatgatacgtttaaccttcatagatgagggctcagacctgtgggtgcctttaattactgaattaaggccaaaggtaattttataggcagagccttcctgaaaatgattcagctgtgtccatctggagagttgtgtattttaaagtttttccatgtttgagagtaatgctctgacatgggagattgcatgtgacagggcagtgcaaatcctgatctctttctgccccaaccttcaaactcaaatttaaaaaaaaaaaaaaaaaaaaggccaggcgtggtgactcccgcctgtaatcccagtactttgggaggccgaggcgggcggatcacgaggtcaggagatggagaccatcctggctaacacagtgaaacccgtctctactaaaaatacaaaatattagccgggcgtggtggcatgtgcccgtaatcctagctactcgggagactgaggcaggagaatcgcttaaacccgggaggcggaggttgcagtgagccgagatcccgccactgaactacagcctgggtgacagagcaagactccattctcaaaaaaaaaaaaaaaaaagttacaatgttcaggattatgaaatgctatacagtcagttaaaaaggtatttctttagtaacaaatgacttaatctttgttctgttgacaagaaaattatagctgattttttactgactctgcagaagtcacaggctgtaagagggtttgggtagaccacagtgtgactcttctaactagtgattgtcttttttccaccccacccccttcactaggttctttgttctaggggtaaccatgttatctgaaggcatatggaatatctccagtatgttcaaacactaggtatttattgagagccttccatgagccaaacattgtgcagactctgggcatttctaattactaggttcagagttaagttttctttgttattaattttttaaaaaatttttacctccttgcaatgcatgaaacaatgcagagtggtactagccgttttctagtactcatcaacacccgctcaaaccaaaatcgctgggcagaaagtccctttcccaccatctaacaaaaagagaaaacttcatgctatatcctcgagagtctctgagctcatctatcttcactagtaaaatagtaataaaaaataaaaataaattttaaaaataacgctaccagatcggactggagaaccaaacgattgcagttcccaagtctctctcaaagcaaacaaaattaagcgggaggaataaaaaagttcttgatcaaagtgttgagtccccaagataaccaagaaagtgtggagttagaagttctcagcagatgaactttaacttcgcgagcctggcggggaagaaggtccccaagggtccccgaatccagtcaagatgctctggccacccacaagcgtctgcctggggggaagcggtagttggcgtggcgctgcgttaggggctcaagggcagaaaggacgacccggaggactgccgagccggcggcttacccataaccgagcagttgacatcgcgctgggaaccgctggagcccacctggaagacccaggtgcccagcaggtcaagataggtgcagttggcaggtgtgtcgcagcgcacggcgccgtcgccggagagaagcagcaggagggcggcgagcagcaaggagggcccagcacccatgctgcagggagctgagaaaagaggtgaagaattaccaggaagccgagcgctgcgggctagcggtgagtccaccacgaggcgcgcgccttgaaatagctacg

SEQ ID NO: 1651 - DNA, 16961 bp, Homo sapiens; identical to SEQ ID NO: 1650
  source 1..16961: mol_type = genomic DNA

SEQ ID NO: 1652 - DNA, 44182 bp, Homo sapiens
  source 1..44182: mol_type = genomic DNA
tgcagttatttttaaaactttattttaaaaatatgagcatctattttaaaagttttgataattattgccattattttcttgtgattggtacaatttaaaaataagtctatgttttcacattgattttaaaaaatatagcatgtttgaattacaaatgattaagcaaactctattacttcatagctgaccatcttccagaaaattcccacttaattgaatacttagaaaaaaatggccagtggccgattgaaaggtatattaaaattaagggcagttttaattctgaagacaaatatcttcatggaaatctatttgtaagcttctgagattgctgctgaaagtctacagtctgtgaatataccaattcccctttacaactgatgcagatcattatgaaatactggaaggcataccctacaatttaggaattggtgtggctgccactgctatgctctcaattgcacactcatcagttcctctgcggatccggaagtagccattctcaccccagccggtgccccagctgtttttaacaatccagtaatccatcccagaggctgagtcagtgccatagcccacaagcagaacagcatgattagtcagctcaaaggggttgaaagggtctcttagaccagtgtggtggtagatcccctttttgtagtggaggaagtcatcatatacttcaaaagcaactgccatgggcccatgatggaccaactcaagcttcatcagggcttcattgcagcctccatagaaacctcctacatagtggtactcagaggagtaataacgaaagcagtcttccttcattttgcatggagaatcagtgcctgtgtaggggaagcaagcttcttccaccagcccaaaatcttgggcgtactttcctgcaataaggtatgggaagccgccttcacagcctgaagatgaataacacacatggttaccccttagtagaaaaaggattatcccattttctattttttcttctttgctccattattctttgcatgttacccctgaaagttgttcttagcttaagcatcacttcattcatccatccattttccaactagctaactatcctttcatcctccttctacttaacagatatctacttagcacctaatatggatgtagctatggcaaagtggttaagtggggaggctctgaagcctatataggtttaaagccaaagccgtgtgaagagtttaacttctctgtatctctgcttacttacctgtaaaatctagatggtagtagtactttcctcatagggttaaattagttacttcatgtaaaaatagcaaaagttaggtattatggtcattgctaagcagccagaccccacaacttggctctttctcaagcaagtcttttccctgacaacctcttgccgaaatgtctttcctaccttcctcatgcagtcctggccctattatatatattataactctgtactttttcttcactgttcttcactctgttgttataattatttaatctctatctcttacttaactgtaagcttcatgaggataaagattgtcttgatatattatagcccctatagcctacaagtcacaactagtagtacatattttagaaagaatgaaaggctcactggcaaataatcactcatcagcagtttcactagtgagctgggaaattcctagtggccaaatctgggcttgaaagcataaactttaaaatggtaacgtttctccctcaatcaattatagctgtgttttcgacatacatcacatacagcctgatctgaaagcctaagtacagattttttttttttcataacagggcctcactccgtttgcccaggctggagtgcagtggcatgatatcggctcactgcagccttgacctcctgggctcaggtgattcttacacctccgcctcctgaatagctgggactacaagcacacaccaccacgcccagctaattttttgtatttttaatagagaaggggtttcgccgtgttgcccaggctggtctcaaactctaggactcaagagattcacccatctcagcctcccaaagtgatagggttataggcataagccactgtgcccagccctaagtacagaattttaaaattctcccagagagaaaccagtgttagtatagttttaataaaagttgggttttggagacgatgattagaagtgaaactccaatgctaaaagctgtgagaccttcaaattattagaaaaatttcttagttcctgttccccgcccataaatagggattatacttactacttctcagagttttgagcattgttaggcaatatatgtaacaagcagagctcactcaatatatagtaactattgacattttgctggatggtacagtaaattccatgagcaatcatccattaataagtgatagggccagacttgcactcagattttctgactatagacactgcgctctctctactgcatcatccttttgcctttgccaacaacagccagctgcacacaggtaaatagctcataaatggtgtctgaaatgcaacacttaccttgagcatactggctacaagacacaacctcctgagggcttaggattggggtctgagaattgttggttagtatacggattctcgcttctagcatacccatagaagcaaatgagtagcagctgccacaggatgctggcgatgaaaaaaagacacataatccaagagacatctgaagcctcacagagaatcatgcaaaaaccttagtgaatcacatacattaatgtttatactgaatgttgttgtttataagaatcagcacaataagaagactcaactaacaagcattgttgagcttattaaggcaatcattaagatttcatcctttttcatcaaaaggcaaacattagtacatgggactttctttgagaatattttagaaactaaaaaaacccctcataatttctgagaagcttttggcaatattcttgataatgatgaaaggatttatgtctacaacgttcaaagccatcaggttgggtgatggaggaatacatgtgagctgtggaggaatacacgtgagctgagctttcaaatatctctaatgcaatgagatgaaggtttatgtccctctaaaatcatgttaaaaccccaatcccaaaagtgatggtcttaggaggtggggcctttgggattagtgacctaatacaaaaggctccagagagaactctcatcccttctaccatgtgaagttatagagagaagtcagcctgtgagtcctatttccttttaactactgccatttctgatgttccctaaaattctccccctaaaaatctcagattgaccatattgtacactgttttgctactgagagattatctaaattatgaagattagaaaagcacttggaagaaggacctgtgaattcatctagtgtacaacctgctcacttgatagataacgtgtaacggtggctcagaaagaagcaatgagctgtccaaggacacacagctaatagatagcagggacaagtgccttactgtctcctaaggcaggattagtgtccttttcaatttatgggtctgtgtctactttaacaaatattcagattttctctccctgtctcgtagtcactagacagggcaaaattagcttatatcttttgttttcaaaaccatgcagatgatactatccataggacccatccttcaaatgacggaatgtcaaagaacattgtacattgtacactgaacatataactgtgttcagcagtaccttccaacagtgaagaacacactgaactaggagtgaggatactttttttttcctcctttcttgttttgcccctcattagctgtgcaacactggacaacttacaaatacaccttggcgcctcatgaaaggaaaccaatgtcaaagaaataacacaacccaggagagtctggaaaaggtccctttctgaccacccagctttcttggcccatagcagccatggaaataatctctctcagtactggtcattaaactcccattatctgaccatcgatcactgtgggaggcacaggctgcaagtgcattcaagggctctgaatgtgttctatttacagagcaatcacaggaacaagggaagaagataaacttcatcaagcccctgacctgtaagaatgtgtcagctaccaaggtaattaatgcctcatttcaacagccaaggccaatctgattctaaaagagccatttatctcttaagaatactgcaatgcaataaagaataagaagtgaatctagcccagccagagctctgcagtaatcaaatttctacaatctcaaatagatagtgtgatcttcatatggtataactatgttcagcagcaccttctaacagtgaagaacacactgaactaggagtcgggagtcaggattcttttttttcccctcctctcttgttttgcctatcattagttgtgcaacactgggcacttgaccttttgacactgtttttttctttttaatcttttgtgtaaaatgaattgggtggagcagtttaaggtctctgccttcctgctcaaataatataaatagcattttgaaacaagacttaaatggactagactttacgcattatgaaaacactctgtatttcctaattaatgtgacccaggagagacacttcccttctctcttaaaaatacaataataaataaaaacagcatagctgggagaagaacaaagaaagcccattctgccgtatttctaagcttctcttccctctcatacctcaaagtattaataaatctaggtataaggcttgttcttaaatctgttttcaagtgtaaaggtaaaacctcatttgtcctcccactatttcttttttctttaatttcaatttgctctctgactacagaaaagctgtgaattcccttaattgcagctaattctgaattctgggttatacagaacactggtattggcaaagttggtgggaattttcaagtagcccaattagcaggaagagaaaatacttttttccccaacttacagtatagaataccaaaagaaagtcaaaagaggaaactttaagtacattattttctcaagtacctgacaagatactgtagatgagggatcaattcaaagcaattaatccatcaaagccctctgttttgaaattgccatttctctgtacaaatcatacttataacagtcaaagaataaagaacatgggagaaaataacagcttttaccaagctatatgaaaaccaatgtcaaataatttggctttagaaagtcgaatttcctttccctgaattattatctcatataacttgtcaatcatttcttttgggaagggtttgctaaactcttctaccttctcttatgttaccaatgaatttaaaaaatgctttattaaagtagttatcatgctttactttaatgttttgcttgtatgtcttgctaaactgtaaatcactaggacaaggactatgtcatattagtcttcatttcctctgccattaaaaaaatcctaatatattttagatgttctggtaacaacaccagaagcaacactatagtatcagtagctcaaattatatcatgccaatgctatcatgtgccaggacctcaatgataaagtcaacacataatatgcactatgaattaatcctctcaggcacaaaaaatctatttggtgatagcataacttgcaatctcttaacatggacccttcaatttcactttccattcatttctcaattatcttcaaatttatcttatttccaatcccactttccaaagaagccctccccaggaaattgagaaggtagggaaagatttcaggacctatactttctttagagctgaagagcccagaataactggtagaaaagcaaagagacgagacccttggtgtcagatgaaaaacagaaatgttgctgactggctgttataagacccacttggggctctcaacattcagaacactgcaagaattcagtgagatgggagcttggagggcaagtgatgaaaatgagacacggcagagactgattatcactaaaagtttaggaaagggaaacaacagtttatctttgggtactataaatttataatcctcccaggagacactaatcagaatgtttccagacagcaaatactaaacctattttatagtaacaaatcagccatgggtagtattatcttcaaaatgagcttagaagtaataaaactgagtattgcatagattctccaagtcattgttggctacaactcaggataacaagataatttgctatcaagtgcagttagaggacatgttatgaaatcaactcacattgtatcaaacttctgaaaataactggtaaaattcaataataggaatacttttcatgaacctgggttccgccctcacgccatcactcaggaagctgggttaatacttaccatcacatatcgtattctaatgtaaagtgaattgaaaggtccttacacagctcaaaaaatctaccaggaaaataatttaaggatttattttacgggttcatgtagtaattaatgactaaattaatgggggtgggggaatacaggaacaggtatcaaagaaagattccaacaaaccacttgcagaatggtacacaattctttgcttctactagaatctttcctactaggaggacaaatgagtttgtcttacatatcactctgattgtcactagctacctggaaaatatattgagaagagtactgaataaatgctaagctcagtagaaaagaaaattttttactaaagtttgtcatggatataaaaggaaagaataattcataggccacctattttctatttctgtaaaaaggggatcatgcccattccatctaggtatccccgaaatccatcacacagagcaactgttcaataaatagttccaaacaaattaacaaaaaacttaggcttatttttttaccttggtttcgaacaggactgacaaaattgataccatgaacatttctccagtcccaagatgttggcaaatgcaaaatcttttgctgtatttcagcagtcagtggtgcaggtttgggcctagaaaggaaatatacatttgatatcaacatataatctttcctttgaggatgatttcctaaactctactataattctatgatttcagctaccagactagctaggatctagattcagacccagagcacctgttttatgagtgattcaatgtgtcaattacacaatggagttgtgtaaatggctttcattcgctgtttctttttcaggatctagtattgataattttcctttgtgaaatgacactggttttgtatatcactgtgatgttatttttagtttgcctgaatagctgcattcttactcatttttgaaagatttttgaccaagaaagagatgagaagtagaagacataagaagggtttagagaaaacagaggaatcactgatgtttgacttaggagacagacacattggtagtgaggtggctgtaaaagaagtgaagttggcaaagggaaaaaagggtctatgtgaggcaggagaacaggttctggaggcagggaacataaggccaattcacactgacttcctagaactaaataaagtggaaacacttcagcaatggcaggaatgcgaagggctttgtcacttcacttcatcctctccgtttacatgggccacaacccccaggagtaacaccctctccattaacacaaggcctatactgagtaaatgactttgtaacttaactccaccctcttcatttacataaggcatacaccaggtaaccaatgggaaacctctagacggtattgaaaccccagaaaattctgtaaccagggccttgaatcatttacttaggcccactcccatcctgtggagtgtgctttcattttcaataaatctccgcttttgttgcttcattctttccttgcctcatttgtgagttttgtccaattctttgttcaagaagccaagaacctggacaccctcaaccagtaacaagcataacacaggctgactagctccgtaaacaacagataaaactgtttcattatagaaccacaccttatatgacagtgttgggctgtaagacacacaaaggagagttgcctaggcccatgaatgaacggacatttttgggaagtgagaaaattgttctaacagcttctctgtattagcgatttcacacatacatacacatgcacacacacacaaacacacgcgcgcacacacacacacacacacacacacagagagagaaccacagctttagacacattcgacttcttggagtttccccaagactgccaaatggcctctctgttctatatctttatgctgctgctcctgtaacctcaagtgcctgttgctcaccacttaaaactcccctaagagtttttccctaacttgtaattttcaaaactgctcataaagtagcctccactcaccagcccccagcgaaaactcacttcctctctctctctgctccttcaaatttgtttttagggcactagtcacaatgtggtaaaaattattttttgttactataaactatttgaatttcttattcaactgggcattgtcatatcacactgttctagtttttcagtggttaccagatgttttttactaggctaaaatttagtcaatggcaaagattctttctgggctacttcatgccctctgcacctatccacaaatggtcccgtctctcacagcttctcttagatataacacaggttaagaatacatgacaaggggccaggcgcggtggctcacgcctgtaatcccagcattgggaggccgaggcgggcggatcacgaggtcaggagattgagaccatcctggctaacacagtgaaaccccgtccctactaaaaatacaaaaaaaaattagctgggcgtggtggcgggtgcctgtagtcccagctactcgggaggctgaggcaggagaatggcatgaacccaggaggtggagcttgcagtgagccgagattgcaccactgcactccagcccgggtgacagagcaagactccgcctcaaaaaaaaaaaaaaaaaaaaaaaaaagaatacatgacaaaatggaactgagatgaaacaaagagaaaaacaacaacgatttcttcaaaaatagcaattgtaaccttgacaattgtatagattacacaaacactagttaattgttcactaattttttctcctaagccagtcacattggttgaagatatacatgatacagagataaatatgagatggtcattaacaatatggaagacaatgttaagagacataatatacacaaagattactataacaagttacagtaatgctataaaacacacaatttggacaaagtctatataatcaaggatcataaaaatctgtgcctcataggtaattttatatatagggtgagagaaaaaacaaagcttggacatttcttctaagatgtataaataaaaactaagatgcaaacaaaccatttccatctttgaatggaaatagtttctgtggtttcacattgagagagtatgttgaagaagaaactcaatttttttttaattctctcactgaacactatcaactgtcaacacaaaagacttctgtgatcaaatgcatgtgggtttttccccacaaatcaagcaagcaaccaatttcacagtgaatactagctgggtgtcctccaatccagttttgacactgtgtacttagagatggcatcagatctcacaggctgagggctccgtcccacaaaactgccccctacttctcatgccaattgaaagccctaggttgtttacctgtgcttctggccaaccagctataatgtggggatcctatgacaccctccttgggttcaattaatttgctagagtgactcacagaactcagagaaatactaactaatgtttagtggtttattataaaagatactacaaatgaaacagatgaagaaatgagtagggcaaggtatgggggaaggggcacacagcttccatgccctccctgaacacgccaccctccaggaacttccacttgttcagctatctggaagctctctgcaccctgtccttgtgagccttatatggggacttcatcaaataggcacaactgacaaccatgtagagatgtgactggacataaagggaatgatgtaaacacagcaaggcctgtccagattcttctgagcctctctctgttcagtgttccttcctttagggtatgacacaggacatctttggaaatgaaggtcttatgacccaagatcagaaaggcaggagaagattagagtgctgccctgggcaggtgagaggagggcggaagaagatcagagagagagagagagagagactctgttttctgaggcctacttctgaggcctaatgtgccccaacgttaaaagatagtgacaagggctatgggagttatgagccaggaactgtggacaaaatctagtatgtgttaactagttgtcttgtttaaacctaagaatatactaatataaaggataaaaaagaaatttaagtttggcagcataatgtaatttcagggcatatgattttatcacttactatctgtgtaacatttggcaaggaacctaacattacaaaactacagttcacttctattaaagtgggtataatcatgcttacctcaaagggttgttatgaaaattcaatgtaataatgggtaacaagtgcttagaacagtgtttttctctgataagtccttaataaaatggcagctgttatgaagataacattcatatcattaacaggactaaataagatgctgatacagtttaaagcaattatctggcacaaaacagtcattacaatattaagttccttttttctaccatcctataaggcagagatttgcccatcattgcacacacaaacaaaacaaaaacagtgtgagaactgaggcttaatgatgttgtcaaaggtgtttgacccagagcaactccatcttgaataggagctgggtaagatgaggctgagacctactgggctgcattcccagacagttaaggcattctaagtcatagaatgagataggaggtcagcacaagattcaggtcataaagaccttgctgatagaacagacaggctgcagtaaagaagccagctaaaacccaccaaaaccaagatggcgatgagagtgacctctggtcttcctcactgctacactcccaccagcaccatgacagtttaagaatgccatgacaggccaggtttggtggctcacatctgtaattgcagcactttgggaggccaaggtaggcagatcacctgaagtcaggagttcaagaccagcctggccaacatggcaaaaccctgtttcaactaaaaatacaaaaattggctgggcatggtgggtcatgcctgtaatcccagctacttgggaggctgaggcaggagaatcatttaaacccaggaggcagaggttgcagtgagccaagattgctttaccgcactccagcctggacaacacagtgagactctgtcaaaaaaaaaaaagaatgccatgacaatgtcaggaagttaccctctatggtctaaaaaggggaggcatgaataatccatcccttgtttagcatacaatcaagaaataaccataaaaatggacaaccagctgccctcagggctgctctgtctatggagtagccattcttttattcctttactttcttaataaacttgctttcactttgcattgaggactcgccctaaattctttcttgcacaagatccaagagccctctcttggggtctggatcaggacccctttccagtaacactgtgaaaatgaagagagagcaagaggagtctgggggataaaaaggtgagaattacaaacattttgagtacaagatacaggattggctcttaatcttttggcccacattctttacaaatctagtgaaagctctagattcagaaatgctcataaacaataaatgctgtctgtaatttcagcagtttcaaagactccctatatctcaagttaagaatctttgagagtttctattacgtcattggattcttagaacagaactaatttataaacaaaaatgctagtgaaaaatcaggaagccagattataatatctgctttcatatttcctacttcactcaattccatctccttatcttaaaccttctataaagctttagtcatgaaaacagtccttcataaacccagcccttgtctaaaacaaaagtggttggctggagggagaagggagctttagcaggagtcctcagaaacatagcatatgacacttggtaaagcagctgtgactgaggctcccatctttcaggcaggagccacagtctccctaggctcaagtgctaacactcctcctcttgatgcttgtttggatttttgttgttgaatagatctcagcttcctgtctcatgcagatacattaagacacattaggacttcactttggtgaatttgagaaggggatatgatatgctccgttttccaattttgattaactagagcatttcacagacaagaaattctctagaataaacttggagaaatactgcaaaagattcttttaagaaaggggtagaattatgggaggatgccatcagttggacaggaaaaaccttcacatagtctcacagttgaaaaatgccacaccttagcattattagtctgcagatgaaaaagttagtaatgttgatatggacaggagacagggaaatactgggtagaagagggtggtccctcagcaaaggccccaccctcaagcctgaagacctaaggccctaagagaagacaggcatttctgttttcacaccaaaaaaggtgccttttggcccgccatgccccccatccttcccccatataaacccaaaatcttagcaggcacagatacaaggagctgaacatccagaggagcagaggaacagagcggcacagagctgtggagagtggtgggacagcacagcagaaaaggagggaagaggtatttgaacccagaggagaacaggaacaagtggactccaggggaagaacacctttcccctccatcctccttctctggctgagagtcgtctcgcggagagccacctccaccactcaataaaaccttgtgctcatccttccagcccacgtgtgatccaattcttctggtacactgagcaagaacttaggctgtcacattggacccctgcccttgcaataaggcatggggtctaatgacctgattaacacaagccatctgcagacggctaagctgaaagagcacactgtaacacatgcccacttgggcttcaggagtctccaacatccactcctagacactgctgtggggccagagcccaaaagcaccccccatggcctctgcacctgcccctctgcatgctccccctaggggtttgggtggtagggcaagggcaaccaaaggtgtgagaagccacacctctgtcatatgcctgcgagggagataagggaactctcacatttcaaagtgttttagttgagtaattattaatctattagtagtttattcaaataatacaaatttgagccatgaactctacagatattagaggattaaacattgtattctctgagaatttgaggctatttcaatgtattaaggaaaaataacctacctatataatttttcaaattctgctagctccccattgctttccaattccttaccccttagtcacatgatcctaaagcaaagtatggcattacaggacttatccgtggccatttaacaaatgttaaggaactatattagatagatgtagatcctaagctagatccagctatactttcagaaaaataatttttttttaaattatctaaatttctgactagacagattcaaagtattatgatataatttcccaaactaagaaatataccatggggcttatgggtaaagatgaaaaatgccacctctggttgagagtaatagagctatactgataacttttttttttttttttttttttttgctggacatcaaagcatagagaggattttgagatttttttttaggtggcaaattttacagttactgtaggcaagttgagggctatttgaggcaaagggaacagcacaaatgaagatgaaaaatgaaagttttcattcattgtgtgtcatatcgtttgaaagcagagcaaggtgataaatatagttatggtcataattagatgggtttggataccaggctaaatgtatccattaggtagtgggcagtaacacagtctcgtaatcacccaacgggttctccttcctcacggcctacacagaactgattatcaagacagggaaattgcaatagaaaatgagtttaattcacgcagagccggctgtatgggaaactggagttttattattactcaaatcagtctcccagaacttggtataagaggatgaaactagaagcatttcataaaacagctaagaatgggaactgggagaggtagcgacgaaagagatggcaggcatgaaaccgcctttgcaaaaattataccagtgagaaaactatgagagtgaaagagagctaagctaacccatcccccatcttgccttccacttaaatattcctgggctattgggccaagctaactttggaagtcatttcggctacagtttaaatgacaatgggccttgccctgaaacccaaccacttttgtgaagctaatggaggcagtcaggctgtggggagaagaggaacctgagtccagctaaggcgcagacttgagagattgtcagccgttattccagaggttataagacatgcaactccatcaattactccagcaaataacatcattattgtagaatctaagactggctttttgaaatatcttttcagggaaattttatatttattttatttattattttattttattttattttatcttaccttatcttattttattttattttatttttgcatgtctgacacccgtggttctacctggacccagcaaccccactcctatggccccacctagaagcaattcagcccacaggaggacagcttcaactccctgtgatttcacccaccccaaccaatcagcagcaagcatctgttacctggccacccccaccccttcccccaagctgcctttgaaaaacccctacctatgagctttggacaagataatttgaatatgaactccatcccccacgtggcatggccagcctagtgtctcttaagctctttctctactatattgccatggtttttctttatgcagcaggcaggaagaacccctcaggtggttaccggcaggaggctaatccatagcatgggggaaacaggacaaagctgcatgccagagtgtagaaaatggaaagggggcaatggaaacaacagacatgtgaaagaaaaactcataaataggacttggagagtgacagaatatgtatcaataggagataaagatcgttaacagatcacataaaaagttacaactgggatgaccaataaaatggcgagcaacactggtaggactgcttaggagggaggatggtattcagcattcatatttttattaatgataaaatgtgtgcttgattaccttgggatttttcgactgtggccaccacttctcctaatcatatctcccagggtaagagtctcatattccatgtatgtagttgcagtccaagacttctgaatggcattgatagctttcacaaagttgtgatcatacttgtagagcctattagaatacctgtccccaaaaatgagataatttcagatatagtctttactgatgtaaatagagtaattaaaacaggcattcacactctgtgcctaagtggaaagtggtacaatctttcaggaaggtaattggcaatatgtatcaatagcctagaacagcctggcatgtcttctctaaaaataaaagttcaagttaactaagatgcatgtataaggattttccatgaagtacttttaaactactaatagattgtaaataaccgaaataaatattctaagataagggactgattaatgatgtttcattttctatatattcatttaaaatgtctagaaagttatttaatgatatggaagagtgctcacaactatattatattaaatatgagaagatatcaaagtttatacataatcataatcaatttatcaacttttgcacagtaatatatgtatattatatgtatattaacgtatatgtataatacatacatatatatgtatgcgcgcacacacacacacacacacacacacacacacacactataaatgcatttttaaaatgccaaacatggttacctctgaatggtggcatgagatgccaagctttcccctactccctacagtttctacagtgtacctttataacctttttaataagaaaaaagagaaaagcaaaacctgtatgcaacatatatacaaaatgcaagcattataaccatatgatactaaaagaaattatactttatggacattcggtttatacttgttactcagaatttagttcttgaaccaatatcagtagcaacacccagaagtttattagaaatgcatactgtaagtactcagcccagatcacctgaatcagaatctcctttttttttttttttttaaacaagatccccaagtgattcacaataacattaaaatctgagccacattggtttaccttgtgccaaatgcttggatatatatgtaaatagattcaacacacaaagagcatatttacaaagtagaaaaattcaggaagctgattattcacttaattaaaacatttatcatacctgtgtgctagatgctaggaattatagaactcaccatattattactattaaaaaagagtctgtggtttcagagtgactcactatctaagacttccataaacattcaactatgcaaaacaagatataattaacctgaggaacattttaggcatactgcaaacttttctttcccttataaatcatgtgtgtagagagagaattttgatatggtctaaaaacctaagagcactgaaaataatcagaaaaacgtgcaaccaggttgataatgttttaatgtttttgtcgaagttctttcccacttgttgcaaagtgtgaaaaacccagagacgtacccttatcaagcagattataaaactgtatcatatgtatgactacactaacacaataacaaaaacaagttatagttgtttcattgtttctttaggcaaaagaatatattttaaattgtaaataaaatacttttgagatattttcccacaacgccagtcaatatttcattgactgtagatatttgaggagcagtagcctgctgtttcgcttgctttatcataacatctagcaaaacctcgtgtgttgacatgtgcattaaaataatgacaagatagcatcctacgtcttaaatactattatttttggtgtttaagatccaacgagattaaaaataatgtatcttactatgggataacagatcattaagagctgaaagagacctcaaaggcaattcagtcccacatgctcacttcacaggtgaggcaatgtaggttctgagcactccggttgggagcttcttcactaaatgagagaatgtttgaaatatcaaatagagtacaatagtacatagcatatcctaaatgatagggtacaaagtaaacaagttaaaagtaaatgtgtagctctaggatcaagccaaacaaagctatttaaaacctaaacttaaaatgaaggggatgaattagtctagatcttgcccagcacctttgcagacaattcatcctcctttaaatcatctctcttacctctgtgctgcagtcattcattactaatgttgcctggcttgggatgatttgtacatgtacatttttagtggcttttacaactacataaaacagaaaaagtaacaacatttcatctcttccttccaaaactaataaagtctaatttgaaatctcctgtttgtgtggtttagtcagttatagatttaatttaacagtaaacattaactgcagtttatagtctgaattgtgtccccctcaaaattcatacgttgaaattctaaccccctgtatcacagccatatgactgtatttggagacagagctttaaagaggtcattaaggtaaaattaggtcatatgggtgggccccaatccaatatgactgatgcccttataagaagaggacattaggacaatcagaaaagactgtttaggagcccagtaagcaagcagacatctgcaagccaaggagtgtggccttggaagaaaccaaacctgacaacacctcaatcttggacttctagcctccaaaactgtgaaaaaacaaccttccttaagccacccagtctgtggtactttgttatggcagccctcgcaaaccaacaggctgcataaatactaagaactttgatttcagttatttatggtcttgtttaaaagttgcccaattagtatcacctatacttgttgcagcataaacatacgtatctacttgtatcatgcaacatgttattacatggcaataagcaaaatggcttttctttattagtaatttgcaattctgtggtccattacatgatttcatttaaagtaatcattggtccattacttttggaacactttgaaaaaatactctcaataatgttggtcaatttatttttccagtaaggttttacatagcatgcctaatatttctaagccaaagatattttgtataatcaaactaaaattccaaaaatgtacacacatattcatatatactataaaacaaaactaaacgtatgtctcatttgtagcaactcacttttcctgagaattcttaaggtgtgctatgttgacatacacattctcagaggcagttcccaccttctttccggtgaaacaagcccagttccggcccaacacatcatgcacccacccagtcattgtctcgttgcagtaagtggtcaccttgctgccctcttctttatactgcaaacaaataagagaaaagaaaaccaagtaaaatctgtcttcaaatttcaggtccatttccatggctctcattcacagtaaatgtgcccctttcaaaacaaaaacttcaccctgagaggttacactgtaagaattattctagaaaaagaagacatacaaacttttctgtggttagcactgttggccaccaaacaaaatgtatataacaaaacacttccaggaatgaaggccaagggaaaacaaaacaaaacaaaacaaaaaagaaagaaaacagaccatctggcatattcaaggcatttttcaaaagtgacttcacagtccttacaagaagactatgaggatgcagatgataataaccacattttaccaaggacaaaaggagctcagctcagagataaggagctcctaccaaggcaacaggcgaagtggcagaaacagaattctcctcagtctatcacactacaattttccactgagacaagggccacactaggaaactacaagaacaaatgatgaactttttttttccagggatggagtcttgctgtgttgcccaggctggagtgcagtggtgtgatcttggctcactgcaacttgcacctcccaggttcaagcgattctcttgcctcaacctcccgagtagctgggattaaaggtgcttaccaccacgcctggctaatttttgtattgtttagtagagacggggttttgccatgttggccaggctggtcttgaactccagacaagtgatccacccacctcggcctcccaaagtgatgggattacaggtgtgagccacagtgaaacagaatcctttttttctgtcaatctctcaatttattagcatattctgatcatgagggggctaaagtaacctgagtattaaatatattctttacactttatttcagtaatatggccttttgtcttatttcagtgttagaactgaaaaataactattatttttaacagatccaggatttgaactaagatgctctggctccagagcctagtcaccctcatgttagaacatctcctcatggaggcggggcacatgatccaggatgactgtgtagcatgtgggagacagaaagggaaaatgctgtgctaaatttctgaggagagacttgggcacagacaatttcaggctctgacttaatttaatagaaaagactatttgtagaaccttgggcaagattttacgaggctttagttctgttgcctgtaaaatatggaaagtagaaaaaaaaatcctcaaaggtataaacattctgggattccatgatcaaatgcagggtttggtaaacacttcctataatggccagacagcaaagaccactaggctttgcaggccacttagttctcttgcaactgttcaactctgcccttgtagcacaaaagccatcaaaagcaagactcaaacaaattggcacaggggtcaactatgtttctataaaatttctgtttacaaaaacagacagtagggtggttttggctccagaggttgtagtttgtggactcctgctctactctaatacacattatttcacttgtttgcagaggttggcaaacttctttttgaaggactagatagtaaatattttaggcttgaaggctggaagacctcagtcacaactactcaacctaaaaggtgcaaagggaatacataaatgaatgagctaggctgtgttccaataaaactttacttacaaaaagaggtttgtagtttgccaacccccagtttagagaaatgtgtgggctaaactacacttaaagttaaaattaccttattgcatctgactctctgaattcaaatcatatttagggggagagttaaaaatgtatggctttagaatccagaaaaactggacttgaattgtgggaatcaccactcactgtgttatatagcacaggaaaagttactctgggctactcatatccgcatcttgcttttatctttggtgatattcatgatattctctttttttcagacagagtctcactctgttgcccaggctggagtacactggcgagatgtcggctcactgcaacctccgcctcccaggttcaagcgattctcctgcctcagcctcccaagtagctgcgactacaggcatgtgctaccaggcctggctaatttttgtatttttagtagagatagggtttcaccatgttggccaggctggtctcaaactcctgacctgaggtgatctgcttccttcagcctcccaaagtgctgggattacaggtgtgagccactgtacccagctggttgttcatgatattctggatcccatatgtctgcttctagtgaagaatggcttcactagcatgagttcagttcccaactactcaagtccctgctaaaaccctactcaatatgatgaccatggaaacaaagacccaggacattgttgggcagcaatatgagagggtgtgttgtgtgaaaaggttaataaaattaacttcatactaaactatgtaaaacttctactttggtagatcgaaacagtgtaacatggtaactttataggatgcaacctaaactccataaagttgtattatgtacttctctctggcactggctcttgatcctattctcttctccttggttgcatgctggtaaggcaggccaggtagggttaggccgatgctccctcccacctctgctgtttgaggaagcagtctgacaatgtttccagagttcttaagagctactttatagatattgacacacatacacaaacaaaatgctacacacaggaagacattcactgcagtataacacaagttaaaaataaaaacaatagaatgtcctagaaaatgcccaaatttaaaaagtattaggtaaacaatttattcaaaggaataatgtgtaacattgtatatgataaacctgagttctataggaaaggggtgagcaaactaaaattggagaagactgcctatttctataaatatagttttactggagaacagcatgcccattcatttatacattgtctatggctacttttgtgccacaatggcagagatttcatactttataaatattgtacagattactcataaatcttacaggttcaagagaacacagaaatgatatagtcttgggggacaaaaaaaagacctaaggaagtggtggaactagaactaagcatcctacccaatgccatcctccacttcttcctacaatttgtcttctcacgaagagccagagaggtaaacaattactaaaatcactgacgggagatacccagaaatgacagaaaaggcttttttttaaacccaaagggcttccacctatattatttgagcctcacgataatctctttgggataaaatttctttctaatgaagaaaaggtgactctgcaaaattaaatggagaggaaaggattcaaatacaggtttacatgttacaaaggtcattgctttatccattgtattctctaaaaaaaaaaaggtgcagagaattaactgactcatgagtcacgttcaaattgttgcccaaggcctttaaagggctgcctaaaatttctagcagtcctcataggtgttctcccattcttcaggtacctatgttgccttggctctttcagtctttttaccatgcctgcctagggtttttgacgcagaacagaaagaaagaataatgccttcaggcctagactgcctagactgctctgccactgattggctgtgtgatcctgagcaagtcacgttcctctctgtactttcagtttcctcatctttaaaacaggagcaatggccaggtacagtggctcatgcctttaatcccagcactttggaacgccgaggttgggggaatcacttgaggccaggtgttttgaggttacagtgagcaatgatccagccactgaactccggcctggatgacagaatcagatccattctctaaataaataaataaataaataaataaatgaagcagggatgataattacagactatatctcatgggctgtgttttatgtatactaactcatttatttttcacgatagtctatcaggttgttctttccacaaaaacataactatgacaataggatttttgtttattcagtacctagaaaactatctggcactaggaagtaattaactactaaatgagtgaataaatgaataacagaagaggaagaacaacaaatgtcaagtcctatttcaacagttaacaaggcactgagaataggtaagtttataattaacagaggtgtggtgatgccaatatatcacaatgtctgacagtccaaatcacagtattacttcagaagtgcaaatgttcctctccaaagctgcttccctatttgtaattttaggttgacctagaagttccaaaaatttcccttcaagctttctaattgcaaatccttatatctgtggttgtcttaattttttttttttttcaagatggagtcttgttctgtcacccaggctggagtgcagtggcgcgatctcagctcactgcaacctccgtcttccgggttcaagcaattctcctgcctcagccgcctgagtagctgggattacaggcatgcgtcaccacgcccggctaatttttgtatttttagtagagacagggtttcgccatgttggccaggctggtcttgaactcctgacctcaggtgatccgtctgcctcggcctcccaaagtgctgggattacaggcatgatccaccacggccagccttcttatttaatattcataaagccagtaattcttaatagacacactatttatatgagtaatcctaaaaaactacaactttgtttttgttgttataacttaaaccctacacattccattaaattgatggaattattttcccttttaaaattttattttatactattcttacaatctgaaataatgtatcaattttagaacctgaaattattctgtaaaagtacagagctgcaatgccactctgcacgacaacaacttagtaaaagagaggcatttaccagcggggaagccaagtacgcagtaccttaagggggaccatccactgtacccctgtgattttcttgatttgaatgttttcggggtatgtcattttttcctgtgaaatacttcttttgtgatttctgacgttgtatcaccaattaagaagttgaagttttgaccccgctatccagcttgaaatgcagccaaaaaatttttctgagttttcacttatataaacatcagtctctgaagactgccttgcacagatgagataatttaagtttccattcatttatgctaatttctactgcaacaaatagataatttcctaaaatatgaagatcaagccctagtatttaagtttaaaaaactattatgattcaataactatccatttgcttcttcaatattaccattaagttgccacacattctcaaaatatcccttcttcaatttcccactcattttatcagctatccaattagatatacctagtcatagggaaattttggaattgaagttatttttgggaactgaagttatttatcttggatcttttacttgactgctttttgacactgaggagagggaaaaaaaaattccttaaacctgttctactgttttcttgattaataatatacttagccaatgtctgaatacttactttacataacaaacttggctagaagacagaggcagtttagtaaagtggactccgccctttaaatccagtctgtcacttatcatttacgtaaccttgagcaagtcaaaactagtgagcctcagttactttatctgaaagtaggaatgatatctataattgatactactttactggactgctatgaaagatatagatgaaattgaagttggaagagttaaaaagttatacaacattaaacaagtgactatactaacattaccatcattaccatgaaggatacttcatccatgccttcatagaacttatattctatccaaaactgccaactgggcagctgacactgggacctatcctttcaaccagtggtttccagcggaacattggaaacaaagtattgtaactcccatatatatttctaacataaaaatacaattggccaggcgcagtggctcatgcctgtaatcccaacactttaggaggctgaggcgggtggatcacctgaagtcgggattttgagagcagcctcaccaacatggtgaaaccttgtctctactaataatacaaaaattagcctggcatagtggcacacgcctgtaatcccagctacttgggaggatgaggcagaagaatcctttgaacctgggaggtggagattgcagtgagctgcaaccatgtgccattgcaccccagccttggcaaaaagagggaaacaccggctcaaaaataaataaataaataaataaactaattaaattgaaaacttccactattatttaatatatgaaacaacattggtgtgcccatcagatctaatatcagatgttcatctgttatgtacagtgtgctagtaagtccctataagatagttaaggcacagcatattccctttttcacatctgcctgcttaaactgacttgagcatcttatctgaattaatcaggctaacactcataaaatgaacaagtagtttaaaatatacttgcaaagaaacaaggatttgcaaatactaatgatgcaaacataagaaaatggcagtttttttataattaccctattctgacttctgtcaaacatgttgacagaagtttttaaaaacagatgttttgaaatggttccatcactataatattttttttagtcctagacatcaataaagcaaatgtttcagttaaaatttgtctattaaaattgtcatccctaataccaattgataattattctaaatccttctaaagctgtgacactttcatacttttaacaaaaatgtgtcaaaatctactgaaattctttaagattttaaaacacatcagaaaattttgtttccaaatgttgaaaatttacagtcatgaaaattatcagtaacagggactctaacattacttttggcaacaaaatcataataatgaagaatattttacattattttcaaatgatatcttcttaaaatatattttgggtagggcacaattttatgacattaataaagtatttaatcgcttaatatttcacattttataacaaatgtagtacagtgatacatgtatatataattttcaaaatgtacctatagataatttagaatacataataaaaaatttagacatccaagtctaatccatcaagatgatttgtaattttgaaaagagtactttgcatggagttgaatgatttgatgattaaccaaatatggaaatattatattccagcaacattaaaaaacaaaaaatgtttccatttttgccctttgtttactgtagaaatctatatacgtacaattacctccatttgctgtcagaaaggaaccaggcaaattttactgaattggtattttgccaaatccatcagagtgtcacatctttcctcagaaagaaaccaacttccctatgtcagttccaaggaatagctatagttttctgcctattaactggactgaaccatgcatttaaaaagtcgaattgtaataaaatgcaaaactgccaggaaatagttacagtggttacagccaagcaacttccagcattttactgaaggaactggaagtttacatgtgaaaatggagggtcataaatctgtttatttccagtgctgaaaggacattacattaaaaccaaaatacacactccagaattagctaagaaaacagcaatttactgcacagcaaagtagtcaaagtccctgggctcattcctcacttacttactcataaactcaaaccgtaaagttggaaaaaaatcttaagagttcatctaatccactcctcagctcatgttcctcactatactcaacagaggtgaggcacaccatgcagcatttcaaagcttcggtcctccaggctttggggaacccctgcagtcagaacactcaggatttcccttgatagctaattttgtttttagtagttttgaaagttagaacatcactgtttttaactctgagccctatcttggcctctataggcttacacaagattaaaacataaataaataaatagaataaaatataaaagtctaatctcttttccactaaatcatccaacatatatggcctgagggcccaccatagcctctaaggacacaaaggtaacacttcaaagaacacatcaataaaacaataccacatgatatattacataacattctttattttacaagtatttattgaaggcttattattggtcatatatcgtgtaatacatagggaatcaaatggttagtaagatggagttgatccttgccctaatgaagtttaaagaccagagaggaatacaaacaggcaattatgacacagaatactaagccttattatattcagggatcttctgacacatgtatctgcaattttgtactcactgaatcttctcttccataataaaagcatgttgatgcaaaattactcagataaaagaactcattagtaatttttaaaattccatattaaatatatatacatatatattttaaattttttaagttccagggtacatgtgtaggatgtgcaggtttcttacatagataaacatgtgccatggtggtttcctgcacctatcaactcatcacctaggtattaacccatttatgccagaggttgcaatttgttgaatgtgaaaaatcagaccttggcaatgaccttgagcaggatataaagaacttccacatgcttagcattccagaaatggaacactaggcataaatgggttaagcccagaatgcattagctattttttctaatgctctccctcagcttgaccccccaccccctgactggccccagtgtgtgttattcccctccctgtgcccatgtgttctattgttcagctcccacttataagtgagaacatgtggtggttggttttctgttcctgcattagtttgctgaggataacagcttccaactccatccatgtccctgaaaaggacaggatctcattcctttttattgctgcatagtattccatggtgtttatgttccacattctctttttccagtctatcactgatgagcatttgggttgattccatgtctttgctattgtgaatagtgctgtaataaacatacatgtgcatgtatctttgtaatagaatgatttctattcctttgggtctatatgcagtaatgatatttctggttctaaatccttgaggaatcaccacactgtcttccacagtggttgaattagttgacattcccaccaacagtgtaaaagcgttcttatttctctacaacctcactagcatgttgtttgactttttaataatcaccattgtgacatgagatggtatctcattgtgattttgatatgcacgtctctaatggtcagtgatgttgagcttttcttcatgtttattggccacatgaatatcttctgggaagtgtctgttcatgttctttgccaactttttaatggggctccttttttcttgtaaatttgttaagttccttgtagattctggatgttagacctttgtcatatggatagattgaaaaaattttctcccattctgttggttgcctgttcactctgacagtagtttcttttgctgtgcagagctctttagtttaattagatctcatttgccaatttttgcttttgttgtaattgcttttggtgtctttctcataaaatctttgcccattcctatgtccagaatgatattgcctatattctattccagggttttataattttgggttttacatttaagtctttaatccatcgtaagttgattttcgtatatggattaagaaacaggaacagtttcaattttctgcatatggctagccagatatacagtaggattaattgaatagagagtcctttccctattgcttctttttgtcagctttgtcaaaaataagagaagaatcaaacagacacaataaaaaatgataaacaggataccaccactgatctcacagaagtacaaacaaccaacagcaaatactacaaacacctctatgcaaagaaactagaaaatctagaagaaatggataaattcctggatgcatacacactcccaagactgaatcaggaagaagttggatccctgaatagatcaataacaagttatgaaagtgaggcagtaataaatagcctactaatgaaaaaaagtccaggaccagatggatttacagttgaattctaccagaggtacaaagaggagctgataccctttcttctgaaactattccaaacaattgaaaaggagggactcctccctaactcattttatgaggccagcatcatcctgataccaaaacctggcagagatacgacaacaaaaagaaaacttcagtccaatatccctgatgaacttcgacgcaaaaaatctcaatgaaatactgataaaccaaatccagcagcacatccaaaagcttatctaccacagtcaagttggcttcatccccaggatgcaaggccggttcaacatatgcaaatcaataaacgtcattcatcacataaacagaactaaagacaaaaaccacatgattatctcaatagacacagaaaaggccttcgatacaattcaacatcgcttcatgttaaaaactctcaataaactaggtattgaaggaacgtatctcaaataataagagctttttatgagaaacccacagataatatcatactgaatgggcaaaagctggaagcattccccgtgaaaactggcacaagacaaggatgccctctctcaccattcttattcaatatagtattgggagttctggccagggcaatcaggcaagagaaagaaataaagcgtactcaaataggaagagaggaagtcaaattgtctttgtttgaagataacatgatcctatatctagaaaaccccatcatctcagcccaaaagcttcttaagctgataagcaacttcggtaaagtctcaggatacaaaatcaatgtgcagaagtcaccaggatccctatacaccaacaaaaggcaagcagagagcaaaatcatgaatgaactcccattcccaatagctacagagagaataaaatatctaggaatacagaagaagtgaaggatctcttcaaggagaactacaaaccactactcaaggaaatgagagaggacacaaacgaagggaaaaacgttacatgctcatggataggaagaatcaatatcatgaaaatggccatactgcccaaagcaattcacagattcaatgctattcccattaaactaccattaacattcttcacacaattagaagaaactattttaaaattcatatagaaccaaaaaaaagctcgtatagccaagacaatcctaagcaaaaagaacaaacctggaggcatcatgctatctttcatactatactacaaggctacagtaaccaaaaaagcatggtacaaaaacagacacatagaccagtggaagagaatgaagatctcagaaataagaccacacatctacaaccatctaatctttgacaaaccgtacaaaaacaaacaatagggaaaggattccctatttaataaatggtgctgggagaactggctagccatacgcagaaaattaaaactggacccctttcttatacctatacaaaaattaactcaagatggattaaagacttaaatgtaaaacccaaaacaataaaacaccctagaagaaaatctaggaatgccattgaatatattttttacatatcagttgctttggttatatttacatcctgaaagtcagcttgaaatatgcaattcttttaaaactctgcaggaaggtaacctgataatattctttagagcagggaatcaaaaaagatgtatatggcaccattcctgatttgtctttctagaatcctacaaaattaattctttgtaagttggtaatacttgtgaaaagtctgcaaaaagaaaagaaaactgtggtgcattttccaggtacctacaaagttctatgtgcattaggtgttgaagatatacagggagaaatacagattttcaatctggaaagagatgaaaacatgctacccaatcactccattacagcatggcatgaaagcagaggtacctgcgatatgcaatgggaaccaaagttctgatgtttctcacggtaatagagagagctggggagggtttcagagagcagcgtcatcaaggtcctgagtgataaagaatttatcaggtccagaggtgagatagataaaagtttccaggtgggagcagtccactgtactcttaattcatctttctgaaatacttcttctcagaatagcagaacagtatacctctcagatcatacaaagagtcatctgaatcaacagagtaaggatgacaaactactctctagagaaaaattcttctattcaagcagaaatgcaagagaggaaagtccacccagacaatatgaattaaacataaccccataatttcaggcttaccaaagctgaaagaagtcagctctaaaccaacagagcaggaaacaagaccattattcggcaggaaagagctagaagatagcaatcagttgaacaatactgtaattaagattagtaaatttgactatgacacttagtttgtacttaatttgaagtttacaaagctcttctaccaatttccaaactacaaactgaaggagaaggtaagttttggtcttcaatgaaaaaaccctggtttaggcaagaaagtcagtagcctaatagctaaggaaacctaagcttcaaggcagttcttctcttaaaacttcaacatgagcccatgcaacattaaactaatattcatgatgctcacagactggaatttaccaggaaatccaaatatgcctctaaataccatttacttatttgtgaaatggcttttttcactatttagccccaaggaagtctttaggcttgaaagacaagttctagcattttacagttagaaactctgtgagcttagcactgtaagagattaattttctctatctataaaatgaaactagttatatctactttacagaacttttgtagcttatagtatgtcaacttcttagcacaaagcttgtacctaatgaaaaaagaaaagaaaaaaaatagggtgtttacgataccatctttctggccagaggtactggaggtctataatctgtagaagtatactatagcagtctgacatatctgagaaagcctcttttttcccttctttaaatatgtcctccataggaccatcttcccttcaataacttatatctgtgaatctcaagagatccaagggccttattttctccttacaacaggctcttgggttcctcaaggtaattagagaaaggaaagacactcaggcagacagttaaactgtgaataaaatttacgctgtgaataaaacaaaacatacacttcaaatcctgacaatcttagaaaaaaatcactgtaatagaagggatttcaaaagagaaaaagaacaacgtgttgtatattgttccttttattaaaaaactgaacggtgaagccacccaagattttgcatcttcagaatttttttttcctttctcctgtgtagtctctggttgttcacattccaaaatgatgtttactgttttccaagggagtgttcaggagggcagctgccttggaggtaggtcaccaggactcctttgcattttgcatgcaaataaagactccagaagggactgtagctgctagaggcctttgctagctgctacaggtaggtccacactgtcgcaggctgctctgtctcttagccccaacgtctgttcatggctgtggttttaaaagagtccctcaacagatgctctatttaataactacaagacaataaaaactagggttacaagccaacaaggatcatattgtctcttaatatttaatcatatcagtttctttaagtaaaaaaaaaaaaaaataccagcactgatatttgagatcctggtatatttttgtaaatgttaagacattcacaggaaagatgccattctgaagctaaatgcttaagcaacatgtactgcacatgcaaccaacatgctttagaagcacatgcatctgaaggtaactgccactgaaaaaaacgaatatgtttctgaaacatacttaagaaacaggctaaatatagtaacttagatacattaacatgtataccttgcaaactttaatttaggctcagtgctgcctgaatccacatgactaggtactaggctatttatcccatttacacaacaaattaccagggtttatcttttctactggtggagcggtctccctaactaggagaaagagtgaagagttaaggataaaattttgtaaactgtattttgagaacagcttatttttcgtggaaaaaaaaaatagtgaacctatctgggaaaagtttcctattgcatcttcctcctaagctaccaccatacaatatattacagactctgagaagttctgaaataaagaaaactatttaatacattctatatttattcaactaccagaaagaactgagaagaaacagcttactaatttcaaccctaatgctcactttgatctgttattagtggctgtatggaacattgctgaagcttaacaagataacgcgacacaactgatgagcaattcctacctggcagatgtgtgggtcactgctggttcattataaagtttggaaaatgctaatataagataaacctatggtgctttcaatacttgttcccagttccctttttcatatctcacttctggtatttaagagccaagtaacagaggaaggaaaaggggaaagaatattatgttaaaatgcaaggaagggtaagtctctattaattttactctctaatcacctatttcttcatcaacattttagacatttatggatccagtgtgagcaatgatttaaacatctattctgaaaatgtgaagagaatgtaaagagtgaataagattctctcctcctcagtgaatagtctattaagactattttaatagaagccagttttacaaagctgggtcatgtcagataagtgatgagtatgtcaatttctctgtaaaagccaccttctctgtggaagacagatctaagctgctgtggcctcacatgtttctctcttgagggattcttttcaagaaaagaataagcaacctaaggcagcctaactactttacgaatgtgaactgaacttgagtcaaccttttttttagctgggtctttacccttttcggttcacgtctacttaggttacaagtagcattcttgggagagctgatttgacatgtgaaaacagaacataataaagtagaaaattactcacataaaatagtgcagacaacttagaaacagcagacaagcaggctcaagcaagaaattcataagaaaaccataatctctccagtcaccctctgatgaataaataggcattaatttgcataagccatcaggaagtgaggaagcttgcttttaataagaaagttagaaatttttcaatggagctcacccagtttgttcctcagatgtggcaaatcatatatccccacagttcccagctgcatgaacaaatgactgataaaatcagtgacatcctacaaagagtttacaatggtaaactgagtcattatgttgagattaagcatcatcatgaaagaagacataaaatagttaggcaggcactcagtgctaaacttctgatacttttcctccactgaaatactcttacaagtaaacccaaagttgtttaaaacaaaacaaaaaaaagacaaaatgctgagcttgatatattgaatccaaattttaaaaagtatacctatctcaataagtcttctaaaattgttatatcttaataatgaacccagaaggctcagtgaaaaaatgtcacaatattcccaaatcttttattgtagaaacacaggcgacatttctggctgtgtgataagcttgaaatttattaatcactagcacacaaagtgagaaattaaaccctctagtatggatttctcaacatagagttcttgtttctgtttgttttgtttttgagacagagtctcactctgtcacccaggctgaaatgcagtggcacaatgtcagctcactgcaacctccacctcccgggttcaagcgattcttctgccccagcctcccaggtggctgagactataggcgtgcaccaccacacccggctactttttgtatttttagtatagaggggtttcaccatgttgaggctggactccatcttctgacctcaggtgatccaccagccccagcctcccaaagtgttcttgttttgagtagcaacttgctttagaaacactgatggtcattttttttagcttatagttctattaagattggagcctttcaaacaagagctcaattagaaagccctaagatttgcttcactatcaccaaataaaatttccagccataatgagtctacttcccctctacatatttcctcagcccttgagtagcttaatcttcaaaataaaatctgagttccttctctactgctcccttttagagtcagtttcttttactgcctcagagaaagtaaaatgagaaacagtaggttagaaagcctattcaggctgggcgtggtggctcacacctgtaatcccagcacttggggaggtccaggcgggcggatcacttggggtcaggagttcaagaccagtctggtcaacatggtgaaaccccatctctactaaaaatacaaaaattagctgggcgtgatggcgggcacctgtaatccaatctactctggaggctgaggaaggacaatctcttaaacccaggaggtggaaggagcgagggcctgggagacagagctagactccatttcaaaaaaaaaaaaaaaaaaaaaaaaaaaagcctattcaacaggaggtcattttttggagcttagtttgttttacaggacttcctgtctctgggcaatttggtggagagaatgctacacagaggagctttatacatgatcatcattaaaaatgaacaaagtacataagagcataaagaagaaaaaataatcacatatccagccatcatgtaaagtcagacataattaagcattttcacagtattctgtttcgtgttgttacattgtgtgtgtgtgtgttttgttttgtttggagacagagtctcacgctgtcacccaggatggagtgcagtggtgcaatctcagctcactccatgctctgtctccagcgttcaagtgattctactgcctcggcctcccaagtaactgggactacaggcgtgcgctgctatgcctggctaatttttgtatttttagtggagatgaggtttcaccacgttggccacgctagtctccaacttctcaaagtgctggaattaaaggcaggagccaagctagcctgcattgtgtttttatataggagattgcctgcaggtacttttaagaagtgcaaatttgctaaagtgtgccaagtacaatgaaatggtaaatgctactaaaatctgataatcttagaaactggcctgtagatagtattgtcttttgttttggccagcccagtgttttaaaggaaatttgaatttgaatgcctctaagactgtttccatcttgccacaggcctgattactccttattagtttacataaggttatttcaaatgcttagatacccacccacctgagtgggccctaaatgtaatatgcaactcccataaagtgctcagataataaaatgcctggaggatgctgagtaagaaaaaatctttcatttttttattattattattattttgagacacccaggctggagtgcaatggtgtgatctcggctcactgcaacctctgcctcctgggttcaagcaattctcctgcctcagcctcctgaatagctgggattacaggcatgtgtcaccgcacccagctaatttttgtatttttagtagagacggggtttcttcatgttggccagactggtctcgaacgcctgacctcaggtgatcgcctgtctcggcctcccaaagtgctgggattacaggtatgagtcaccgtgcctggctgaaaaaaatattttaaaaacatacctagtacctcctgctcaactcaaactatgcaaaaactttagatgtcaaacttttattccttccaaacttttatctagcttgaagtcacatccaaatatatgtatctccatccctactatacccccaatttctcaagctgttaaaaccaagttttaaaatggcttagaaatctcaaatcataaaaaatgtttctctttcagataagccctgaataaacagaacttaataaagcaagtttctagcaataggagctattctgattgattccgaagtggaatgccgagaatggcaaagaagctgtgtctctcctggtgagatgcaggatgctgagggaagcagaaggtaaaagcaggagcctaaaagaatgctgtggtgtggaaaaactactcaacgtgctttttcctattctcagtcagcaacaacaatcaatacaaaagacttcggtgaccccaaaatatgtaggaagttctccccaccagcaagcaagcaatcaattctgcagcagacaccagctcagtgccctccagtacaactccaatgctacctaccaggagacagtttcagatcccgtaggttgagggcttagtccccaagactgcctgcccactttagacaccagtctcaagtccaggcctccagaacttctgatggactggcttcaaattggggttcccataaccccctctttgggttcaattaatttgacagagtggcataaaaactcagggaaacatgtttatgatttattacaaaggatatttgaaaggatataaatacacaggcacttgaagagatacatagagcaagttctggaagggtcccagacacaggagcttctgtccctgcggagttagggtggaccacccttccagcatgatgagttcttcttcaccttcctgtcagaccctacatgtttagcgcttcagaattccctcaaatctgttcttcttgggcttttatggagcgttcattgaatacacatgattaaagcatggataaccatgttaaaatataattaggttataaggacatgatctaaacctaacaaggcctgtctgttcagattcttcttggtgtctctgtgcagtgttccttctgctatggtatggggcagaatactctctggtatgagggtcttagaaaccataatcagattagagttctgcagtgggcagatgaaaggagggtaggagaagatcagagagagagattctggtttctgtaacaagggtcttgggagtgagttatgagccaggaaccatggacaaaacctatatatgtcataacatacaaatactctgcatgtaccaactactcaacaaactcgagcagcaagaacaataagaaacaatctacttcaagcatatctgaagcatatataaagaggataaaaggaagcaagttgtagggttccagtcagtggagaggcgtgaaaatccaattgatttgtaggataacaacaacgatggcaggtaagcatggcaagaatttgtcaaatatttctgtaatggcagtaggttgagtatgttttcgtttatgtaagactctttgaatagcaaatactactcaagttttgatgttttctctttttacaaaaataaattttaatgtaaaagatgctttctaattctataggaacaattctcacatgcaatacttattacatgggcttgtgttttccttgagttacgcatcctttcaagcacggtttccccagctgcaggaaataccctgatgcttatggtaaaatctgtaaactttctgtattaataaatgtcacccatcaacagtggatgactttattattcaaagtcaactccatcttaatatctttcttaagtttttaaactctgtttcccatcactcttgcaattggatttactaaaataacatggtattttatcactttgcaagctatgtttatctggaactacctgattatattaagtttcaaaaagaagtatcctattatattctactctgcctaaggaaattatggtgcttgtcataagacctaactactgaccagagtggttgatttttctgcagaaaaagaaaacatggccctgataatggttttgtcaaatgggcactttaaaatagacatatcctgaaatcagtagggcaggagtattttttctattgttattcctaatgaaagaataaggattcgatcaatgccatccagaaccatatgattaggcagggttctaccctccaacagcatatatattaattctttccaactcatggttgggaacacatataactttatttggctttaaaaagtgattttctattgacctaatgtgactaatgttcttaggcaatggcaaaacaccaaatgtgcttacaccgtgattcacaaaaagtgatacaattcctcattcagccaccagctaattccctctgtccctaccagctttggactactatttaagctaagaactaactgatgaaaaaataataaaagaagaaaactgcttttgtctatatctattacatctctggtaattaaataatgattttagaagtttccccaccagtttctccaattctgcagaatttaagaatcaaaagttttctaagtcaaaagaataaactatgtacttgtctctttttacctattcctcatctcctaaataatttatttaacctatttcccaactgaattccacttcattcattcattttttttgtaataaattgactaggtgtctattgtgtgtcaaagaagaagggatagagacagaggaaaagaaaatgacaaaaaattatgtacaaggtttatggtacatggtaacaattgccttgaatatctcttcctttgcacatgcattccacatgcaattgattcttaatctgaagtcaaagaacctttgaagggctgtgacagagtaactgtaagaggtctgcaaaggcctaggctcatcaacgtatacaccaaagattattttcaggttaaatataccacatatacattacaattttaaaaatttatatagatactattgtaagtatgttttttacaaaaaaaatgcgtagcatctggaaatgatactaaaaatagttaacaactggttaagcatgggtttccactaattcagtggactggtggccatcaacagctagcatggacaaactggtttccaccagctgcatatcacaccagcaaatccagttgaggaaaggcaacctcttcctctctatttcatcttttttttttccatattaaagaaaggtccttattttaaaaatatttctgggagttattattctaaaaaatattgtaaacttgcttggaccgccataaccttgtgacaaaccacaactcccatgagaaattataacaagtttagaactaggcctttgttggtgctttgtcttttatcatatttaacagagttattccctactttcccacttcttcccagatgttttaaaggctgtaaacctttcaccatgaaaaagtctgtcttaatttatactctatgtataatgagaaacgcctagtttcaggcttatgtatccaatttacttgaaccatttaatatttagcttacaagaaaagttccagcttgtgaagaacaaatgaaatgggctgcaatttgtgctaaactattttaaccctgagtatgtttgcaattggaaaaagtgtgttatgagaatgaacaatagttctttcctaatgagagaaggaaacaagctgggttgacttggctacctttcactttaaccagcctaagggagtaactcctaggttctctctttctgttagtttagaagaaaaaattactcaacatatttagtacatttaagataatgaatcatttaggcctatcactacctcagccaacaggtagtgataggaaggacagcatagtaactgcaagaaaacaaaatgtgtaatctctctatctttcctacagatttagaacaaagccaaatgactatggcaacatttagaaataaagtggtagtaataaggaaaataaattaagaatttagtcatacttaccaaaatgtaaattttaaacataatttatacatattcaaatgtagcactggtattttgtaaacctactaaaatcataattttaaataaagtggcaaaattataccaactactactactcttgggaagagtggtgtcaattccggtcatcttcttaatctaaaattaaaattctgagggtctactaatcagaagaggtttcagatatcaaatcattgaaaatgtaaatccaacttccaacaaaactaaccttaaaaaaggcaaaccacttgtagtcattcaacacaatctcaaagccttggttgtaaatgatggtgaaatggccagaattgccaaggtcatcatatgctgtatccagcttctgaaggtacaccactacttttttttcttgtggtcctaaagaaaaaaaaaaaaagcacaataaaggaaaattatttggatttcaataggggaaagaatcccccaatttcaattttaattgtgctgctttcctttcatgctacccagtttgagcacagtctgcctagtgaagaaaccagaggctccatcttgttgcctcaaacagttcctgctccgaggcaagactgtgaagttaggctctaaaaatttgagataatgcaagcagaagcagtggctcacgcctgtaatcctagcactttgcggggctgaggtcagaacttcaagactagtttgggcaacatagtgagaccctgtctctacaaaaataatttttaaaaattcgctggttatggtggtgcattgcctgtagtcccagctatttgagcggctgaagctgaggtggaaggattgcttgagcccaggagttggaggctgcagtgagctatgattgcacaactgcattccaacctgggcaacacagtgagaccttgtctcaaaaaagagagatatgctatgcagcccagcaggcagggagacccccaaaactacagtacctttccagagcatcccaacactgaagaaatttttccactgaacaaaaggagaaatggggaatgttgaaaattacaggcttccagaaacggagaaaaggcaaaatgctagtcaaaagtgggaaatgcaagaataaaaggtatgacaacaaaaagataaataaacagactatcagatcctaaggaagacaatgtgctaagcccaggagaagacacaaaatgatctattcggagaagaaatggggtacctttctcctcaaaggctctacagtttagaacctcataatctgaatccttccaaagtttattcagcaaactagaggtctgtatcctataaaaccaattagtgctgataggaatgatacgtttaaccttcatagatgagggctcagacctgtgggtgcctttaattactgaattaaggccaaaggtaattttataggcagagccttcctgaaaatgattcagctgtgtccatctggagagttgtgtattttaaagtttttccatgtttgagagtaatgctctgacatgggagattgcatgtgacagggcagtgcaaatcctgatctctttctgccccaaccttcaaactcaaatttaaaaaaaaaaaaaaaaaaaaggccaggcgtggtgactcccgcctgtaatcccagtactttgggaggccgaggcgggcggatcacgaggtcaggagatggagaccatcctggctaacacagtgaaacccgtctctactaaaaatacaaaatattagccgggcgtggtggcatgtgcccgtaatcctagctactcgggagactgaggcaggagaatcgcttaaacccgggaggcggaggttgcagtgagccgagatcccgccactgaactacagcctgggtgacagagcaagactccattctcaaaaaaaaaaaaaaaaaagttacaatgttcaggattatgaaatgctatacagtcagttaaaaaggtatttctttagtaacaaatgacttaatctttgttctgttgacaagaaaattatagctgattttttactgactctgcagaagtcacaggctgtaagagggtttgggtagaccacagtgtgactcttctaactagtgattgtcttttttccaccccacccccttcactaggttctttgttctaggggtaaccatgttatctgaaggcatatggaatatctccagtatgttcaaacactaggtatttattgagagccttccatgagccaaacattgtgcagactctgggcatttctaattactaggttcagagttaagttttctttgttattaattttttaaaaaatttttacctccttgcaatgcatgaaacaatgcagagtggtactagccgttttctagtactcatcaacacccgctcaaaccaaaatcgctgggcagaaagtccctttcccaccatctaacaaaaagagaaaacttcatgctatatcctcgagagtctctgagctcatctatcttcactagtaaaatagtaataaaaaataaaaataaattttaaaaataacgctaccagatcggactggagaaccaaacgattgcagttcccaagtctctctcaaagcaaacaaaattaagcgggaggaataaaaaagttcttgatcaaagtgttgagtccccaagataaccaagaaagtgtggagttagaagttctcagcagatgaactttaacttcgcgagcctggcggggaagaaggtccccaagggtccccgaatccagtcaagatgctctggccacccacaagcgtctgcctggggggaagcggtagttggcgtggcgctgcgttaggggctcaagggcagaaaggacgacccggaggactgccgagccggcggcttacccataaccgagcagttgacatcgcgctgggaaccgctggagcccacctggaagacccaggtgcccagcaggtcaagataggtgcagttggcaggtgtgtcgcagcgcacggcgccgtcgccggagagaagcagcaggagggcggcgagcagcaaggagggcccagcacccatgctgcagggagctgagaaaagaggtgaagaattaccaggaagccgagcgctgcgggctagcggtgagtccaccacgaggcgcgcgccttgaaatagctacg

SEQ ID NO: 1653 - DNA, 17780 bp, Homo sapiens
  source 1..17780: mol_type = genomic DNA
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagtgcagtcccaggcactgggagcttattaaagacagcacctcaagccctgccctatatctgctgaattagaatctgcattttaatgaaattcttagaagagtgatatgcatactaagtttgagaagctttggtactgaaggcatctagtgagtaccttgcaccttgtagatgctcggtaaatatttttttcctcacctctctgccccaaggcatttagtggctccctatacccatcagtcaaggctgaggacacagctttcacccaggacctggcctatgctcctttcacagtctctccccctgccactcttgccctgcagtggggagcctggtgggctccggcatccagccatgcttctgctccctggcctggccagcttggggcgactgcaacgtgaatctcaactgccactgcctcatcaccttccgatcacttcattacctgcctgacccctggcatatgctatataattctgatccatccctaactagggcctggcccatggtggccttcaatacaccttcattaaatggtctgtgaccccttcaaggcccctctggccccttgctgcccacatcccagccacatccggtgctcccttacctctagtcgctgtggtgttccgaggacagcgggtgctctgtgtgctccccaccttgcccctcctcacctcccccaaccccaggacagagctgggggctgcagtgcagtgctgcgggcttggtggcctgctcatggtggaagaagtccaccagcagttttctttctttgttcttggtctcagtgtttggccacctttccctgcctttggccagaaggccacaggacaaaagc

SEQ ID NO: 1654 - DNA, 16946 bp, Homo sapiens
  source 1..16946: mol_type = genomic DNA
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagt

SEQ ID NO: 1655 - DNA, 18242 bp, Homo sapiens
  source 1..18242: mol_type = genomic DNA
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttccctttccttccctctaagagcattttatttgcagagttagccaatagtatcttgtttcctgtaagggagactatctttagatgctgccacaggcaagctcagatactccagggtggaggccagctgccaacaggagggcctgactttataaacctggaagatctaaacctcagggaagactgcggagctggagggagagaggtgccacttaccccaacctggaggtggggggcagggagcaggccctgcagtcagcaaagcacagcacagtcagctctcattaatggggagccttcaggaagctgggagagctcatggggccctcagcttccctgcccacgagagggagcccagagtactcactggaccacactggggcacacacagctcttctcctcaaagtgcagtcccaggcactgggagcttattaaagacagcacctcaagccctgccctatatctgctgaattagaatctgcattttaatgaaattcttagaagagtgatatgcatactaagtttgagaagctttggtactgaaggcatctagtgagtaccttgcaccttgtagatgctcggtaaatatttttttcctcacctctctgccccaaggcatttagtggctccctatacccatcagtcaaggctgaggacacagctttcacccaggacctggcctatgctcctttcacagtctctccccctgccactcttgccctgcagtggggagcctggtgggctccggcatccagccatgcttctgctccctggcctggccagcttggggcgactgcaacgtgaatctcaactgccactgcctcatcaccttccgatcacttcattacctgcctgacccctggcatatgctatataattctgatccatccctaactagggcctggcccatggtggccttcaatacaccttcattaaatggtctgtgaccccttcaaggcccctctggccccttgctgcccacatcccagccacatccggtgctcccttacctctagtcgctgtggtgttccgaggacagcgggtgctctgtgtgctccccaccttgcccctcctcacctcccccaaccccaggacagagctgggggctgcagtgcagtgctgcgggcttggtggcctgctcatggtggaagaagtccaccagcagttttctttctttgttcttggtctcagtgtttggccacctttccctgcctttggccagaaggccacaggacaaaagcagagtcaggccgctccccatccactttctgacactggcccctccccaccccacaccaccccttgatacctctcctggggtccactcagctgggctggctgcctcagccccttccttgcctctgactcccctcctcttctgagggctcctttcttggatctggccaagactctccctctcttcctgtcccacactcttgacgacagtctcatccaccccacatcagtaatcccctccgtgttcatgagcacacatctctacctccatccagggcctggataatttcccaagcccatctaaccttctccgttctctgtctttcctctcaccacttaccccactggccattctccacccagaagccagagagctcttcctgaaatccaagtctgccaacttaaacgcctccaggggttctctcatcctggtttaagtccacggcctggtaagcacggcccgcccc

SEQ ID NO: 1656 - DNA, 16543 bp, Homo sapiens
  source 1..16543: mol_type = genomic DNA
tggaagttctataaaatatgtatttgctaaacattggaaacaagttaaatgtttatcaattgagtaatggcaagtaaattggggtacatgatcttgaaggaacatgacttattctctcattcattatacaaacatatagactgccaaagagctatcagatacacagcaatttaacagttaccacatctgacttcaatgaatacacagtctggtagagtcttctaaaatgataattaccaaactacatagaaagcgagcactatttgtggtctaacgttaagaggaaaacaaatcagattataaaaccatctgtacattacgattgcaactctaaacatgtgagagtgtgaacaaggtctggacgggtgaatacaggaatgacaatattgatgtggttagattggatgactttttctttagcattattacaattgttttcgagctttaaacttttagattgttccaaacgtttctaggggggaaaaaaaagctgctcccatagccctggctccccaggttggcagtagcatgaatgatggggtattttcccagatgggcaggggcttgccacaaggtgactgggaggggatattcaaggcagtccaggagagttgggttacggaaggctatcactctgtagacttgggagtgctcactgggtgccatcgtaagaaccagcctcttctgtgtctgggctatgccacgcagcagcacctgcaggctcttccaagctttgtcagcaccacaacttgggcacagcacagcagtgccaggtgtggaaagcagaagtctaagaggcagacaaaagggttgagacctgcaagagttggtggctagttcctcatgctggaaaggatgatctctatgtgaaaggtaccttatccctcttctacagaccaggaaactgaagcttgatttgtcccaagctactggagttggggttggaatccatcccttcttatttgggggcagggtttttctatttcccttactggcctgggagcaggtggagatgcatgaggtcatatggaagagacaggctgataggatgggtggagtcctttgggaaggaggaggcaatggggaatctattggtaggaccccatggtggacgtatgagaagccaagcatttgagttttgactcgatgcagtaggcagtggggagcccttgcaggtttggggacatgatggaagagggcttaatgaagacgaggctggtgtaatcaggggagaggctggatcaggcacatggtaagggtgatgtgtggcatttgttttgtgtaatcagaatagtacccacccatccaacttcttggaaatatgtatttctgcttctccatgagattggactggaagcttccatcttatatatcccttccccatggataacagcaccttccagggatgggcacctgatacaaacttggcctatcagagcacttccctgggaattttgcccttggggccagagaaacatgggtgtcagtccctctctggtgataaagctgtgtcatgtaaagtctgggggatctataatgactaaaagatttgagagtcagagagagggaattctagcttggctcaggccctggtttcccctcactttgagggctcagacacccttttgcttgtgccacaatatgaacaatattcaccaccctcatttaactaaactagtctgagttgaatttttgtcatctgcaaaccaaaaagttctgatgacatttgcagtaagagaaatgtctactctttgtcattcaaagagttcaatttgttcattcttcaaattttgagcacaattctcaacaacactctagggttgttttgtgtgcattgggtccatcattttgtgcctgtaagaaataacaacaaaaatctttcctcactagtcagcatcaggttcaggaactccaggttctctgtagacacaaggctttgggattcccttcagagaaggagcaatgcatctccatcactcgtgtggtaagtaaaattgctgctcagaacacttccatgcctgctcctttgtgattcagatgaggagaaatcaacgtggactgagcgcccacacaggacagccaggcatttcccatacaggtggtaaaggtatcttctgaacttctccccagcaaatgcatagatgagaggattcaggcaacaatggctaaatgcaaccgtctcagtcacactgagggccagcctcagatccttcctcatgtcacaactgggaaagaagtcatagagcttaagcgtctccaggaaaatcataacgttgtagggtgtccagaagaggaaaaacacgatgaccaccagaaggatcagtttaatggctttggctttcttgtggttcttgcaggaaaacagcgtctggatgattctgaagtagcaataactcataatgagcagggggagtaggaagccaagaaaatttgtttccacattgcggagcacgggccagatttcctggaggacctcggggtagtcaccaaggcattcattttctttctgctttgtgaacatgaactggggtgctgccaccaaaatggctgctgcccagacgcctaggctgatggtgacgccatgctgcacggtccggttgttcatggagttggcggccaggacgatggccaggtacctatcaatgctgatgacggtgatgaagaatatgcttccaaaaaagccgatgaagaagaaggcggtagtgaatttgcacatggcattgtggaggcccttttcatttatcaaatagtgagtccagaagggcaaagtggctacaaacagcagatcagacaaggccaggttcaggaggtaaatgtcggtgacactcttgggcttcttgctgttggtgagggcaaacactaccaacaaatttcccaccaggccaatggcaaagatgacggagtagaatatggacaggaacacagtcccaaagaccacgatgtccccaatataacaggcctcagccaaatcatcgtactcaaagttttctgtcactgattcagggaactgatccatggtgaaggcctggatcagaaagaaaaacaagtaactgtgttagttatcagagaaacaaagttggaattctgtgtggcctcatatgtaggcaggcaggaagaaacaaatattggttgggtgcacactacatttcccaacttcccacttgccatcttgtttaatccccacaacagtcttgtgatgaagactgcaacagactcttctgacaggagaggcggactcctttgacttgcccaaagccatgcagtaaatggctctgtgagcatttggctctaggcatttttttttttttaaatggagtctcgctgtgtcacccaggctggagtgcagtggtgcgatctcagctcactgcaacctctgtcccctggggttcaagcgattctcctgcctcagcctcccaaatagctgggattataggcgtgcactaccacgcctggctaatttttgtatttttagtagagatggggtttcatcatgttagccaggctggtctcaaactcctgacctcagattatccttccgcctcagcctcccaaaatgctaggattacaggcgtgagccacagcgcccagccagctctaggctttttgaagcttgagacagatctgttttacttttactgcccaaaatctctccaaaagctagctagtttgaccaatgtgtggatgagaaagggagaaccatgagcaggagggggaggggggtgagatggggtgaattgggggtgcagctgtaattcacacttccagtccaaacttccccaaagcaattctccatcctcttcctttgtttccaccttttccaccctctggccccttacttttccatgaagctaggcctggagagagaagcctcagacccagagccttgggcagaacagcacccggaagccctcatctttgttttttgagaaccatttcacctcctcttctccttataatcaacaagtccttctctttcttagcaggtatcagacagagtcatacactctagagtgactaccttgttttgggctgcccaggactttcctggttttagccctgaaagtcccatctattgggaacccctcagtcccaggcaaatcaggactgttggtcatcctacaacgctaagtgaagagaaggtgttgccatcattcaggactctgcagtcatagaggggctgactgattcaagatggaggatggggctccgttagtctgctgggctagtctccgggtgactaattccccctacgattaccagccctatagttcactttggtttggacttccccactattcttatctcctgtttccttctgagcaggaattgaaaaaagaagacacttctgcaggctgcactccccttcttttcgcagccaggacttgctgctcattcactccagagccggctgggaggcagccctttcacacggctcctctgggcgtctcctcgtgataccacagatgggtccctcagaaaccctcaaaacaggcctcctggttgtcactgcctccctccttaccacaacttacagcaaagctcacgctttaaccgagggagtttccacgccccactacaccctttccatgatggttttacccaggtggtgtctcaccaagatgagggcccacccagccagggtgtgtcacttctcgcttcccagcctctgctttggggcctgcatctcacccagactctcctgggataagtgggccggggctttacaacctaagctgtctcaggctgtgatgagttctcaaccccagggaacgtgtatgctttctctgcttcaggctacaatgcccttttctcagagaataatctctggctgtgacgttaattaataacatttaagtcaaatggtataaaatggctgacatacagctatttttgagccacatccatgtcagttttatatgactcaagctaatatgtgggaaacagaaattgctacttagtgcctgcagcttgtcacagagcatgatcttcccagacaagctgctgtatgagtaaaaatagtcaagtccttggtggttctatgttagggaccctggagctagctactttctccctccccttcccccagtgagaagagctggcaaagccgacctcgagaggtggccaaatccagtaaaaattgtctcgcatctctttatgtgcctgtggtcggtccttcagcacaggaacttctgtggactcgggcactcccgagattgaatcctgcatctgtcctctctggctgagtgatgggtgagcttgaaacctctgagcctaacattccttgtctgtaagatcgggattcattctcatgcctgcccacagaactgttttaaggggagcacctggcacagtgtgtcacatacagcaagcacttaatacatgttcaatttgtttcctgcattatgtgaggaagcaaaagccctttggatctttggaaacatccaggctgcctgtggactcccatgttccacctccaccctgggtatcctgggaatttggtctttaaaggtcactttatttttttttccccctgaaataagacatgctttcttttcagattattttgggggaggtaagccaccctttattgagcttttactaaactgtcaggctcattgctctgtttggattaatattgatctaatccgttctgcaattctgaaaaaaaaaagttctatatttaattcactgcactgctgaatgcctctggggatattcatgatgagaggaaggaatgggacaaatgtggagaaggaagggaaagttagaaataagcaactgattgcctggtggagtggcagaggggtcccaaatcaggccctttgccttactgggtgcttgggctcagggctgccacgtgcacaggggcatctctaatttgcaccaagtctccatataagctgggggtggtctggcttggcaaggagctcatgaaaagatcagtcaggtacagtctaagccaggaaggggcttgtcttctcaatggggaaaattcacataaagactttgattaagacagaatggaagaagtgggtgaatgtatcttctgcagatgggatgcaaattcagataatgctctgggcaggatggttttgcctgatacgtggtgatattatgtattgagagccaaatggctggttatgggcatccatctggcttgggactgctccctgccatccagggggtctgctcagtgagggcagacgaacactctgcagccctcatcctagctccctgctgtctcagagtccccagtgaagaccctagaattgctgtggctcccacaggagtctctcagtgctggcacagtgggtgcatgcagtgggtgctcacccagcatatcatggtccctgctatgagccatctggaccatgctacagaggaaagagcagtaccaatatcgctttctatgagttcccacgtgactctgaggaacagcactggtcattgagggacatttttgatcttcatgttcacatttccattttgcacacactgtgcctcacaggaggcacagctgggtgaagcacctggcccatcccacagctagaagcagggggagcaggactgaggccaaggcctgtgctgttcccactctcccttgaagatggaggagactcgggccctgggcttaggggccaaatcctggcaggggagaagagtcaaggactcgatgactatcaaacagttgagtcccaagtccagtggtaaaaaggcatcaaaacaacagccttagcttcctcctctaaaaaaataacctcttaggtttgttgagagcataagaattaaattactttaaattgcttattgggatttatcgtagacacacacatgctcaagcaagtgtgtacactgtcactgcaacaagcttcaaatataaatgaagggaaacaaccccaatgtccatcactagggacagatcaaagcacgataagtccaattaatggaataccaagcagctgcttaaaaaccaaacagtttctagctcttggaaacttgggaaaaacaacaaaaacaggcagatctgtatattctgtcatgcaacaatctctaagatatactggtaagtgaaaaaagctaggtgaggtaccatgtacatagtatgctgtcatttgtggaaaagaatgatgtgtgcgtattttgtataaagtttaaatatctcttaaggaatacactggtggtggtaattatccctggagagggattctgaaggattgaggatatgggaaaggagacagtttttatggtaaacttttggaaatgttttttaccatgtacacatactacgtattttggaaaatagtttaattaattcgtttggaattttaaaataaaaatcaacaaaaatatgagttatatgaaaaactaaaaaatgagtaacttagtacaataacaagcatgctgcacataataagtggtagccaacatataaaaggatcatctctatttttatgggcaaatagatgaattcagagagggtgaataacttgttcgaggtgatgcagtgtgtgtgcaatagggctgcagtgagggcccagatgtgttcggcctcagcacttttttttaacttcacattacagcccttccccattcctttttcccaagactaggagttcctaagagaagacccacgtcctcttcagctctgcaggccaatgttcaacagaaggcctggtacacagcgaatgccatatgaatatttgcagaaggataaatattatatcctagacctttgttccaaagagtttcatctagtagtgatgacagcaccctatcagtcaccctgatcccaggggtgctcatgagcacacaggtgtcctttctgatcataggctaggaagccttgaactctgagaagttagtaggtgcctgatgtgttaaatgaattaataaataagtgaatgaaagacttcaaggagcaagaaaagagattcgtcagctctataatatggagccccaggagatgagaagaggctcaccagctctccacagtcagaagacaacttggcaaacacaacctctcatttcaaccatacctctcacatgtggcttttgaacatatgtggtcatgaaatagatatcagcgtgggtaattgcagctctgtcttctgtgcaaatctcaagaaacagcaggagtcattgggcaacatagggttttgcctggttctgaagagacttgtattctgtgtgctggagctagttcaaaccgcccttggtagccaaatgccccagagcatgtgaaggcaccatttacataaaaaatctgacatcgctgaagctgtgtccttcgcagaagtattccagtgaacttgatagctttagcaaggcgctttttaaggaagactgagcctgagctgagtgtacctcctatttgtggatcctccaagatgttcaaggtttgggagctgagcctaagatagggcctcctggcagcagatgcgagtgtggccgtgccttgggggtggccctcagggtggtcaaaggcctgccagaggtctaattggttttcatcttagactggaccatggctttcctttgtccctgagggacactagaaaccaagtggaagaatcaaatgagaagactttgcagtgtctacccagctgggtttcatatccacaagggttgtaagacgcatgcattctgggatgttgcactaataaaggcatcatcaactaaggctgcactttacaacttagtgcagcagccagtaagaatttaaaccttctctgggccatcctcaggcctccttacccactattcagttaagccaaggttttactaaatggccttgagctgggagagtttcggtgaacctagacagagctttgagtgtacacatgtttcacacccaagtagaaatttgtaaaattccccactcacatccgtggctgatcctggtctacttcctctggcctacttccttttctcatgcctgctcatttattttttaactttttaggggagggacactcatcattacccattgtttccaatcagcttcccttttctatacttcccttcttctttaggtggccagaatccatttcttcttcaatctgacattcttttatgttgctttctccctctcttttggcttcacatccagcttactgttttctaaatccagtgtatcttctggtagtttttaccctcctggtctctgtttatggctttttagtaaaagtgaagactgggtttgaggttcagtctggtgccaagaaaattgtgaggcttaatttttttctttgtaccaaatgagagtagagaattgcttgaggagccccaacccaaactttccttatgaggatgccattgtgctgttgacattgtggaatctgaagtcaccctcagaaagccccagtttagaaagggaggaggctgccattcccggatgcctgctaagtgtcatgctccacacacaagatcccaccacattctcttcacaaccccactggagaaatgatgatccccatggtataaattaaccagcagaggcccagagatttggttaacttgttcaaggaagcaaaagagccaggatctcaaccccagatgcctctttccacaaagcctgtgctccttgcaccgcacaatgcttttctccctggaggggaaatctgcaggatattgcaggccacttctctcgaagtagaactgaaaatagtagacccaggccccttaagagaaactggtccatgatgcatctctgaattcgttggggttctccccctgtgggctcataacccagcaggctgcccctcagggattggtgagtggaaaatggaatgcgggatattatttgctcctctagccaccactaggtggtccacactgccagatccccaggaatctagctcccagcaaccatagtgaggaaactggggtcattttctctggagaggaaaagtctgaaggctgaaggtttagcctattttctgccttcaaatatatgatagtgcttttaagagccacatgtttcacaggagcccatacatttctgagcatgaatggctgagagaccctgggcaggtcactctgctctgcttcagtttcttgatgtatgaaattaaagcattggaccagaccacctctaagagccttgctagctctggcatgctcaatttttcagcaagaatcaaacagaaggaaactgtttgtttgagacaggatctcgctctgttgcccaggctggagtgcagtggcatgatcatagctcactacagccttgaactcctgggatgtagcaatcctcccacctcagtctcctaagtagctgggagtataggtgtgcaccaccatgcccagctatttttggtagatatggggtcttactatgttgaccaggctggtcttgaacatctggcctcaagagatcctcctgcctgggcctctcaaagtgccaggattacaggtgtgagccatcatgcctggccaaggaagcagtcttaaagagcaacatgagtcctaggtcagcaaaagtgtggtctattgtcaacagagaggctgcccagcagcctgcccagggaacatgacacttctacacttctggggcacagcctgtgagcattcagatgaggttctgtttggagatagggagctggatcagttgatcaagtcttggcaaatcttgtttaccttgtactagatagaaaggttctcagtcggctgccatgcccagacccctgactgtttgggaagccaagttttaccaggtcctgatggttttctcatttatgatggcagctatttttataacacatatcccttgggattcagagagagctaaggctgatggggagaggggtgctgaattccatgttaaggagctataaggaaacattttataccccatcccctatgcaagtaaattcagtgactatctattcctatagcaatgagcccatctagaacagcatggcattgtctacccaccagtttttcacacaggccaaatgcacacccaacccttccctccaaccaccaccaaaaaaaaaaaaaaaaaaaaaatagcaacaggagaatcctattgggtttagtgaattgcccctttacaaaacctgccattattttgtgtttgaagccccacccttccctttcctcttcaaaatactttatggtatttatttatttatgtcaaagtaaactgtgaaattttgaagggaaatacttcataatttttttaataattaggaaagagatagacttgttaattgtttaattattaattaagtcaatatttttgagcatctgtaccatattctagtctaagtagaaattaaaaataaaaacatttaattattcttgttaaaaataaggacagagatctcctcaccttctgtttttttctcagagcatttactttagaaaactttttttttttttgacatggagtttcactctcatcgcccaggctggagtgcaatggtgccatcttggctcactgccacctccacctcctgggttcaagtgattctcctgcctcagcctcccaagtagctgggattacaggcgcccaccaccatgcccagctaatttttgtatttttagtagagacaaggtttcaccatgttggccaggctgatctcaaattcctgacttcaggtgatccacccgcctcagcctctcaaagtgctgggaatacaggtgtgagccaccgtgcccacctagaaaacttttacatactttctcctctctttgaacatgtgtaaatccttttgaaactagataggctttttgtcagctttatgagctaagctagtctttcccaaggacctgggcgtcatctctttgaaatgtaaacaaacctaagggagatagtgcttctatctcttagtttctgtgggaaggtatgagcctaactgaagagccttgctcagtgctgcaaaattaccccttgtcttaaagataaatttgattttcctctgggtagagccagttagctaacacaagtggttaccctaattaccaggtaaatttagagtgaaccatgtacggcaaacggtgctggcaagacctcttacttgaggaacagttattgtttgccttgataacatgtatgtaacaggttgtatctacttggctatacaaaagggggagatttctttctgttcttgcaacctcttagtagatggcctataatgctctgcatattttggtttactgcttattccataataaaactgttctttctctactccttttgtggagagaatctctgtgttgaaagaagactttgttaattatatttcaccaatactaggcactgtgctagattctgtagaggcaaaagtgtttaagatacagttcctagaagtgtttattattgctcagtaacagaatataagaaaagtcatgggaagcccaaggattgaacctctatatctgtctccttaaaaactgggggagggtgatcaagaggatatcacaaaaaaaaaaaaaaaaatctgccgtttgagctgatgttttaaggatggggaaagtcttccaggttgaccaagatggaggtggcagtgaatagtgggtgggctttgaagacaaaggcacagagggtctgagcataggaaggtttcctggggccaaggccaggcagagggaaataggaacagaaggcagtgaagatggtggagttgggaggagcccacatgctcccagagtgttcaggaaagtcagtttaggctgagtgcagggcttcggggaaggatgcagagaaagccaaggctgaaaagggagaagagggacatagagaggggtctgaaattccacactaagtaactacaaggaaaaatgatgaaagactttgaaatagacacacactgaagattactgggagtcctttctggcatactctttggggctacctcccccttttattgcctgagctaattttacagcaccgtaggttatagcagatagcagtgcaaatgactcttgctcatggaaatacaaattttgtctagtggagatgcactggattaagtgccctgtagatatggaccaattgtgcctttatctctaaattcatctcagtatttctggaagcatctcacccatgctgttggtttggctgtagactgctaattctccttgctgcgtaggattccactgtgtgactagtccatgatttattgccatttctactgctaatgcacacataggtggctttcagtttgttgctagtttggacaatgttgccgtgaaaatttttgtgcatgtacatctcctacaacgtggatgcattttaaaagtttagtcttgagccaaaccaaaaagtatgaatccaaatatgaagatcaaaaataggcaaagctaagctatattgtttagggatgatatttagattcagtcaaactatagggaaaagcaaggaagtgatcaccatagaagtcagacttgtggttctttgtgggagaggaagaggctgtggtcaggaagggacatgagagaggcttctggggttctctttctcagcctggatggtagtaatgtgggaaattaaatctaatactttgctaacccagacattgttctttcagtgtgttgtattttgcaataaacaaaatacaacacactgaaaagagactttccattttctccttaagcacactttaaggggaaaacaaaggtggtctaggaagatgtttaaagacatatgatacagcttttcttccttactcacaagctaaaaagctgcactttggccaaacaagatgagggggtcgaagcatcagctgtggccagcgtgccgtgagaatcccacctgtgaagcagccagcagattctgagcccctcaagagggcaggtgggatcaaggttcagctagaagccccaactttcccctggctcttctgggcagagtgagtgatgccagagagcccaacttctcggaatgcctgggctgtgctgctaggaatcagaacaagtccttgggaaaggcagccaagatctggattctgccattctggttccactccctcctatgaccgtgacctgctgtggagcagcagaagttcccctccttgttcagctcctccattacaggtgctggttccaaacgtctctggactcaggatactgggtcagaggctggggctggggaggagcagttggatgcctggatcccaagaaggaggttttttgaggctagggtctctggctagggagaaccatacctgacattgccactgtgccatagctgcctagggccgggcaggcttcctcctgggatggggtggggtgaggaaggggatagacgatcgtcctgactgggtcagctctaatacgttctttgctttcctgcccctacagctctggattcttcacaacctcattcaatagtagtcagtgtttttcaggtatccaaactttctgaggctcagtttcctcatgacaacaacatatatcgtttcttgagcatcaaagatgggtcaggcagtgtgtttgggacttcctataccatgcctttaatccttgcagaaagttgacacatacccattacatggcttcaaaggctgatggacaatctccattttaaaagcaggaaacagacttagcaagcccagtgcacagtcaccaagtgcagagccaggacttcattcctgacttcattccttcattccaaagccaagctgcctatgtccccatctgtgaagtggggccagctgaggagcagggttcaggagcagactttgtggagactggcacgtggctgatggatagtaggtgctcccatcccagaggtgtggcaagtgccaggtaagcctgagcactaagaagaaccacactgaagttgggctgagactatttcctgccctgccttcctttgtgaaaataaagccaagcaaagaggaagatgaaagaatccaccctagccttcctgagcccatttctcattcccaggggttttgaaccccaatccactgcccccattcccaacccacagtggtcctcaaggctctccagcacaggtccgtcacccaccctgcctcctctcaggaaacccagctccctccaaagcgccctctgggcctgggatgccctgagcaatgcaagctttcttgcctgctttcacgtggttcaattttcctttttttttggctcaatttttttctgcctcaagttttctacctcaagtatttcaaaaattaatttttttttcttttcttttttttttttttttttgtggagtgggtgttgaaagaatcctaaactttcttagccattctctggactgagctataaactcacaaagcaaggattgcaggctctgtgaggctgtgattgccagaggcaaggcaagagaaataacaagccgtggtcagtcctcagctggggcctctgatggatttcctcctgtcttgcactcataatttctttctgaagaccatgttttccacccacacaaacctgagcctgagtatcctcacaatggttataacaacatatatcaaaattgaacactaaatttgtgccaggaatttattaatggagaaaccccgcctctactaaaaatacaaaattagccgggcggtggtacatgcctataatcccagctacttgggaggctgaggcaggagaatcacttgaacccaggaggcagaggttgcagtgagccgagactgtgccattgcactccagcttaggcaacaagagcaaaactccgtctcaaaaaacaaaacacaaacaagaaagaaaacccaaaaaacaaaaaacaaacaaaaacccatagatggtacaaaaagtggaagaaaaaggaaaaaaaaacccatgaaactatctgcaatgcagtttcctagaatcaaccacagtaatcttttagcttttctctatctaaatgttatacatattttatatttatattaagtgcatttatatttatattaaaatacagatacaaatttaaaaactctttattattaaattttcaaataaaaagcaacttttcaaataaaagcagcgagaacctccttatacccaacacctggcttcaactattagcaacccatggtcaatatttcctctatttcccacttaatgtctctactgaattatttaatttcacccataaacacttgtgtgcatctctaaaagttaaggactcttttttgaaaaagactttaatacaatttctcatctcaaaaaattagcaataattcctcaacagcatccagatgcaatttttcatgcttttttcagttagtttaaaatcatgagcttttctccatgtctctaaaatgtaattactaatgcttctaatactattccaccaggttgagtgtattataaatgatctgatcaccccttgcctcccactcttccatccccttggacatatttaggctacaacatccccaggaaaatggtttccattgtctgcacgtaagcaaacaggcattattaacctattagctgtccactgctccaccccacccacaggtacccaactagtcctgtgcacctacctggcgtggactgccaagggaacctctggatctgccagtcagccaccctgtcctgctcagactttaccagagacgagtatttc

SEQ ID NO: 1657 - DNA, 14941 bp, Homo sapiens
  source 1..14941: mol_type = genomic DNA
ttggtggctacatttgagtacagaactttattaggaaaattataagtgcatatacattttttcattggtatgacttcaaagtagaaattgttgtttctcaaagagttgtttcttatttattttttaaagcacgctgcgtataggaattggccttctcctggaccattttcacattatctgggagatgcaattgaaacaatacaaaatacagtattcatcacatttaacactgaatcattcactgctcagagactgagagtccagcgaggttgcaaaataacaaattttctacatggttttatcagtggtctgcttaggggatttggaagtttctagggaatatttcccaggaatggggctccttcagaatgagtcagggaagctctgtagagggatcagagcactcaaattctcatccagctggaaaagggtgtagcacctgggaaaggcgatcaactcccagtcagggagcccacggtgataacaccagtcagacgatcacaccatggaagggtccaatgagatccaatggaaagacttagaacatctaaggttgggggaggtgcaaccttctgctattcagcccctctgctccaagcggaaccttttttctcaggaggtaatctctaataacaagcagagtgccctctggagcctcctcgctggtatctcagtgcctggacagagggggacacaccacagcacaaacacgtggcacagactcaatcccaacacacagccagtcaacgagcctctggccccttcctctgggtcctgatacagagctggcagcgagggcctctgaagaggttacagggagcccaagggagtgtcaggtagaggcagcaccaggtcccggagggacagatgagggatccctagtaaacagctcgtggacgcacttgactagcagttcgaaagcaaaaagagattcggattacaagagacttttcccttgcaaatggaagactgtatttaaatgcatattgctttagctgggcagtctccaggaaggagctgattgttagtagaggaattgttatgcaaataattttccctgcagtttctactcttatctattttctcccatggaggagaaatagaaatgattcctttcctgactgtagtcaagatttagggtcatgtttgtttcctcaaccaagaattcaatggtcttggttcatggattgggggcaggtacatccaagttctacgtgacagattttaaaatatcttggattacctggataatgactgccccactgaaaactcaattatactggtatagtgagaggttaatttcaaaaggttttgaaagagttctgtatctttataactagtaaagatccctcaggctctattttttcaatataacatagctggattgaggattttaatttttgtttaagggacaatttttgttgatgggtttgccttctgccatgaagctccaatttgaaatacttatgaaaatacttaacacatgttactaattaccctacagattattaaattcaagaacagttacaattcaagattacatcactataatttacttcctacttcctacatgttacatagtttccttgctttgacttccttgttttccactttcttcattaaaattttttttaactggagtctttaatcaaagggcaaaagtattcgtaagactgaatgaaaaacaaaacaaaaacccacaagtgcttgcctttgtcaaaagtgaacattttaagtggcttaatacagctctatcgactgccctcagtggaaggggaacactccaaatgtcaggcaggttgacttactcttcacatagcacattgttctcttagagaaatgtcctgtgggaagggcccgaagcacaggtgacacgcagagcagagagggcccaggaggaaggcaggagatgatggcattgccaaatggtgaagaagatgaggttagatgtgaattgggaaagaatcttcatgtccaggattggttattttgtggactgggttttaaaaaccaaaaacaagttgtgaatgcttgttttcctcaagcagtgctgggcttggccctagtttgaaggtactgacatgtgagggagcactgatggggcagcaatcctctggggtcaaccctggtgcacaccgaattcccttgggctctgcccatggacccaccatgtttttgtgatcagtgggggaaccaaggtagttcaccccaaaggaccacggctctgatcaggactgcactcaaagggcccaaggagcatctcctcgctcagcggctgcacagggggaacagtgcatgcatcaagacattggtcacagaggaggacgctggctttgaacaaaaacataggattggacaatggacaatattccaaacaagacacagatgtgcacagtgttttcaggtaacacaagacattttcatttcctgcttggtgcacagtttacatgaaagctttggtcctgagagtccttttgcagggccatggagacagtcgtggacacacatgatgatggatgagacagagaatgatgagcagaacgtggaggatgtggaggtgctcgggatgagggctgggtctcactctgccctggcctcacactgctgcctcagctcagggtagccctgctgccctcccagaagaggcagacccggctcccatgtggatggagaagggggtgagcctcccatgtggccctccaccatcccatcccacagagagaagccttcactaggctttgcccaggttgactggtcctggcacccccaggcgtccctcttggtggctctccaccctagggctgaccatggggccaggctccctcagcccagtctccccacctgcacagctcagagaatacaaaacccaggagccctgagtcagaggagtggctccgtggaaagacactctaataaggcaagtacaataatggccttagtctaagctgctacgtgtcgccagtgacactgaataatcaaactaaatgaaaaataaatgtcatgtattttgctacataatcaaatggtgaaaatatggcaaagtgtgcaaaacaaagcccttggcaatgcctggggccctgccctggcaggggaggctgtggcaggcccttccctaacactggtttcagagctgggctcctactgtaagggttcctcaggcgtctgaccctctcacatcttgaacctcctgttgacaagaacagagggaaacaccattaaggcaggttccccccacacccagccagctccagaaggacagcggcctgcgcggaggccctggggccaatccctacttccaagttgccaccttggccatgcatctcccttcagaggccctgcgacaacagacgggaggggagtgcgagacgcagccaggctgaagcggagggacccatggatggcagaaagcagaggacagacacgtggcaagcactgggcgtggcagacgcacgaaggcacagagaggcccatcagagtggtcatacgacggggacagggcacactgcttacccggcaccggcgtggggctgaggctcaggatgctgctgccctgcatcctggcctcggctgtcccaagaggcactttcgtggcttccagtaacccttcgccctcggggcctctcagccaggggccatgccaccgtaggtggccccaggtgggactgctggaggtggcacaggggtgggtgcacaggtggccaggacctcccaggaggaacgcatgctggacagagcagtgaccatagcgcacccctcatttggctctgactggtgtgagcacttcctagtttcaacccaccaggaatcccggtcaggctcttcactcttccacggcgaccctgtcttcagcactgggtgtaccacctgctcccaggagcttcacaagccacttgtaaaccacagtgagcccccagggcacatacagtcacatcaagacatcaagacaggacggaccttgcatgcgttctcaaggtgggacccactctcagtccctgcagaccctgctccccaggagtgggatagcaagcagtttgtatcctcaggcagccttagctgggccctctgtccctagggggccaacagcttttcatactgaccaggacagactggccacccctccccaggcacaaagccctgctgcatgtggagtccgaagaatgcaggcgagtatgggggcacaggtttgccctctcggggcgcttttgtcaagagtcccatggactagagtggctactggcttccacgggaaggatggcagccccaggcagcccacccaacagctctgtgccttaagaggtggggagggcagaagactagggcacccctgtacccagggctcaggcctgtgacccccagtgctggcaagaggaacgtgggccaggagagttgtccaggtaaaagagatagcagcgggaaacaaaggtctttggctgaagcatcctaggacacctccccaacgaggagaaggcatggctgtgatcacagggagctcattaaagctcaaggggacaccacgctccgggacagggtgtgtctgacatgcaggggtctttgtgggttttctcctgaattccatgtgctccatcctccaaccactttctctttctgcatttattaaaattatgacccaggatccgggtgcagggtgggcgggtgtttatgtgaggtggagaagggctgagaaattcaacgcatcctttttccgagcactactgaaatggggtccttgctcttccatcctcccggtccagattagagaaacttgccaaaaaatctcacacatacatctacatgggcagggaaggagggtgcaggaaagttcctagagcttaagtggtatttgctttaggcagataaggtatttcccatgaatgaggacagaggcagctgtgccctgcagctggagcacacgccatcacgcaggaggcgggaggggacaggctgggatccccagggattcaggacccttgcaaagttccatagcacatctgtcctccacgtgggggacccgtttaaagactctaaagagaattgcccaaagaggagctccctgagaagtgtttccacatctgctctctgagaatgcagcattccctcgggctcaccccacacagtttgcagaaacccacccgggcttggggataaagccactcccacaacccaggaaggaggggctgaagaagccccttcccaggtggcagagtgctggagggaaaggcaatgggtatttggaaaaagccagggcccattcctaagggtcagtcagttttcacctttcctgagggccacagaggggtggcacacccccttcctggcgaggccacctctgctagcaggttgccctgcacactggccaggtggccacagcctggtctccacaggaatgcagactgcaagtgtgtggagctggtgagctccccagtgagcgcaggccttctaagagaggaagtggagggcgggctggggggctcagcaacctgggcattcctggagctcccaggctattctggacagagtcctgagcacacaggctccgcgtcacagacccccgccccagtctctgcacaactactttcttcataacttagcagaccaacaagggccttaaaaagcacataaatacagaagccggtgtggctggcagggcagcaaagcactgctcccccacggaagtctgagcccctgcccagtctgcatgggggtctgtcctggaggaggatcgagcaaatttacaaagcgccgagagcaagtgaactgtggtccatctcgaggtggcagataactagtttttccttttctgggcagcctttctcttcttctgtcgcttcttttttcctatcttttcttttttccccactttttcttctctgcgcccccttagataaaattagtagaaccattaataatgtggaaataaacaaaagttcgtctcagtctgcataagatttaacactggcccgtgtactggttaaactgtgccttcagtctcaggcctggaggcccctggtcaaagcactgtttatcagtaattcattaaaataaattggacatttccttccattcaaacaaatgttcaatgggctcctagaacacctttgtgaatgggttacagcgactgccaatctgccaacctgaacctgattcccactggggacaaggaatccacatctcagggtacacccagggccaggctggccatcgtggtccttgtcaccccaccctgccctgttctcatgggactttttcttcttctcaatgcagggctgaactcttagctttctctaagaaatgtctgcatttcaaattgaataacgttttggaggctgcaggccccaggttcagactgccattcagaagaggagaaaaaaggcagtggtcccaccttcccctttctagacgcctgtgaacactcctgggaatgaatgcgattgttctggagagcaagggagagagctggttagcagaattttattagagcaactggctcgtgactgtcacattaaaatgattcaagctgaatggtatttaatgatttatggggtgaggccacctgtccctgtgaaagcttcatattaaccatggcctggagtcatgggatttttacatgggaaaatgtaaaaggttgatattactagggttgagtctctggggattacatggggaagttaggagaaccaaggaggaggagggagggaagacgaattagtgagtcaaatattattcttcagaaaaccagcactgctatttcaatcgggttaaaaaaaaaaaaaaaagatccaaaaacttgagctgcagatctaatctgctcgtgagaaaagcccatacactgtcacacatgggctgtgagaaggggtctcagacacctgactgcaggcaggcttaactatataaaccagaaacgtctataagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggc

SEQ ID NO: 1658 - DNA, 9231 bp, Homo sapiens
  source 1..9231: mol_type = genomic DNA
ggaggaggatcgagcaaatttacaaagcgccgagagcaagtgaactgtggtccatctcgaggtggcagataactagtttttccttttctgggcagcctttctcttcttctgtcgcttcttttttcctatcttttcttttttccccactttttcttctctgcgcccccttagataaaattagtagaaccattaataatgtggaaataaacaaaagttcgtctcagtctgcataagatttaacactggcccgtgtactggttaaactgtgccttcagtctcaggcctggaggcccctggtcaaagcactgtttatcagtaattcattaaaataaattggacatttccttccattcaaacaaatgttcaatgggctcctagaacacctttgtgaatgggttacagcgactgccaatctgccaacctgaacctgattcccactggggacaaggaatccacatctcagggtacacccagggccaggctggccatcgtggtccttgtcaccccaccctgccctgttctcatgggactttttcttcttctcaatgcagggctgaactcttagctttctctaagaaatgtctgcatttcaaattgaataacgttttggaggctgcaggccccaggttcagactgccattcagaagaggagaaaaaaggcagtggtcccaccttcccctttctagacgcctgtgaacactcctgggaatgaatgcgattgttctggagagcaagggagagagctggttagcagaattttattagagcaactggctcgtgactgtcacattaaaatgattcaagctgaatggtatttaatgatttatggggtgaggccacctgtccctgtgaaagcttcatattaaccatggcctggagtcatgggatttttacatgggaaaatgtaaaaggttgatattactagggttgagtctctggggattacatggggaagttaggagaaccaaggaggaggagggagggaagacgaattagtgagtcaaatattattcttcagaaaaccagcactgctatttcaatcgggttaaaaaaaaaaaaaaaagatccaaaaacttgagctgcagatctaatctgctcgtgagaaaagcccatacactgtcacacatgggctgtgagaaggggtctcagacacctgactgcaggcaggcttaactatataaaccagaaacgtctataagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggc

SEQ ID NO: 1659 - DNA, 8036 bp, Homo sapiens
  source 1..8036: mol_type = genomic DNA
taagctccatcactaacaactaatgaattttatttcaggtaaataaattcccacatacagtaggacgtttataccatgaaacaattagcattttattgctagtgcatataatgtcacatttgatacaattttagtacaagtgaaaaaatacactgtggctaacattgaaaagctgcaatcacatttatatatcatatatatttctttacaaattgccagtagtttgagataatagagaagtataaactactgacattcatatggctccacttcaaatatatgaattgttcgactataaatatattttgaaatacatttgttttctaaagaaacgtaaaaaaaaatgtgcacaaaaatatatataaaaaaatgccttgcaaaaagttacaaataccaccaggaccttctgtggatcgcatttatgcatggaaatgtcaccttgccaacagttctgattggaacctgaaaccctgctgtggcttcaggagggggtagtggcaagatgatggtttattcactgattttttcgcttctgatttcggaaacctcagagtttgttagtgcctccatggcatacataggcttcagaggcaatcacaaaacccagtcactcaaagcgagctctcagatttaaaattgcatttgattctgtaaagacttgtcttttgcgggtaagcagggggaccattacacatccccaggagagggccagctccattctggaggaggccaaagacggatctcacagagggcccgagctgtggggcaggccctgggaggagagggatgcagggcacgagccccagcaatcaccctcttcccggctggtgcggcgctgatcaggctacagaaatgagaagcagaagcaagattaagcatgctctcggagtcggggagagagtaggaatagctgggagaggggtctctgagcacagtcccagtaatagtggcttctacatggagcccacagagccaatcactgaggttgaaagaggaggtgaaggcagtggcggcgcccagccccagtcggtatctgagtgccacagaggccttcctcttgggaggggcgctgctgcgggagcctcagtgtctgaagaaaggacactttttccagctccctgttaagccaccacctgactgtgcccagactccccaggggagcagaggagatgctccaaacaagccaaattcagatcttgaagtactcgttgatttaaaaaatgagaatgagaatgatgatgattgtgatgatcatgaaggaactaactgcttgaaaatgctgttgataatacaatttctttcttagaaaaaccccagtaataaaagttccaacgtgcacaggtacagggcatggatgaatataagctgcaatatcataccgtatgctataaatgcagggtctaaatgctggcaaacctcaggcccgatcccagatcaatgtgcccaccccacacacacacctggtcctcatggttaaggccccctcccccacgtctttgccctttcatctctcacaaggttttagttttcctcgagtgggtctagcggaaagtcctttttggctgttgtgcttacttgtttaaagctttctccaggtactcctgaatccactttagcttcgggtcaatgcacacttgtctgttgttgttcttcagccgggctctgtgaaaacagaatggcaacagtgtgcggctgcacaggaggaaggcgcggctgcaacgtgtgcatccgctcccccaacacccatctagggccctcgctggcaccccgtgctccacttggtacgctcaggctccagaggtgctcgcggtgtgctggggaaagctcagcgctggcagtgcaggaagttccattgcagagacatggaaatgtgaacagaagtctttccggggcagtgcaggggaattcatgtaagggagcatttgagctgcctttgaaggataagtaggagcttggagagtaaataaacgggaagggaaaatcaggagcaaatacgccaggggggtcatcaaagcatacagaggaaactgaggaaggggacgacaggatgctctaggtacctggggaggggagaatggagagcaacagagcagaggtttatttggatgggtcatcttgatagatatagggccgacttaaggatgggcatgaggaagcctggaggaaggaggcctgccagaagtcaccgcggtctgaccgggagggtgaccagccagggaggggaggggcagtgcaggtggcttaccagaaaatagtttctagaaagattttacaagttcactgaatgtttcttggtctcatttgttttttaaaagttcacactcttaaaagcttccctacatgcaaactcctggggaaggcctgatttcatctctctgaatctcttgccagaaagccctttggtgccaggtaatctcatgcagcccaagtacttaagggtcttgaggacagctaagccccagaacagtggttcaggggcacccagggagtcttcaagcagcctgtccattaggtgaagaggggtgcagagatgggtgtggctcggagcaacccacattggggtccaaatctggggcctattctttgttaatttagtgtctgctcagacctgagaattgtatttggcatcttcaacttcaaggtgcatttccaggccagtaaaccagcatgatcagtgctgtaaagcaggtccaaggtagctaaattgagcatctttaaaatactcttcacaagagataaagtatcatgttgtaggcaaagtacagaaaaaacattcattttctagggccctaaaacatactgtaaataacaaacacattcaaggcagtaaagggttaactcaaaactaaaaacagttttctaaaatcaaaagtaaaaacatttggtgttgggtggaaaagtcttgggaaagttgtagctttggttccaactgctgtctccccaccccatttttagcactagaacttctgagcaatcaaatcctctccaggagactccctgagccctcgcttccccgtgttcagacacaggacctcttgagcatgagagggctttcaagcacatggctttcttcccgcatttctcccggtcttctgtacccagctgagatcttcctgtcttgtggatgtgtgattttggtctttgtttcccaaatgaataaaatcaaatgttagtggctgccatccacaccaaataacaccaaaacctcatatgttgtacttgagaaaatacaggcaagtgagctgaaaatgttgaagtttcacccaatggttaaagaggacttaaactgcatttgggtcttgtgagttaatgtagggcatcagatccccgaaactggcaggccagttatcactgttattagctaagggctggctaatttactaggcttcagccaaaaccttggtgaagcccatagtttctccagcatccagctgtgctgtgctgaagaacacaggtttggaaagaagagagaactactacgagcacagcagggtgcccaggccaagagcggcttttaaaattaatgcctggtggcatactaaaggtcctcatgataagaatagctgccactaattatgccaagttcaaggttggacacttggcttgtcacctctacacctttaataagactcgggttagatgttactatgttcgttagatgcaactatgttcgttagatgatgttcaatttcaagacttacacaatctgaagggcacagtttggagtgttgagaattttgagatgcttgacgttggctctggcaacatggctttcgaagaatcggcatgggcatctgtagctcaggctgacgggcttccctagaagaggtaaggacaacaaggcactttactaccctgccagattttggtaatgtgtgtctgggctgcagcagttggtgcagcgattaaggatcaagagacggcatcactggggtaagttccaggttactggtgtatgttgggaaaggccatctcctcaggcaacacagtgagtgctggctgagctcaggctcagcttctacagggcaaggagcccaacaggcctggggagagccggagcctagatgaggcgggagtttaaattagaagccacctgctcagtgtctcaagataaaggtagtaattatagtagataacggtttcagtccaaggtactgaaatttccagttactctttgtaaaaaaaattcctcaagggacaactgagaaagatctccctactcagggaaaagaaagggggacaagaggctccaggctccctggcctctctcctctggcacaggcctctagccaggaagcacagtagtactcaggaatgctgccctcccccaccccagagacccctcctcacattcacctaaagctctggaaggcacaaaagaatcctggctggcttcctacctgtgagtcccctgagagcaggccaaggacccaccttctgcccagcactttccccaaggcttagagattagtggagctggagttaaatgtggttttcattgcctaggcagggatgctgtagcctcaggaattgtattaagatctttgcaaaatcaccaatttacaaaatgccataattgacactcattagtgtaaattagcaaggggctcctgcagaacccactgctcaccctttaaatataggattgcaagccctggagggctgggatttgtgtgtgctttttgtttttcttttttccttgaagattttatccaagccccacttaataccccaaattatttgaacttgtggatcctttcatcagagattaaatatatgtctaagaatatttggtccagagattttttttcttttttctttttttttaagtttgcctgtttacaaagttctgagagacctctgtggttctgaaattctgcacctttgggaaagaatgctggggaagtaggaggaaatcttgagtaaggggctcattttattttattttttctacagactgcaatcaattgagggatgatgtggactaggaattgcattgtgtattcagccaccaagttgcaggaaaagtggaccacttgtccccccacttccttgtccccaggaccaaatgcaactccctgaaaaccaggaaaaagccaagcatcagggtgctggtgactcatggcactggagagacctaaggcagccttcacagttacacctgatctaactccagaaaggcacctctggggccagcttccagcagctgcactgggaccctgcaggggaagtcagcactgcactgtaaccagatcacctgggaaagccacccccagggccggggcctgcagcctgggtaactgaggagctaaacgctcctgagtgttgtgcctccaggtttccctggatttcttttgggcccttccaagctgaggcagggggtgggttgggggtggagcaggagaataggaggccggtagtgaggcacaagccccctcccggcaacagtgagcttgaagatatgcagccaagggcaagtgctgcagccgcccccgctgggatgggtggggctgtgactctccagcgcccagaggagagaagctcctctggccccccaaccaagcagtggtgatgaggccagaaatcagagcctattcagagctcaacacacaggctctctctcctctccccctccaccccctgggattatccatttccttcaaaagcaattcttgcttctactcccaggacctaaggcccgcctgtcaagcagcgaatttcaacaggtctttttaaagtgacagagcccccaggtgtgcttaccaaaagaacatggtctcgtgtgtacctcatgtgctccttcctccagctttttgtcagtaagactaactttcccaaccgttctggatgtaaatccgtgtaccggcaagagtcctgactggctctgatggtaccccggatttgggaccgggtgagcttggctccaggagttttcagaaagccctccagtctaatgcagagacaggagcccagctggcccctccaagcaggcttgggaagggggcccaccctgagtttaagcccgggaaacccaagggcccagctgcctgacggaagtcagccaatgggggaggggcaggacccctggccaagctctctctgtagtgcagcttgaggactaagtgtggggatagggggcacataggcactgtgaggtgaggggaaaacaaaacaaaacaaaacattctggcgatgtgtgtaaggagcagatctgcctggagcccaggctcctgccctggttacttggctgccaatggggcaactctgagggccatgtcacccttcccaggccaggaggagtctgggatgaaccccacgtctctgtgcttcccccaggtcagttgcacccataactcaaagaccgaggttcctcattccaatcctctctccagccctccggggagggggcagcaccatttcccagagcggcgcactgtgacacctccgcgctcatcccaccaatcagtcaataactgcccaaaccagagaccttacaggaacagaagaatatccagcaataaaaactagaaacatgccccatgacttgcgggggggggggggggtcagtgtgcagacacagcctcagggacttttcatcaacgacgaacattcccaattgccttcagtctgtgtccttaacacttaggcagtccgccacgaccccaggctgcccagcttctccagcccgactcagctgcgctggtcctgctcacaccagcgcacagtccaagccagctaggacgccggggccacgtctgcaccaacccagccaagggctcgaggcgcgctgggcctgcacagcccgcggctgcaagagcactcagagtgtccttcaactctttgcaggaaacttcacagccaaggaagctcagcggcctgagccacagggttttgttttgtgtgttcagaggcaacagtttattttggtttgcatcggtgtcctgtgacagcgcagcgagtttctcttcagcgaaagaaaagaaaaaagccctctcccagtgaaacgggacaccacggttcccagtggcccagggccttggagattgaactttgctgcagctctcattctggggcaaagcgcttggccagctggtgacaaaagagcctgtctgcaggtgtgtttggggagctggggagggggcgtgtgaggctcggagggtccctgggcctctctcaggtgaacccgagaagagacaggaagacagcggctggacgcgcgcccaggtccgcgtcgctgcggaccgcggagctgtgcagaagcgcggcctggcgggtggcacaagcccgacagctgcgccgcgcagcccgcccgcgcctggccaagagccccgcgagggtgtggggagaggatcggcttcgcagggagcggaggctgcgcggctgcatcggacctcacagcctcaagtcgcggcatgaggcgaactttgcaaagcgcgctctcgccatgcaccgcccgacctccagcactgtgcgcagcaggacctcggagcccattcgcctgtggaaaccgagcccgcagcgggaaggcagtgggtggagggtgggcaggcaggggtctggggtccgcggctccccaccctcgcgccttcccgcgccagtcccgaacgctctcttggggcgttcctgcccagttgtcccggctgacctcgctctgcagccagcttgaggtcaggcggtcgctctctgcaggtcacaaaccctcggcgcaaaagtagggctttgaacgcgacaccgcaccagagcgcccagctaagcgagctgcctccacccccactgtgtcgggcggcgcaaactgcgggcgcaggcagaggagccgcggctctgcgccgggcgggagccgaagcccagagcctcgccagggcctccccgccgagcgcacttaccgtcgctgaggcagagcgcggtcagcacgaggaccagcacgaccacgaccttggcgttcatggcgcgggcgggcgggcgggcgggcggacgagcgcgggtcgggggccggacgccgagcgggcaatgcggctgacggagagtgaaagtgcggc

SEQ ID NO: 1660 - DNA, 8036 bp, Homo sapiens; identical to SEQ ID NO: 1659
  source 1..8036: mol_type = genomic DNA

SEQ ID NO: 1661 - DNA, 6019 bp, Homo sapiens
  source 1..6019: mol_type = genomic DNA
ctgattaatggtctatttattgataccattctattttaacaaagaaaatatttcaaattacaaggtatacaagtcaatactgttttgaagtgaaaaattatttgctttgagagtgtatgcatgtatgtatatatatgataaatgattataacgtgtgtgtcagtgacaatatgtagtctttggttgttagttatatactgtctacctgtgagatgcaaggtaagtgggtcacagactctcaaatttatgaaacacttagatttttcagggaagttacatgaaggaactagggagtttcatgattagataagacgttcgggtgggatctccaccggacagcactctaaatcatcagcagtgtgagcagtgattcaatttgggaaagtgagtataggtttaaattctggccacagacaacctctcctacacaattcactgaacctcccctggaaggaggtttccacatcctgcagaggctaactgggcaccaatcatgcttccactaaccgacttggctgcttcctctagcgcttagtacttcaccgttccctttcttcatgggagatggtgtggtaattgataatcacaatacaaactctgaaacaagtaaacggacaataaaactcatatttgcctaaaatgagtttcgataaggatctcggtggctatcttgttagatcttagaaagctgaggcttattgagaaagcccttttccttcgggaaaaggaatttttgtatggttgggaaaaggttggtcactggctgatctataaagtccttttcattgtaagattatatgattttcggtaaactgtatattttttaaaaacagtccagaatatccgcaagtgttttaccacgtgcttcttattgttggagaagctgagcaaacatcctgtcataaaaagacaaggatgttgcatcatccctggtccctgtagtgagtgtcctgaagataataagtaagaggttaccagaggctagccaacatggagtagccaggaaagagccagcacctgctctgagacaatggtctggttgccatcctgcccataacaacatcaattaaaaaattattaaaacctagttccacagtattattaggcactgtggaagaaacagggaaatatactgtggctcttgccctcaaggagctgacaatctggttggagagataggataaacacccaagaattagttaaccattgagtgttcacccatgtggtactgaaccaagtgaaacaggagttttaagataatttgtgtgtccaaaaaggtttatttaagaggcaggacttgaactaagctggactgagtgaggatgaattgggagaagaaagcacttctgtggggtgttggggacaagatgagaaaggagttgactcagataaatcagagcatatgacaggtgcactggagagaagaaaggcactgcattgtggtaggatggagaagagctgacttgaatgaagcaaaggggaacaaaaagaaataaagtggtcagcctgagcgggcaagatggaatcacatggcttccaaagccagaaaggaggctctgaaagccacacactggtgatctccagtggtgatacccaataacaatcagcatgaatctctcagacacattgtgtgtgaggcctgtaggctgattcaaatacagaggttgatggccacagcagcttggtgaggtccagctcaatttcaaactgcttggctcaccagcatgctaacaggcttaggacttgctgacatgtgcctcagatactctctggaggctgcagtacgtggaagcctagggctgctcttccaggcagctgttgtgagtgggatgtggttgggtgaacatctgtgtagacatgggtattgctaaaatcatggccttaagcatgatgaaattcaactggtgggtggtagaagaacaaagacaatcatagcctttaacaattcttaacgtttggattcttaaaatcaactttctaactttagttacaatttcagagtaatgttttaaattttctagtcaaattaataagcctttgtattatatgccatcctcctttggaatgatagcggtataattaaaatagaacatttttaacacagaatacttattggtgaagtggtctcttatgtagtcttcttttgacgagaacgttgagattttcgaactttcagaactttctttttttgatgttttttcccattcttttgctttttcttttggctgacctgtgagaagaaggggaaaaagggcaatgtttctgaatcttaccatttttacttccttttatttggactctcctgatcattgtctcatacccacatagtctcaaaaccacattaaagtcacttcactctcagaggggctcccttagattctctctactttgctcactttgaggaggaggcaacagccttcaaactggctgtcttttgtctattcttctggcttattacattctcctggcaaccttgcttaccactcacctgccccagctacaaccctctgaaggtggcactattatcatccacgttttacataggaggaggctgagttctggagagggtgactttcccaaatctagacagctagtatgtggcagaacctccagtctgtgagactccagaacccaatctcccacccacatattctgtggctctcttcaaatccaactccttagtatgccatgcaggattcctcccgctttgtcctgatctacttttctgcctcagtcccttcactctcttcacacaaactccagccacattaatggaggctccctgaacacagcaggttctctcatgattctactcttctgctcatgctgtccttaccttcctggcaaattatttatccttcaagacccaaatcaaatatcacctgacatgagaaatcttccttaacactttctcctgccccattcccccagcaaagttaagtactccctcctctatgtcgtcaagattcttgtgcatacttttatatttctcacattgtaccataattattagcatatgcactacaacaggaagggactataccttattatctttgtatcctgtgtctaccattcaattcattacatatttattgtattaaataaggacaagctctgtacccccaaggaacacacattcttccagtgggagacagagaggggatactatatgtaggaacctaattttgtcctaggaacaaaatagaagcaccataatatgaatgaaaaatgtattcttaaaagttatgtattcttatagtgttaatgaaaaagcagattctttgtcttctaaagttaatttctaaaagaaagaaaattttgatcttccttttcaccaacctgtttctcccactttttaatcagttccttcacatctgctgaatctgggtttagacatgtttgaactccattcttcagtgtagcactgccaaagaaatagcaatgagatagttttttctcattaataatttaaatgcttcttctcagaaataatgaaaatcagtatgaattgtgctgaattttctaatgaaactacttaaaattatttcctaggacaagatgagtcactggttgaatttttttttttttctttttttgagacagaatttcgctctgttgccaggctggagtacagtggtgcgatctcagcttgctgcaacttccaactcctggattcaagcgattctcctgcctcagcctcccgaatagctgggactacaggcatgcgccaccacgcccagctaatttttgtatttttagtagagacagggttttaccacattggccaggatggtctcaatctcttgacctcatgatctgcccacctcagcctcccaaagtgctgggattacaggtgtgagccactgcacccggccctggttaaattttaaaaattacttacagtagactgtctggaaataatttaaatgttcctttaatttttctgtatagtctgagaataagagtagtcaaggatgacttataaagacaaaatatgcacacatccttcaacctagcaatcctaatctctagaaaggaaagaattacagacacaatactgccacagtaagttttatttcagcagtaaaaatttggaaataatctatatttccaacaataatcctggtcatataaattatggtttatccatatgatgaaatacagtttggccattaaaaatgacattaagtaaaaatgacattattagagatttactgacacgagaaaatgttcatgatatagtgttaatgaaaaagcagattacaaaacagtgtatagtatatgatttaatttttgtgcttatatacgtgtatgtaaaaacatatctatgttatgtgcacacgaagcaagtaaggaagatttagaaaactgtatactaaggggttaacagtatttgtcactcaagggtagaattatgcgtgatttttattttcttctattgtgttacctgcattaaacattttgtacaataaacatgtgtcattcttggggcctaatctaccagaaattccttgcatttttaaggagaagaaaagaaaggagctgcccaaatttatggagggggtaaccatctgatttttaagtgtttgtatgggcaagcactccaagggtaaaactcatgctaaatttaatgttcttgccaatatggtgcatgcatgttagctgggttgttacttacatgatttcaattttctcgcaggaagggcttggggcaaattgtttaaggtctttcaaggattgtaggtggatagtcccttggttggtgctgatgcaggaacagcgaccctttctcactactggggttcctgagggaaagaaaaagatagaacacatcagtataggccaatgtttcagtttaggtgatctatcaaaatgatacacttgactgagtcatgattattgctatcatttaccgagtgcctaaaaataatcaccacaaacctttgaaggaggtatcatctctattttatacataaggaaactaaggttcagaaagattaagaacaaagtcatacagcttttagggagcaggggcagggttttagcccagatctctctgagtccaaaggcgttgctcttaactaccacaccgtaagtccgtgggagaaaaagagactttcacaatatttaataaatgcctatcacaagacaaacagataactaattcatgtatgctatgctgatcacagtttcttaagcaactcctaaaccatctattatttattatctgaccttaaggaatggaactggtgttggtgttgaatagaaagcactcctttgtaaccaatcaccactttcatcctcatcctctctcctccccactgccttgcttttcaatagtgttttaaatttttgaaaaccccttaaaatacattatcttaattcttaaattcatatatttacttggtacttattgtaccatatgccatacattgtgtagcagtcagaaaaggtataactacaaagttctattttacagatgatgaggaaactgaggtctagaaagattaagtaatttgtccaaggtaacaaagatagttagtaaatagattagggacaaattctctgattattggttggatccttaattggttagccacagatatacttagcaaaaaacagtatcagggagaagaaaataatttaggagatagagttctcattattacccagttcaatgaacatttattgaacacttactaggaattcatacacctagactacaaagacttgtgtttgacttggcagatcgaagttatgaactttggataactggtcatgtcactgagaagcttttatgactgaccaaatattactcttcaatgcaggcagaacattcacctttatctggctaatcaagattcttttacagtgaatcacttctcttactttacaacctaactcagaaccccttaccttgcactccaatcagaaccagcaagatgatgcccaagaggaaaagaacaccacttttcttcatagtgatagaatggagttccaagtcactcctgtattggat

SEQ ID NO: 1662 - DNA, 4149 bp, Homo sapiens
  source 1..4149: mol_type = genomic DNA
ttcctgtgatcattatttattgagcatttagtaggctccaggcaccaaggacatacagtgaataaaccgacagggccctgtctccaaggagggaaaacagactaggaaaaaactgcaactcatggaaagcatttggggagggactggtgagctcacatagcttgaggcagggctatgcctaggcaaggcctaacccagaagatgatgctcacctcagggtgaagctgagactccctggaggagcatttccttttacttgtggacaaagggatcttccttggccaggggtatgggcatgaacaggagtttctgtgcctcaagagactgttctagcaggagttaaagccccagggaacactgcccttcaacccagagaggtgccttcttaggaggtgctgcccccattctactgcaggaacagccaacaatgctgcacacacccttgactctgtcacaaccaagatacttccacagggacaagcacggaacagaagctttattaggaacatctgcctgcccaatggactggtggctgcacatggctttctagggatgctgatgctgcacgccagcctggaagctgcagaggggaagggctaagggctgcttgtctcgttccacttggggctcagcaggtggccagcacatgtgtctgcgatgttggtcatgggggtaaagggggttcttgtggcatagatctggcttccaaaccctctttctctttgttcatccaccacccccaaggggaacatgtgtttccagctcctcacaaggccagctggcaggttgatgttttggcagtgcctgcctcaatgtctccagcagacactgcaacacacctgagatgggaaaaccacccccctgagctcggatcagagcacacagagccaccagcttggtggctcaacgcttaacactcagagttgaggagatgctcctgtgagggtcaacgagagcatccagccctcatgaggacacagcttcagccctgttctctcatctaatgtcagattcggggctcagatgtggccatgctaattagccagttagtgggttaaagatgtgacgttcaacgggaatgatggtgcttcgtttccatggaggtgcaaaggccggtccttggaggtacctcaacagctcctcagaaggttggtgtggcccctgaagacaccagttcctaacttccccacatcctatagcgtccccccaaaacccagatagtgcctgtccagagccagatcaccttccacacacaacctcagggtgttggttattctttccttctgagaagagatattccttcatcgatggttttcagaggttggaagagacattgacagacgaagaagtgtaggaggtaacacgatgacgtgccaagaactccttgctgaccaggccatgcatagccaggatcttgaggaatccatggcgaaaattttggccgatgaaggcgtagatgatggggttgaggcagctatggagaaatcccagaatctcagtggcatccagggcccggccgatgttgttgcggcgctcacagctctcctggatcacctgggtcctcatgagggtgtctgccagcaggaccaggttgtagggcagccagcaaagcaggaagatgaggacgacagcaaagatgaccctcatggctcggtgcttctgccccatgtgggccttaaacagtgtacgcagggtgaatccatagcagaacagcatgacaaacagcggcacgatgaagccaaaggtgtgaggcaggatccgcaacaccatccgccattttgctgtgtcatttcccaggacctcatagcaaactggactggaattgtttggatggtaagcctggcggaaaaggaagaagggcagggacagattcatagacagtccccagcagccaagacaaacaaacttgaccaagtgacgcttctgggtcagtgtgcgtgtggcatggacaatggccaggtaacggtccacactgatgcaggccaacagcaggatgccactgtagaagttgacttccttcaggagtgagaccaccttgcacaggaatgtgccaaaaatccagccattcaccttggaggcggcccagatgggcaaggtcagggcaaagagtaggtcggccaaggccaggttcagcaggtagacatcagtgacggagcggccgaccctgctgtataagatgaccagcatcaccagggagtttcccagcaggctcagcaggaacactagggcataggcgatgatcacaacatacttgttgagtgtctcagtttctagcatacaggggctgtaatcttcatctgcaggtggcatgccagtgaaatttagatcatcaaaatcccacatctgtggatctgtaatatttgacatgtcctcttcagtttcagcaatggtttgatctaactggaaggttagaaggaaggaaatgtgatttagtagctcggattcaaggcattctcatcaatgatgtgagagcagttactgggatatccttggcttccctgttggtttggcaatgagagctctccttcctcctttgactccaacctggtcttcttcggaggttggcttcccagtgttctccaccttccacaactctaaggcctggcctgagtgtggggtaagatggaatatggggaaaacaccttagccctagctcaacctacaactgcctcctctcagcctatgtctctacctctgtccctctttagccttctccatcctcagctgtgtctgtgcatttggatgtggggaccaggttggtcttagacattcagggaagggccagcattaagcaaaatgcaagaaggcaaacctgttcccaggtgtccccttctactatttctattcctatgttctccctgattcttgtttaccctccttaaaatctactgggggaaggaagtgataacaacacattgcattaaactgtatattttaagccttctttaaatgaggagcacatattttgttcctctgtctaaaggagttttaagtatttgagaagataaagtctccatcttggtccctgaaaccctccacccctgaaaaaatccacagaatcattcaagagttttcaaatatatttcctattgtgaaatagtttactgaaataagatcttcccagaagcccagtatgtgaagcagataaaagctgagccactgtggggcagagtgtgctaatctccgaacccagatggcccctaaagagcccctcaaagctccaggactctccagagaagtctgaaagcctttggaaagtcaccgaggttggttgtaaagacacctagcatccagtcttcattccatcctgattctaccattaataagtttcgtgtgtaatcccagccctttgggaggccaaggcaggcagatcatgaagtcaggagttcgagaccagcctgaccaaaatgatgaaaccccgtctctactaaaaatacaaaaaaattagctgggtgtggtggcgtgcacctgtaatcccaactactcaggaggctgaggcaggagaatcacttgaacccgggaaatggaggttgcagtgagccgagatcgtgccacagtactacagcctaggcgacagagtgagactccatctcaaaataaataaataaataaataaataagtctcatgaccttgagtggggtctcgtacccctatagatttcagtcttctcatctgcaaatcgaggaagacagaatcatccacctctcatttgctgccaggcctgagggtgtatgatgagtccactcagatccacacattttagtgtgttccctccctaccagtatttgcattttcactgaagacaaagtcttaaggtgaagcaataaacatcaaattggggaatggtcagcctcttcccacaaaagggcaaggtataaaaagaggggatgaggaggctgtcctcttcacctgctaactccatgtatgagtggtggtcacaagagaggaagcgggcagcagaaatcctcagctcccacagaaatgaatacattttccaaaataaagtcaagccaagcagccctaccccacagaaagtcctagcaaacagaggtggcttcctacctgaagcaccggccaggtgtgtccaacagtaggagctgcagtcagagatcagagtgacttaacagctagagggcacttgatgaata

SEQ ID NO: 1663 - DNA, 1895 bp, Homo sapiens
  source 1..1895: mol_type = genomic DNA
taagtttaacatgtacttttattaacaacttaatacaagactgtacactgtaggtgctgaaatcaacccactcctgaaaactgaaaaaccagcatttctataccactttgggctttggttataagtgccatcttctacagcaaaatcacgtcttaagaacaggaaaaacgttccacgggaatggagagattatctatgcataaacagctggggatcatttctagctttacgtgattcactacacgctctggaatgttcagttcccttttctacagtcctaccacgagacatacagcaactaagaacttggccacaggtcctgcctagacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggttttaaatttggctccaaggaaagcatagaggatggggttcagacaacagtggaagaaagctagggcctcggtgatggaaatccacttgtgcacagtgttctcaaactcacacccttgcttgatgatttccaggaggatgaaggagtcgatgctgatcccaatgtagtaaggcagccaacaggcgaagaaagccaggatgaggatgactgtggtcttgagggccttgcgcttctggtggcccttggagtgtgacagcttggagatgataatgcaatagcaggacaggatgacaataccaggcaggataaggccaaccatgatgtgctgaaactggaacacaaccacccacaagtcattggggtagaagcggtcacagatatatctgtcatctgcctcactgacgttggcaaagatgaagtcgggaatagtcagcaggagggcagggatccagacgccaacatagaccaccttttcagccaacagcttccttggcctctgactgttggtggcgtggacgatggccaggtagcggtccagactgatgaaggccaggatgaggacactgctgtagaggttgactgtgtagatgacatggactgccttgcataggaagttcccaaagtaccagtttgccacggcatcaactgcccagaagggaagcgtgatgacaaagaggaggtcggccactgacaggtgcagcctgtacttgtccgtcatgcttctcagtttcttctggtaacccatgaccaggatgaccaatccattgcccacaatgccagttaagaagatgatggagtagatggtgggcaggaagattttattgaaattagcattttcttcacggaaacagggttccttcatggagtcatagtcccctgagcccatttcctcggtgtagttatctgaagtgtatatctgcaaaagaggcaaaggaatggacattcacttccaattcagcaagcattaacccagttaaaaaaaatttttaaagcaatttaaaaaaccaattcaggcttgctttcttcaggaaattctgaagtagtgggctaagggcacaagagaattaatgtagaatcctacaactctcctccccatcttttcccatagtgacttcattatatccttctttggtagaaccaattacaaaattctttgtttagaacaaaagggcactgagacgctgagggtttcaaagtcacatcttggctaactcctctgccccgcccactagagggaagaaaaaaaa

SEQ ID NO: 1664 - DNA, 3807 bp, Homo sapiens
  source 1..3807: mol_type = genomic DNA
taagtttaacatgtacttttattaacaacttaatacaagactgtacactgtaggtgctgaaatcaacccactcctgaaaactgaaaaaccagcatttctataccactttgggctttggttataagtgccatcttctacagcaaaatcacgtcttaagaacaggaaaaacgttccacgggaatggagagattatctatgcataaacagctggggatcatttctagctttacgtgattcactacacgctctggaatgttcagttcccttttctacagtcctaccacgagacatacagcaactaagaacttggccacaggtcctgcctagacacacatcaatatgaaacaaaaaaaatttatataaataagtcaattaaacttcacaaaaactaaagaaacacaagacaaaaatccaacaagcaataaaaactgtacaatattggtcagtcttttatatctgaaaaatgtgtaacttaaaaaaaagttatttatcgtataaaaaaaagtcttttacatctgtgttagctggagtgaaaacttgaagactcagactcagtggaaacagatgaatgtccacctcgctttcctttggagaggatcttgaggctggaccctctgctcacagaggtgagtgcgtgctgggcagaggttttaaatttggctccaaggaaagcatagaggatggggttcagacaacagtggaagaaagctagggcctcggtgatggaaatccacttgtgcacagtgttctcaaactcacacccttgcttgatgatttccaggaggatgaaggagtcgatgctgatcccaatgtagtaaggcagccaacaggcgaagaaagccaggatgaggatgactgtggtcttgagggccttgcgcttctggtggcccttggagtgtgacagcttggagatgataatgcaatagcaggacaggatgacaataccaggcaggataaggccaaccatgatgtgctgaaactggaacacaaccacccacaagtcattggggtagaagcggtcacagatatatctgtcatctgcctcactgacgttggcaaagatgaagtcgggaatagtcagcaggagggcagggatccagacgccaacatagaccaccttttcagccaacagcttccttggcctctgactgttggtggcgtggacgatggccaggtagcggtccagactgatgaaggccaggatgaggacactgctgtagaggttgactgtgtagatgacatggactgccttgcataggaagttcccaaagtaccagtttgccacggcatcaactgcccagaagggaagcgtgatgacaaagaggaggtcggccactgacaggtgcagcctgtacttgtccgtcatgcttctcagtttcttctggtaacccatgaccaggatgaccaatccattgcccacaatgccagttaagaagatgatggagtagatggtgggcaggaagattttattgaaattagcattttcttcacggaaacagggttccttcatggagtcatagtcccctgagcccatttcctcggtgtagttatctgaagtgtatatctgcaaaagaggcaaaggaatggacattcacttccaattcagcaagcattaacccagttaaaaaaaatttttaaagcaatttaaaaaaccaattcaggcttgctttcttcaggaaattctgaagtagtgggctaagggcacaagagaattaatgtagaatcctacaactctcctccccatcttttcccatagtgacttcattatatccttctttggtagaaccaattacaaaattctttgtttagaacaaaagggcactgagacgctgagggtttcaaagtcacatcttggctaactcctctgccccgcccactagagggaagaaaaaaaaccttccttaggaggaaaaaaaaaatacacacaaagaggccactcccaggcggcgtggggggtggggtgggtgctgctaggaggggcagtgattaactttttgtaagaagtttttcgcccagggagggaagaggggagaagggaggatcacggggggagggcgggggcgttgcaaagactcattctcctaaagcgcaaaaacttaattttcccacgcctgcctaaatacaaaccattctgggcttcaagcaacttgtagtgggtaaagagaatgcggtcttaaaacgaaggcccttcggtgcttggggtatattgggcgggagtgtcagaaaatgaacaaacggcacctcctcccccaagcgggcgctcctccggtgtgtgggtctcttgccatcctcgtgtttatcacttggcgcgtttgggacgttagggagcggggcattttcctgggtggagaaggtaacggggtctgcacccgtggtcctcgccccaagtttcatttcctcactctcccgggtggcttcccattaccccgccactgatccagttaacccggccggaggtgggcagctggaagcctccaggcggtgggcacgcggggggccgggtcgtccagccccgggccgccgcggctgcccactacacccacgccaaccgcccgcaagcagcgctgcaggggctccgctgggcgacacgccaggctctgtcccacagggtgctggggagcgactgggcggctccgccgcgagcgtctttgaattgcgcgccgctgcaggaaaccaaaaactccctagcaagagggtttcaaaaggtttctggaaaccaccgacggttaaacatcacaactggactcggagagagccaaacggtttccccacttgcacctgccagtcttcgcggcggcgacctggcagcccaggtgcggtcttaaccgcccccgcccctcaccccgtacccgctcctatccccggagcgcaaatctcagggctggcagctgcgcggtgtcaaaggggaggtcaaaccactccgctgacctctgcacgaccccaaactctcgaactgcaggacccactcgcggccgtggggaagaggcgcgcttcggacggcgggaaggttttccccctcaaacccaaagcgcgcgggcggatcaactcctagctgctgccaccactcgatcccctcagaggatcggcgcggtgggtccacccgcctctcccgccctctgcctactgtgctgggagactggcacagctccgtcggccgcacagagtttaacaaacacgcacccagtgtcaagaacagtcaccaggcgcttaaccccgaagttaaagcgggcgcaatctcctcctgggaactcagcccaggcacgccgccctccgcctctaaattcagacaatgtaactcgctccaagacatccccgcttccccaaggaagagaccggtggtctgagtcccgaggcagcgcgcacgccttctctgcacttgtgcacagaatgttcttacgtttgcaaacagcgtgcaagccgccgcgcgcggcgggactcaagggggagacacatgcagccactggaacgctctttccagtcgtttctcctcgactcacagagaaaaagattccaatcctgctccccccccacccacccgcactatataggcatggtcaagaaaactcctttcggtgacccttttttggagtacgggtacctccaatgtcctggccgcttctgcccgctcggagaggggctgcgctctaagttcaaacgtttgtacatttatgacaaagcaggttgaaactggacttacactgatcccctccatggtaaccgctggttctccagatgcggtggctactggagcactcaggccctcggcgtcactttgctacctgctgccgcagccaacaaactgaagtt

SEQ ID NO: 1665 - DNA, 6794 bp, Homo sapiens
  source 1..6794: mol_type = genomic DNA
gttcttcgtgaaagggatgacgggagctgtatgaaagcggaagagttatagaccgctaacacctgtcactggccactggtttcccggagttagcggcaacgaccttgcagcctggacactagccaggcgctccctcttctcacagcggcccacgtctccttgcttgggagcccatcgtcctggctccggtggcctcgctgggtctcggggaagcagaggactgttcattcctgtggcgaaaagccggagtcggccctagacacccacgactcgcagggtccatggttccggaggccgtgagacctgccggggctgacaggtgccagggcccatgctgcgggagcctgtgtgctcagccttcttgcggacggtacctgagggctggggtttccctggatgtggggctgggaactcgtgcggggcgcgaccgaggcgccttttcctgtcccctgctgtcggcagggtctcggctccgctccttctaagcgcgtgtacccgcgacgtgcgtctgcgagtagaaagcccgtgtactgctccacacacagcggccccacctcagtccggtcttccctgcctcccgttggcccttctgctgtgagctcgcctggacctgaggccgggcggtgcacagctctgtggcctgtggcgccgtgctcagcgtgacctacccagaattaagctgaggacaatgggatttagagtcccaaacactcgccccgtgacaatgggaggggaagtgtcatttttctcccttcgaatggagcatgcttggctgcaagaatgctgctcaacatggtgaaatgattttctgccctgcgggctggtgcaccctgtggtccttgacccagacaggtgcggagggtcccactgctgtgattagcagaaccaaactgtgatgtgcacatgtgtgttactgataagaccaggcctcccagctcttcttggtttccaatgcctgctaagtacatgaccttcttagggccattaaccagctttgctgtcttgcacttaatgacctttcctctttatcttccttgttgtgcaggtaaagaagctaagtggaagagtgtttcctcctctggccgtaaagcaggtactctctgcagcaccaggtaggaggggactcaacccccttcttgccttttcagttacatcagttcctactagggattccacatacacacagttggcgtctgttgtgattttgtggtgatgacgagaaaagggttggctaagaaactgggcggcagaaaagaggcaaacattcactgtagccatttatcccgatggaagtggccaggccctgtgggggacattcagcctccatcagaagtaatccagaaccaaggaacctggttatctttggtcactcatcagaagaataatcatgctcaggggccacaagtgtgtgaggaaatggcaccatggatgggttggtggagggtacacgggtgagtctttgtggaaagtcatttgctggcagatatcagcatcttagatgggcgtgccaggcggccgaggcatttccttcagcatgtcttcacacagcgagtgttagaggtaatgtcatttctagtggcaaaagtgggaagcaacttgtaactctccatcagtggaggaatggtcaggcaaattatgagacgaccaacaatgggatatcacccaggcagtgaaaaacaaggtagatgaagattgtcaggtggaaagaatgggcttgatgtgctgtcaaatggcaaactcgtgccctagcctgtgcagatgtgttgggaacagcagtttgccaagatggctgaaacaaaggaccataaaagggctggcttaaagaacagacaatcattgtctcgcagttctggaggatggaagtctgaaatcaaagtggtggccaggttcgtttgttctgtgggctgtgaaagacaatctggtctgtccctttctcttagctgcaggcggctggccggcaatctttggcactcattagcttgtagaagcatctcccttatctctgcgtttatcttctcatggtgttctccctgtgtgcgtgactgtctctcaaatcccccttttcataaggacgccagccacattggatgcgggtccgccctgatggcttcagtctcacttgattgcctctgtaatgactctgtttttatatataaggccacattttgaggtgctggggtttaggacttcaacatacgcattttaagaggacacaatgcaacccatcacaactgacaaaggctctgaggtagaaacaagcttggcatgttccctcaggggatggaaggcctgtgtggcttcagggtggtgaataaaggggagaggagaggacgtggctggggtgggaaaccagatcaggagggaccttgagtgccctgagaggaagtgtggattctgtgctagttggggcagggagcccttgaaaagtttcagtagaggagtgacataatctcattgtccctgtaccaagatcattccgatggcagtgtggtcacaagagtgcagaggacaagtgctgggggggggtgggggtgctatcaggagacttcttcagaaggcagggggttttaggggattggattgggattgtggccatagagattatggaaagggatcagattcaatgtcggttttggacacagtgccacgggatgtgggccgcagatgtgggaaagaaaggcagggcagagagcagctaggtctggggcaggaacgctgtagctggtgatgccactcacagaggtggaagggaggtggacttggtggtgatggttggggtcctgagtatgtacgggcctgtccacctaaggctgagtctgaaggggggtggcctgcaccacgggattcagagcaggacggtgagcaacgtgggggtcccagaaggagggaaggagtgttcccagccatgctggggctgctgagcatggactaagatgaagacaggactggcatgaggccggccatgggtgcttgtggggataggtcagtcagtggagtgggtggtggggggggtggggaataaagggagaaaggtgggggtgggggcagaaggttcagagaggaagtagagactgcgcatgtagacagctcttctgaggtctcggctgttcagggttgtagagaagggaggcagagtgggaggcgcgcgtgtgctcagagtagggatgctgagcgagcatagatggtggctggtggcacccagggcccggagtgagccagaggagcagggtccagagcacagcaggcaaccggctcagctgaggcagctcaccccagaggcgggagaaaagcaggagatctggagctcagaaggctgcagtgcagactgggaaaggagtgaataccaggcagctttggccctatcagggctttgtctcatgagggtgggtatattttcttaaaatcatagagcgtactagaggttgcgtttatgtgttgaaaggaaggacagagagaggagtaggggcagctcaagggtggagttcagggccgggggcggggccacgggcctgaggggtgagggcagccactatttctgactgttctattaggtgccacgtactgggctgggtgctcttggtgccttatctcccttcctcacagccatgtggaaactgaggcatctcaagagtctatgactgggctgaggttctggtttcgagcccagggttccttccaaggcacagggccgtcctccatgcaagaggaggggaccctctcccaagccagacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatccgaggatcatgccatcccagaggctggcacgtggaaggcatgtgtgtggggttgctagttgttctgattatcattcttcttttctcagctcagattgggacaggggcatctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagggtgggactctccctctgtgctggaagagggctaacaccagcccggactctccactctggctaggccaagggggccctctgtcctctgtgttgccctagggctcggtgacctctgtcatagcactgaccacatggtatcctgcctgtgccttcctctagctgtccccgccctactccggaccgccccaaagactccatgggatggacctgagtcagccgaatcccagccccttcccttgggcctgctgtggtgctggacatcagtgacagacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccacgagttctggtaaatcatttctccactctgggcctcagttcctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgccctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtgg

SEQ ID NO: 1666 - DNA, 6794 bp, Homo sapiens; identical to SEQ ID NO: 1665
  source 1..6794: mol_type = genomic DNA

SEQ ID NO: 1667 - DNA, 6794 bp, Homo sapiens; identical to SEQ ID NO: 1665
  source 1..6794: mol_type = genomic DNA

SEQ ID NO: 1668 - DNA, 6022 bp, Homo sapiens
  source 1..6022: mol_type = genomic DNA
attaggtgccacgtactgggctgggtgctcttggtgccttatctcccttcctcacagccatgtggaaactgaggcatctcaagagtctatgactgggctgaggttctggtttcgagcccagggttccttccaaggcacagggccgtcctccatgcaagaggaggggaccctctcccaagccagacacgcaggaggctgggcaagagttgtgggaagtcagagcccgtgtgactgtgggctggtgcctcattctcctcagccatagagtgggcctcacagtaccactgaccctgctgggttacttgaagattcaatttgatgatccgaggatcatgccatcccagaggctggcacgtggaaggcatgtgtgtggggttgctagttgttctgattatcattcttcttttctcagctcagattgggacaggggcatctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagtaggagctgggaaggtcagtgccttggtggcggcagggccagggcactgagagtattggcagggcacagcaggggaaagggaagagaagcagagggtgggactctccctctgtgctggaagagggctaacaccagcccggactctccactctggctaggccaagggggccctctgtcctctgtgttgccctagggctcggtgacctctgtcatagcactgaccacatggtatcctgcctgtgccttcctctagctgtccccgccctactccggaccgccccaaagactccatgggatggacctgagtcagccgaatcccagccccttcccttgggcctgctgtggtgctggacatcagtgacagacggaagcaggagaccatcaaggtcagtgcgatttaggccacctgagagacacggggggaaggtcaggccactgcccatgagcttggagggctggcgtgtgatgcgcttctgtgcttccgcaggctacgggaggcccggggcgcttgcgaagatgaagtttggctgcctctccttccggcagccttatgctggctttgtcttaaatggaatcaagactgtggagacgcgctggcgtcccctgctgagcagccagcggaactgtaccatcgccgtccacattgctcacagggactgggaaggcgatgcctggcgggagctgctggtggagagactcgggatgactcctgctcagattcaggccttgctcaggaaaggggaaaagtttggtcgaggagtgatagcgggtaagtgacaatgtaccaaatgcgcagacaacgcctagggctgctgcccaagatcttgcttgggaatttgggggcttctcttgtcatctgaactgattggcgtgtataacacagtttcctttggcaacacaccttcaaaggggcggcaaggaccttgggctgggggttggtatggctggcttccacgagttctggtaaatcatttctccactctgggcctcagttcctgtttctgatctcagtgagaagcctggtcagggccatgtgcacatggtgtttgtggtgtttggctgtgtgtatttgcacatacatgtgtgagtgcacatgtgtggcagagaccatgaaaagcagcccagcccgccgaatgggtcaggtggcctctagagttgggctgcccgcctggcttcatgaacctgccccagccccaccactcacagcaccctgggaaagtcccctaacctctaggtgactgaggcccgacatcagcatctgtcccctggtgacctgctcaggcatcacctgtagcttcccaggcagtggctggtgcccttccaatctgcaaccgctgccctcagaagtctggcttggacctgcctcttacttgtgtggcttcatgaggacaaggccctctcctctgcctttctggagccctccccctgcctctcccagcgtttcctgaatcgggtttggttcgttatcaaagctacggaagaaggacttgactcccttcttgtcattttgctgatgctgtcttactctctattgattgtgactttgagtaactgtgttgtcacatgggcaggccttgggctatggaagtgaaaggcattcatgtgtatctctctttgtgtacaggactcgttgacattggggaaactttgcaatgccccgaagacttaactcccgatgaggttgtggaactagaaaatcaagctgtactgaccaacctgaagcagaagtacctgactgtgatttcaaaccccaggtggttactggagcccatacctaggaaaggaggcaaggatgtattccaggtagacatcccagagcacctgatccctttggggcatgaagtgtgacaagtgtgggctcctgaaaggaatgttccagagaaaccagctaaatcatgacaccttcaatttgccatcatgacgcagacctgtatacattaggttaaatctgaatttccactgctttggagagtcccacccactaagcactgtgcatgtaaacaggttcctttgctcagatgaaggaagtagggggtggggctttccttgtgtgatgcctccttaggcacacaggcaatgtctcaagtactttgaccttagggtagaaggcaaagctgccagtaaatgtctcagcattgctgctaattttggtcctgctagtttctggattgtacaaataaatgtgttgtagatgactggttagtgtttgaggctttgttctatgttttcccctgatttgttctggtcaaaactcatcaaatgtgtaactagcatccaggcgacaatacagaaagtctgggacctggcactgaatgtttgcctggtagtgactagccgttaatcaaccgactcatccaggatgaagaggacgtcagacttagagcagctgtctgtcctttcaggttactctcactcttctgaaagtgtctgtcagtttctgaagcatgtgtgttacctgcatcacacagctacttcctatcctagcaatacatccaaaatacagctctagtagagtgaggttaacttggaaatgtgatcagtagtgttgttttattttgtagtaatttttttttttttttggtgatttagcaaagtttctagttgttatccatgaggatgatgggcatttccccccaggtattgactgcagtggcccttctcttctgagccaggatgttatggtggttgtacatcccatggcagatggggtggcctgactttcaagtgggcctctttggaggcccctggatgctaggctagggatgctgagctgctgaccagacacttcctggcaacattgggagggacccatgaggaaacaatctcctgtttgaagatacaggaagatattgccggaatcaggcgtctattctttctcctgaccagcaggccaatctcaggggaccaggtcttcctgggcttggcctcgacacttcctagcaacatcctttgctgagtgtgtgaaaatgctgcttctccaaataaacaaggacaatggggaccaaagcctgtcttggacaggatttccagcctcccctggtttctgccaatgagatgtatataatatacaaggttaaaaaaaacacagacaacagttctcatttaaattgtttattatttatttccatggaattttgtttttctttattaagaccaaaaatgtgtttctcattaaaaaatggcaacttttatgggccattagtggcctgtgacttcacgaatttgcagtgtttctgaactgttcacagagtctacacttgtaatctgaggagccttcctactcctcctcatcgtcagagggctcatttggagacatgactgagagggaggccaacagagcatagtaacagatattgtacaaagacattacactaccattatctgagtaaaccagactactaagaatccctgtgccttccatccaggtagtagccgaagatgtaaatgtgacattcccagaggtgccctcccaacttgggccatttggttcctgagggggcccatttcccaggggatgcctagtggcactcttcttggaccacatgccagagcgcctgaaggactgggtgccactgggcccctgaacactgggggctccctgctgacacattttgattgcttctttcctggcattgatgtgatagatacgtagggagcgtcttgtagctaccagattctttctctttggagttgggacacgggtcgcttgctgagcggtgtttctgagggcatcctttctctggatattctccaggagcctgggcttgtctctctgaaaattggagttgcagtagatctgaaacaaaatgaaacatgttagttgttctgggataaattattcctttcccacctctcaaaattatgattttgttttgcaatggagaaaagaatgctttaagtggcagcaagtgtggttatgctctacagcatgacctgactaaagataaacaattcatagatcaaggcagtaatatataaacagcatggattttgatattaaactgcaaccccgtagaggtaatatgcaggtctgcaaaatatgatgcttacattatctctaagggggttgtagtttaatatcaaaatccatactttttaagttctatacttttcatctttcaataaacaatatttcacattttcaaatgctatccttgacacttaagctcttacagtatattattcaaattggtgtcctatgaagatatgtttgagaaagagagaaaagggattacagaaatgctttctactttaccatcattttcttgtttcctggagagttgcttgggcgtgttttgcagaatccatagaggttcagctggcgaatgaaactcgtcaagctgtctgttttgaagatcctctctgcacctttccgttgaagaacctccctctggaagagatccttgtcgatgatcacggcgtctccatcatcgttccagctcacagacttgaatgtgtcttcctccacaatcgtccaaagctttcttgggaaggagagcctaaaaaggttgtggttgtcttccacgttgaccacgcgttggtttcggtcttctggtggtgagttatcttgggagcctggatcttggctcatggcttggtcctcgtgcctgtccaaaacctcgctggaatctggatttggatcaggtgaagaaccagatgggcccccgcttgttggctctccaccaacagatggggccagcttggcttcatattcctgttcagtgttctgactcgccatggagctacaccagaatcaggagcattttgtacccaaggcccttatcactgtcctagcaagtccaaaatgccttcagtcagagtaggcgtgcccaataaatactgtccacaaaattctagagtctcggtatcagggcaaccagtggcttaactcatcatctgctgtatttgtcacatgatgtcacaaaggtggctctcagccaatctggagagggggccctggccaggtgttgggggagtagacaggtggcatggccttcagcttctccctcttctaaaagtataaacaggcatggttcaagttcccagaaaagtctcccatcttctgacagtcacattgtgtcaaagggccaggccccagatgagctgagaaaccatggctctatggccactcccaaccctgaagacaggggaggccatttgctggcctctaatttgctcaagagccagcccctagttatccctagcttgggtttcaccaagactgcctgactcagatggacccctcatgggtgactgccttctaggagatggtggtccctaccaggctgtttggcctgatctgtgtggtagcacccctcttttccaatccccccatctcctttctgctttggtctcttccaggtactcctaatgattggttgcatgtgctccagtgggcccagataaagtgtttcttattccccttgg

SEQ ID NO: 1669 - DNA, 33445 bp, Homo sapiens
  source 1..33445: mol_type = genomic DNA
attggaagaagaagcatagtatagaagaaaggcaaacacaacacattcaacctctgccaccatggggaactgggctgtgaatgaggggctctccatttttgtcattgtaagtaccaacaagagataagttataaattctctgacttctcggggttatcttggaactaaaatagaccaaagcttttttgttcatttgaggaattgtgttgaaactgatttaccatgtgaacctatatctatctgtaaacagactgagtccattcttccaaattccttaatggaaagaacatatctgggggctcacttctagcttacttctgaattcctaggaggaataaattagccagcatttcgcagaaggagtagaaaatatttcatgctaatgatctctgattctgagttgtttagtaatgtttactcagacgcacatgtctatgtgtttatactactttaaaaatgacaaattgaaattttataccattttctaaataaaaaatataagattgactcatgtatgggaagtaggcctttatttcagtaattacactaaatataataaaacttctcaaatttattttcaaaaacaagtaccttcttttttcagagatctaaacttgagttatttataagatttataaaaattcaaaagaacagaattgaaataagtcatctagattcataaatatgtagtatgtatatttatatataattgtatatatatataaatcaatatagtctggagaaactatgtaagtaaagatatagctaatttacaagtggacagaatgatttctgtactttttaaaacaaagaaaatcaactgttctcttaaaatggtgttatcagcaaagcaataatggacaaattgggtagatagaaatacgatttttaaatagcctttctaaataaccaatagaagcattacacagatgttaaaaagtacaattatgaatggaatatgaatggagcttttgtaaaaatttatcatgaaaaataatgagtctttgagttttaaatatagaaagcaattagtggcacaaataaaaacaacaaatattttgttataaaaaatgtttacgccaaaccaacattctactgcaacagagaattcttccgagtattcgaagctgtaaacttaacttcttatcaccatttttaagggcaaataatttctatagaaagtaagttcaaattaaacttttagctctcgccacaatttttcccaggaaatgacctccttctaaattatatactcatgcacttgaaagtgaaaacacagcttggaaagtcagagtaaagaaagaatgacaagatcaggaaattgggaagttgctttagcacttttttctttgtaaagagagaatattatcaagtgtctagagcatataatagcttcaaagcatagttgagaaaagatcactatggagctgaaggtagagaactgggtagtgtgaccacttgatccagtcagtgcttaggataaaatgaactgtcatgatctagaaagctgtttttgttgtaaatcccaagcccctcactatgctcaatattctctccttgaagcattaagtaaaactaatcaaggaaaatggaaggcttggcattttagctgatgagaattcactagctggattactgtgtggtagagggaggtgattagcacctgtgagaacagaacgcagtgtcatactggtggagggaaagcaatagtaatatgttcccttcctttctcattttaagtggagtggcctgctatcagctacctatccaaggttaagcaaaagagaggggaaaaaaagggagtggggtaatgtaagactgataatttggtatactggccaaatcataaaacaatcatggggaacaacacagggtggagaggttttaattatagacaagtgtagtgacactgttgaggaaagagctggctctaagctggttatatccagctttgtcactacctttgtcaaagttggacttggggaagtcctgacccttatctgactccagtcttgtgtggaatctactgtggaaatgcggaaacttcatgcaattatttctgtttgtgcagctggtttggctggggttgaacgtcttcctctttgtctggtattaccgggtttatgatattccacctaagttcttttacacaagaaaacttcttggggtaagtataaattccatcccatgcaatattggctggttcacatttctcatcagacattcttgttcatcttcctgttagcattttaaatacatattctgaccaacccaaacagtaccattagcctcactccctccattgcaacttcctgggcaacagtcacttaaagccttccagtctgggaccaacaaaagtggggcagagggccccagtggcatccttccccaaccaagaaccatgtgccattgtttagcttaaaggagaaatctaatactcactctgaaatggaagggcaggttggagcaatccatccaggagtgacacatgtgggacaagtgggactttccatattttctaagtcacctaattcctagtacttttttgcatgaagagctctgctcctaatcacatgttatgaaatgatcttcagaaaataaatctctctctacatataaagactcgaggaacttgctcaagggccacatctgttgactaggacagtagagtgaaggcccttcagtttccttgggtcctttagtattctgagtttccttgaactgtcaggcctcttgcctccagaagacatctgttacatcatgctgaaactatgaattaattgcttaatattaattattataagtattataaatcataaataaataattttagcatataattatgctagatcattataattgttgttagcttattcacattgatgctttctcccgccaaaatatgcaacttctttagacattacaaatataataattataatgccaaagcattataccataccaatttaagatactgttaagatcaatttaagtgctaagaaaatatttaaaatctttaaaagtcttgatacttaactctagttaatgatatgcaccttaagtgttaaagagaaagtgaactgttgtctgtaacttactttgaaatgcatcaaaaattagatgagttgatggatggatacaggaatggatagatagaatgtgataaagcaagcataaaaggtataatctgggagatgaataaacaggtatttattgtaaatttccttcaacttgtctttatgtttgaacattttaataataaaatgttgaattagggcaaaaggtcaatttcagatgaaaacaaagggtcctagctagccctaaaggaaaaccgttggctctgaaggaccttcctgtacagatcacttggtgtctctggtgtgtggcctcatgctaagaaccttggggaagtggggacagggcatattctgtgctcaaaaaagtcactctgctccctttcccgcctcttctagtcagcactggcactggccagggcccctgcagcctgcctgaatttcaactgcatgctgattctcttgccagtctgtcgaaatctgctgtccttcctcaggggttccagtgcggtaagagaaaatgttttactaagttcctctaattttcaaaggccatcaagcaaaatgcccttttttaggtaaaaacaaatgaatgatttgggaggattccagcttctgtagaatactcatgagccaagccattatctagtatatttctgtgctatttggggatggagctccctaagacaactatttggaaaacaaattttgaaaaaacacacaaaaccacctatacctcaacagtagcaatgaagtagcacacacgtacacgtttacacacacacacatatatatatgatagatatgcatatatacagagctttaggaagttgacatgtgatatctgggagttaatctttcagtgtcattcaaaaaaatttaagtcagaggaaatatcttctgtggataatatctcaaggagatggagtcaatggacagagtcacactataatgaatgtaaccaagaagtgttggcttcatggaactggggagcatagagctttctaaatgtccagaattcctttgactctcactccaacaatttagtaagccactaaatgtactgtgctagaagggggaaaaaataagtaggaagaatctctgtaacccataaaatggtatacaaatttcttactagtattattgtacaaagatgacaaacaaggaacttaaaatctacaagtgtactcaaataaatattatacaaagcaaaatatgatgggttccacaaagctttacaaataaaatactatggggaagcaagagagaagttgtgtcaggtggggcagagaatgaagaagggcattttagagaaggtgacattagagatgagtatataaaaataagcttctaagaggtgtaaaggagagagaaaggcattctatgtggagaagatggcatggacagaagcacaggaaatagtgaggaaatcgtattcttgaaggccaagaattggcatagccttggcttctctttgtattattattataaatatttttttgccacctgtgaccacaccaaagagggtagctgggaaaaaagtagggattggtgtcctggtgggaccaattccgtggttcattaatgactagtagcttctaggttttttttaaaaaataaaaggtatagtaagctttttgaaaaaaatacttattaagtagagatcacttatggaggacagcagaaagcaaactacttttgtgggaatgtagggattgtacagggcagatgcctgacataaggctggagaaaagaggtaggattttactggtaaactagaactgcatatgtatagttgaggagttcatgcttaatttggcaattacagaatatttgaaggaggcagtgaactaaactgtaataacaagcataacttgccttgaactctgcctcatttttcctagttacactaaattcatgctgatccagagaatttttttctttaagaacatataacattcaatttactaatataggactagaggctataatttagcttttattttatgacttaactatttacaaaataccatttcatcttaaaccaactgccaaaattgggctctcacaaatctaaagtacaagttggcagaaataactgttacaccttcgcttcctcagaaaaagaagaatgttgataaccaatttaagatgttccagaaagagtcgtgatatcttcctctgaaaaattctgtgatgaggttcctttccttaagccataaattctatgctacgcaatgttgtcttgcaaactgagagctaaccaaaaccaaaaactaacaacagtacttggtattaaacattgattacaaggatttccaaaaaatcttccaaatttaagaaatcacagaggtaaaattacactcaattgaaagttttattaatgagccacctattgtaaagtataacgtttaatatatcgtaagtgcccagtgaacatttgctaaatgaagcccatgcactatagcttatttttgagttgggttctctatcacccaggctggagtgcagtggtacgatcatagctcactgcagcctggaactcctgggctcaagtgatcatccctccttgacttccatacatgtggggattacaggcatgagtcacctgcctggcgagttccttgtttctaaggagacacaattcatttttattctccctacccccattagaatagtttctatttagaggaagtaaagcctgagaaacaggcaatgttttcaccaagatggcctgttaagaaatcttggttagtctacaagtccaaatttcactgccggtgagcaccatgtcccatgagcagcacatgttgtaatgccagcttttatgcctcctgtgacccaggagggaagatctgcatgagagtctctaaagacagggatgaaatgagactgcccttcaaatcgcagagaagcttggctgtataactacatagatctttatataaaagaatatgttttaaaactatcagcaagcaacattcttttatagatcaagcatgtactttcttctgggattcctaacctgaaatgtgaacttttctaataaaacttcttctgtgattgtgattaaaatgagtgagtgtgctgtaactaatgttggaaatcatatagctgccactcattgaagcttaatggaattcaccgcatgaaatctgcacatcaaaccagtaaagtgggaacaaaattaaatggaagtgttggcattcaaacccaggtcattgtgtccccagagcccattcactttaaatcatgctgccaaaacttcttgaaattgtgctgttgcagtattatgatcctagaaagccattatatatatgagtgtttgagcatgccaagtaacctagactagaaatgacaaggatgttataaatacaaggacttaatagtaggacactatataagcaaaataaccacgaacttgcattcagtttctagaggtctcaatcattgaaactttgctttgtaatccttctggttacctagagaaagaaagccccagggttgcccaccccaccactccaggaaaggtaggggtaaaggctctcagactgctttgttgagaaaaatggagaatgggtgaagctcagcacacaaaaatctctgaggaagccttaaaaacccccaacttgccatgcagaaactaatttctgtctggatggcagtcctagtcttaagatcagaaagaaacaggaaggtgagagggtgaggttttatctgttaccttatatagtctgggagtcagaggcactcagtgtgcctctatctttaatcacgtggtctagcactagtctcttgggctttctgtctcatagtttttttttttagttgaaaaacaggtcaactaacacaaatgtaagaaggcatatgttggtctaaaagtatattaattgtttaagtctgtcaattagtgagttgtcagtcaataaatatttgttgagtgccatttatgtgctaagcactggggacatgtggtaagtaaagattaagttatagataggccatgagcttaaggagcttagagtgttaacaggagagacagagaataaatatggaacttccaaattataaacagtgctatgcaaataaggtagtgttattcatatttatcagatattctactgccagcaggtgtggatattactgtcaacttacttgcctgagttctgtagattcaaagttggattttgtaatttctcccagttgcgtataaatatctaaatcagatacattgatggtgcgtgtggtgagatcaagtgtacaaaaagtagagcttttgagtttctgtaaagtgttacaccccataaaatatgtacttctttttagttccacttcccattttcttgaaatatttttttcttactcagtttcaatagagcatagaaatctgctgaagtgactcaataatctcccttgcattagaatggtagtttattgaaatcgggcaaggcttccggtgacagtaacagagaaacttccctttagaagtcaatggcagaaagtaaagtaagttagtaaggaagctatggggcatgatggcaacgtggataattgggaagtggctggcaataatttagaagtaactcaaagcatataaatgcaatctgcctgatgatggggaacaaaaaattatgggcagtcacagacagtaaagtccttccttcctatgccaccaaccggttgtctcgcctccttttttaaggaagtggtgaggagatggtattcttaaaagcccagtatcagcatgacttgtggcttctttttggatttgtttgccattcctgtccacaccaaagagggtaggtgggaaaaattagggatttgtgccctgatggttggacccactccactgatccattagttactagtaatctcactttttcctttcaatataatatatgtgttttacattaactagctttttaaaaattacctattaagatgaaacagagtatcattgaatggacaatgtatttcccaatcacatctctccactgttctggctttcagttaatttttctctaaggatctacagttaaagctatcagggggcatcaacatatattattttacattttttatgatccatggtgattatgatgataaggataggactatgaagacagtgtatgttccacaacaaaaccatattcgtttgctttaaattcggcgtgcaggagccagtgaattttccccaaaaaatttcaaaaggatttgtcaacaaatagaaaagaacagtgtgtggcaagtatagacatgggggtaaattcatctctataggtttagtatgatcatctccagttccagggcatgaaaatgtacttcatttatgcagccaaataatgattaaaagatttttttaagtacatgacatactgtttttcacacaggaagcttacctgctagctggggagtgcagccttactaactgaaaacttaaataatgatactaaataacatcaaatattgattaaatacctgtcaatgaatatatgcaatagggatttgagggactaactatgataattatacaggtgaggaaactggagactgagtatgttgttcgatgtcacacggctaggtgggaggactgggacccaacataggtatatctgaagacaaaacttgctctgaaatgtgtaattcagtactgctttccaaccctactaattctcattctctgattctttggactccaacctagtttcaccactcctgtaaggactgtatcaatcatctatcgtgtaacaaattaccacaataacttaaaacaacccctgtttattagtttacagttctgtaggtcacaagtccagcacccagttgctgggttctctgctcagagtatcataagactgaaatcaaggtgttttctgggctgaattcccacctggaaactctaagtaaaaaccctcttccaagctcattcttgttggcagaattcagttcattacagatgtagcactagaggtccctgtttccttgctggtgatcatctagggtccactcaaatcctagatgttcctgcattccctgccacatgccctcctccaccttccaaccagcagcagtgcttcaaatctctgacttcctccatctctgacttctaaacccagatttaaagagttcatgtgattgggtttgttggcccagataatctccctattaaagtcaacttgggactttacctctgcaaaatcccttttgccatataatgtaacaaaatcacagagtgatgtctcatcattttcacaggtccaaactcaaggggaggagattatataagtcattgggggtcattctagaattctgtctaccacaaggactctcagaaactatagaggaaattaagttgaaatttaagaagccaaagaaagaaagaaggaaagaaagaaagaaagagaaagaaagaaaggaagaaagaaagaaagaaaataaataaataaataaataaataaactataaaggaacatggcaattgggaaacaggaaaaagttatttcctcaaaattttaaggaatacaaagtagaaaataattttcagcacttgtaatgaacacaaaagacaaggaggctatataagaaaacaaagatggtcaacttttcaacaacagatcagtaaaatgtattttacaaataaatttttatttcaaaaacattaagtttgaaaatttgtattttacaagtttttatttcaaataggaaaccattgttttgagagtctgagtcattgctcagctccactggtgaacatttaattataaccaatgcattggtgctccaccatattccctaagcactggcacttccaatccatgcgacaactgccctttgcaagcatcattcactctctgcctggggattttctttcagctttctcctggggcaagcctgaaatcccaggggattgatgtcctgagagcatccctcagagcagccctcagccaatcatggatggcagttggtggttgaacacccaagcttcttaacccgttaggtaaaaaccaaagaacgaaacaaacaaagtaaatgaataaaaaaccctttgggataagttctacacagtctcccagagttccctggtgtgatcgagcccaatgatatgatatgatcatggtagctgatataataatgcactcttcattaatttccttcccagtctcatttttaccctcgttttctatgaccaccttccggatagaatacttacacttaaattcttgtcacaggtttctaggcacttagaataatagtgactatattcctgcatttggtttggtagaaaagggcattaaccttttatagacaaatagacttggatcccagccaatgtgcaattttagctttagttttcttacctgtaaaatgaggacattaagatttaccttgttgcattaaatgagtaatgattatgggtaaactacctagttcacagaaggaattcaataaagcataatttttttatttttcctttttctggaatcctcagtgtcttccttgctactatttctgtaatttcaagaacctgacctcatggtttaaacttcctgccctccctagttatggctaactgagagatagatggtggagtaagcacaattttctgtgcaattatattttctacaaaatcagagtattttattaaaaataagtaagccaaatattaaacacccctatatttaaattgaataaaacatttagaaccaaatattttaagtacataaattttctttggtacttcactctcttgttcttaaagttccctgaatctctgtgacagtgcatttagactatggaacaaagcaaccagagcaagacattggccagttttcaggagagccaagctctaattcaaccataaatcagtttaaatcagtttttttctttctttgagcattggcacgaattgagattcaaactcacattttctaacatatgtaggttcgtcaaatacactaaaatactgagtacaatagtatttttaatgccaaaggaaatcatgtaaagtatgaaatatcagaatgtttatataaactctagtatcagatggcctgagtttaaatcccagctctgcaacttattagctgtgtgacctaaggctaggtaaactctctatccctttgttttctcatctgttatgtagtaataataatggtacctcccttgtaccattattgtaagaattaaagagttaatttgattattacattaaagattaaattaaattaaatattacatcaattacattaaagattaatgtaagaattaaattagtcaatgcatgtaaaacagttgcagaagctcttggtaaatgttagctattgttattttggctattagcatttggtcaatgatctcccctgtgatgttgttcacctacatgggcaggtgtacccttctttctcctctcatagtgtgtatgtcctagaacagtgttgtttgaaaactattcacttgttctagaactgttcacttgtctgtgtccccacttgactatgaggtatgtgatgttaatttctacatcctttgtttaatgagtaaattaatcagaactagaaactatgtagctagatatgttttttgtacaagtttatatttttatacagttaagcaatggattccagaggagactttatgtcaccagtatgagaacagaaaacataccagttaagccagccatgtcacttactggctgtttgacctgaggaagatgactgcatctctctgaacctcagtttcctcatttatcaaatagatataatgatacagtttgcagggtggtcatgaaaattaaatgagataatatgtatcaaatgtttgacacatagcaagctttcctgttaacaattactattccattctttcccccttaatccaaagtgctgctcaacaagagttcgaagacaactggacaggaatctcacctttcataaaatggtggcatggatgattgcacttcactctggtaagtttattaaagaaaacttggaaccagggagttccctctattcatagatacctttttatataggagatcaaccagttttatagttagattaagtggtggttggatatgttgtatttttttaatgagttttgctcaaaagtatttaccacactttctgccacttcaatattaggatttattcctttaggttttaaagcatttttatttcaggattttcctataaaaatgaaaatatgccatcagaaaagtcaatcctagtgtcctcaccctttgctattctttctagtgtcaaaaatgttaattcactcatgaaaacttatttattctaaaaaaagttcttggttgcacgtgtgaatttgtggactttttgcagcaaacctacaggagccatagcccataaattgagaatccctcaagacggtcattatcagctaaataccttcattattattattactattgttattgttattgcatgtatccatacaatggatatatatgtgtgtatatagatattatatgttattattaaaattattagggtggtagtgtcagtgcaagaagggctgtatttgggacccttatctaattccactaattcactcaacaaatcattcatgtgccagagaatatataagcacagtgataaagcagacttgtactctgcccttaaaaagtctgttcctagcctgagtaaaataggcttagattacaggcatttaactgagtttctcttctactagtagatctggcaggcttttttagcagtggcaaataaatagttcaaaagaaatatatgataaaatcttgttagaaactggcatagtgtacggattaagagcacatatttgcgtgccagaggtactggatttgattcttaactctgctgcttcctagcttgatgaccttgaacaaggttttaaagcagtctatgtcccagcttcctcacctgtaagatgagctgatattaatagtacctacatcattgagtcaatgtaaggattaagtcattgtgaagtacttataacagtacttggcatctagtaagccctatgtaagtgtttattaataaagaatgcaatttttaagacagagagattcataccttatggccataggtttgtatcaattcaatcaaatttgtcatctctctctggaggtaatttcagagtcaggttaatgggccagcaattaggcattcattacatgagtgttttcttgtttgagcccaaatatattatggagagagataatgagagcatatctaaacaccttcagaaactaaggctattgtgtagaatcttataacttgattgagtctttaggagcatatagctcaacatcttcatcttacaaattaggaaaccaagaccagagagttaagtcattttcccacaattacacaactagagaggatcttacccactagaattgccttgtctccttggttctggagacccagttcttgtctataagtgtcctgggcctccctttgtctccctgtggcttatcatagagtcagaggctgtcccagaaacccagcttacaataaatttgttcatacccttcattctctttgtttctcttctctgcccttttcagcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaaggtaagcctctcattatctgacttagatattctctaggccattacaattgaggactagatttcagtgagtgaagacctctcctttgccaaaaaaaaaaaaagttggctaaccatcagagggacaagtctgtaggttacaataatgggagtatagaaaaaaatgtctcccacactcctcacctcatgtgtggaggtctctagatgttttccaggtctttaagctcatccatgagaatgtgtgcatgtgaagcctggagtaactcaggcttacctgtgactatgcccaccagtcaaagaaagctgggaacacatgtctagtcgaacaaggtttggtttattacttgctacagcaaaagaaatctcacaccttgaggaactctgggcatctcaaggggatgtaaagtggatttagaatttaggattctgttagatggtttgggggaggatttaagaatgcaaggattttctctggatcagttatggtcaggaattgggggtagttctcagataaggtatcttaattattttttctaggaggcagagggaacagaataggactaagtctataataggcaaagaagcagtagtcattgtctaggctcagacatgattttggagtggttttgcttttatctcactccatcacagtcacagagtgacctcctcagaagctggtgttttgtgaaattatttatgtgaagtagggaacatcctggcctaagtattagtgtaaggccagccaccagctgacagttgtgtgatgcctttttcttttcttaccaacaacatctgagggatggcctgtgtctacagattgtcattccttgagaagcacatgtgcactgggagtaactcagcatttctctaggggtagccaggagggtatccagaagtaagaacttcttctatcccagcagttgttgaagcttcctacactcaaagacagaagctccaagtcttcatgcacccaatgacttgggaagatgactaaatcacattaatatgcactgaattctaaaaatgttttcttgtgtttagaaaacatccttagttttggaaaaaataattattattctcagacttacatgagaaaaacttgcctgatatacttagggagggaattaaacagcatcataaaaaacagattttttctacaatatattgggtaatttttcttttacattattcattgtttgcccaatgatatatgagggtggcaacattaacataactaggtaaatctacactatcatgctctattcagttgttcctggatcacttttactgtatctatgctctcctactcttctaaatgttttcattttcaataacctgtaactgtttcctcctcagaggactgccctggggctactaaagtcccttttctcacaggctcagagatcttggaaggttggtggggggtggctgaatggttacctgttcctgtgcaaaccgttagccaataactggtggatgcagactatgaaacctggcttccttgccttgagacaggataaactctaagttgtaacttaccctccagagttgccttgcaggatcaggctgaagctatcccctgtgagactgcctgatttcacccccttgcttgacttgtttgtcttttctatcctattccctactctcttaccagtttctcttggagcacatgttttctaagtcacttgcccatgaagtctcatctcaggatctgcttctggggagcacagctgatgatgttcagcattcccagaatatatttgcaaactaagcactgtggccctttcaaaatcaaagggagaaagagccttcagacacttttaggacatcctgtagttgattgatttcctttattttctacccccttagaaataactatttaagtacatcagttcacatttcctatgacatcttaaccatgtaagacattttaaaatttagaaacatctatttcaaatctatatctgtctgtgagggatgattaggattattcaaagagggggtgaaaatatctattgttctatacattggacactttataatagtcctgcatttgagaacctataatattgtgcttgcgcacatgtgtgtgtgtgtgtgtgtgtgtgtgtgtgtgtgtgtgtgtgtgtgtttatattttacagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgagtgagtgtttaaattctgaagtgaaggatttcatgtccctcaatttctaggcaggatgctccattagaggcacagtgacctccttgcctgtgtgtggttagcctgtctgctaagggaatgtgagaggatagcagaggtcagtttgatagaaaccagtcaacattggcatttttgtttcatgcacccatgtaattgctattcatggtgaagttatatatagcaagcttgaaaaatacaccaaagtctgagtatctttgcaaatgtataaaacatattgagagcactggtaggatctggaacatctgcaatgatatcctctatggtttaatcactagtaaattaaacaaacctccagactagaagagttaatgattaatcagttgaagaggtttgttatagttcaataagttttgatttaagcccacagtcatttatttgttgtctaccatgtatgaggacctatctcaggcactgcaggaaatacaagcaggaaaaatatgtggttgttgccttcaaacattctaatataatgaaagtagcagctaacttctattaagggtctgtgctaagggtttgacatgatatatttcttttaacccccaaaatgtatagatttctcactatcaccatttcttggggatagtaattgcagacaagaaacctggagctaaaatgttaaaatatgcagcctaagccacctctctggtaagtggcccagctgagattggagccaggcagtctaaagcaggctgtgataaatgttctcttagagacacacagttcctggctatgtggttaggagagtttgcctgattggagatcctctttcataccaagtttccttttttgtgcagtttcataccacctgcacacaaaggcaggcctggggaagttccctggtgggtatagggctccaggaaattagggttggaggaagtagaagctcaagactcactctgcccagagcccagttggtggccaagacatgactgtgaaaaaggggaagggtggggaaagctgcattgggcactgcattcttaaactacttgctgactgtgacccctgataaactctttgtaagcatggagaaatcaatggagaccaagaatctgatgactctcttaaagcactcaaatatctttaaatgggacttagtcataatcccgtgtttcaggtaatcctagagaagagaaataatttcttcccctctccaatttagtaattccaccactttctgtttgtatggtttcgcagatactcatcttcctttgaagcagacagaggagatatgtttatctccttctccacttgaagagaatctgctctttacactggttaggtgatttctcacagtctcatggctccgtagcagctgaattgggtttaaaatgcaggtttctggactcctggtcctggcattgagaagagaaggagaaaatcagattattttcctatcatttacttaccatgggaacttaggcattttgaactttaatagttattttttggactcttactttgtgtctggcattttttatacatcatgcaaattgcttattataatgaacctttaatgaggtactattacatctgttttacagctgaaggaactgaggctcagaagaagttaaataatttgcctgagtccaccaaactagtaaggggtagaaatgagatttgaacccaagtctgtctgacacaaaacacaattgttttcaccaaaacattctgctttgagttactaaatcattctgatttacattctcatgtaaaatgggggtaataatacttgcctctcaggcttgtcatgaggattaactgagataatttgtgtaaaatgactttccccaagcctggcacatgataagtgctcaatacatgataattctcttccccaagacctaaggatagaaaggagtggttaatgaacttgaattaaaacattctcagaatacaccaaatgacacaataaattttaggtctccaaaacaaacctttacaatgggttttctgtgtcttttcttcttatatattctgaagatgctgtcatttatgttccttgaagtctactcaacgttgggccttcctctctctatcaccaataattgtcttatgatttggtagttgctcaactagcatttattgaattgaaatgaatgggctctgagcaattcaaggtacacactattagtgttgatgtctgtgagaatgttataatccctatatagttaagtatctcaaactggtttcaaaatttggtttgatttagataatttccaaacccacaaataaggcacttcttgtaagcttcagggctactgtatatgactgtctcagttgtctactatagtgggtgcctggccaaggacaataaagttagcccacactttgatgattgagccctttgcttatatcttcataggaagggtaccattttctaatttgcacaaaggcactgtaggggccagcagtcactctgttagatttgcaatttttctgcttttgtttgtttgtaaatgaaaatgatacttgagacagaagtagaaattctcccttaagagaatttgatccaacacttaccctctataatgttacatgtaaatatccctttggtaattgcacatatattttttctgttgctgagtgttatgcattttctttcctttcatctattcagagggagcaataagctatcgcttttaagtgaaaagtacagggcctacatcagagcacttaaaatatatgcagaatcttttaataaaacaatttaatttcctattactaaatgatctggacttacatttttcacccagacgaattgtacgtgggcagaccgcagagagtttggctgtgcataatataacagtttgtgaacaaaaaatctcagaatggggaaaaataaaggaatgcccaatccctcagtttgctggaaaccctcctatggtatgtacaattcattgttgttattacagtttcattactgacaatctttaacctgtgtctaagaaacatgtacagatgttatacatctatatagatgtccattacaaatgtcatggaacagctaaaacatgtgtctacttttctctgctatacttattggatagaattgtttcttgaaaactaagctttgcattgttctgttattaacatcctgatataaaacttgggaaaatagtgtttttagaagtgctgttttggttcaagaagttccatctcttttcttcatgacgacgccagctaatgatttttagggggacacttgggattccatcttgagctgagttggatagctcaaataaatcacttataaggagcaaagggcctcttcagataccagcacataatactttctatacagctttccaatttgaaaaggaaattgatgaggtggtacataaggctacctttaggcattaggagttttctgtttatgaggcataaaggaggctggacggcgaggttcataccaacatcccaatggcatcatgtggtgggcagaagtgtggcaagggtgaccaaggaaatacatggtgaaatactttcttccttctattgggagctctgaagggttccattttgtgtattctcataacactgctccatagagtaagatgtgggccttgtaatcttcatatcattttccccattggcagatggtatactttgttggttattgtgctagccattggtataaaactaggcaaaaatcaacatttgtgcagggcttctgaagaggattatttttttttccttaggcacagtataacataaaggcaaattttccattccattttctcctttcttttttcctactctcttagcataggagcactcttactctagacacagcatactatatgaagacgtaggatctttaagcatcttttcccattaatggaagcaaccagacatatcagtgaattggctccactacatgcagacatcaatagaaaggataaaaagggaactgtattgccaatcctcttgtgggcaggggaaggcacatttcctcgatgacagctggagtcagagtactagtaccttagcagaaacctacctcaaagaatttctaggtatactagcagcaatatccaaatctggctccattcagtggggctccatggtagcactcaggaaacagatagatgatttgagactgttttatatatctatcccattaaaacaaaggccaacaacagaacattgtttatatttggggcaaatattcttcaagtttggctgaagatggagagattcaggtgctctcaatttccaacagtaagtttcctataaaagtaatctagtagaaagattatatgtgagactatcggaagcactctcttatcttttcccccttagaatacattccggaaagtcattttttagataatattgctgtctaaaattctttgctagtttaggtattaaactagaagtccaattggctgagtttcaggatggatctgtttgacctcaatgtttttatatggccaataatgctacagagtaattccagtgttcagaaacactgcatgttctgacccaagaaatagctaaagaagtctgaaaagctctaggtttgtctccattcagcaagtgcattgcatactcccagaatttctcagaatattggagaaacagccaaactcttgcataaaatttgtcatcttgcaaatttgtcactgtgactacataactaagagaaagcaatcacagtgttgcattaaaaatattgtgttgctgaaatgttatcctttaaagaaatgttaattctgaaaccaaccttgctttgttatagggttactgcaactgtagttgcaacactgagaggaaatcccattcttgtgaggagttcctcttgggaaagttttatcttgtcagtacagttccccattgtgactaaggagaatgtttacttttactggctcaaaattatcttagtttcagatattttcatatattccattgtagaagaaatttatttatctaatgtcaaatatttaagcaagcctacaaagattaacttggcttctaaaatttttctccctctgaatattttgttatctattaccacttaatgtatctcattttcatttttgctctgattacagacttggaaatggatagtgggtcccatgtttctgtatctctgtgagaggttggtgcggttttggcgatctcaacagaaggtggtcatcaccaaggtactgattggtttagtaattactagtggtcagtgtctaactatatcatggacaagtcttcccaactcctctatatcattgatcagatgttacaacagagagaagacctacaatttatttcaatttacttagctcaataatcaaatgtttgagcctttaactggggaaactacaagttaccatttttgatgttaaaatgaagccaagttctttctggacatcaatctcccccacccattgtgtgtgtgtgtgtgtgtgtgtgtgtgtgtgtgtgtgtgtgtgtgtttgtgtctgtgtgtctgtgtgtttgtggaggggaaggcgacagaggcattatttggttagttaagagcagaaaagaaaaagaggtgagttcaaaggggcataaattgagtcttaaaattttcagatgccaaaagaaccagagatctaagggtaggtctcactgaggctgagctagtttttcaggttgtctttaccaccttttctgtgctgtgtatgtaataatctaataggaaagttgaagtgcccaaaatttcaacaagttagtaaataagctgcctctcaaatttgctctcctaattccaagtctagagtggcttttcctgaactctaatctgtttctcatcacaaaataaataaatatccaactaaataaatgtaaatggaactccttgttataatttcaggaaacactaggaaagtctatctttatcaaataaaatttaattcaattcaactcagttcaaaaagtatttgccaaaaccctactgtgggttatttttgcaaaacacacaaattcttcctgtcctccaccctatctttcctcatttgctgtctatggtgggtcatagtaaagttagttcagctggctttggaagtcttgaaatataggaaaccacaacagttctccttttgtgatatttatattgcattataagaacaatcccacagatcagcaaaaacagttgctgcaaaatttcccttactagactagagatgactgagtcagacaagtatttttcttaaacatacttttaaggaaaacttgttttcctttgaagaaaatagatatttgttttcttctcatataaataaatatgagaaacaagatgttatccaaaagtattccaatgagaatgctgtccacttatttagttacatctcatttgtgcctatgatagcaaaattgtaatatggtaaaaattttttccacaacacaaaattgcaacatggtaaacaattttcaacataattttaattttctgttttcaaaatgaagctttacaactccttatttcagaacagaagggaagtttgttatagtttttatcatgtaagatgcatttaaatcacaagttctggaaacgtttgacatttttttaaaaaagaatttttcactcttccacaactccctgttcgagaaaagcccagcaatatcagttaacattaggaagctgctattttatttctattgatttttctttcctttgatgtcccttggtttgtctttaattatacatataaggttcttctagaagtcttaggaatcatcaaagaaacagtatattactttctgtattgctcttcactgtgttctattttttaaaaaaattatccagtcaatagttgatggacatttggattgtttcctgttttttgctattatgaataaagctgttataaacgtgtgtacgtagacagatgaggatggcaatgggtgggtagaaaagatggtgtactccccaggtagggagaaatgtagaaataacgcatggaatcaggcagattcaaggtgtgattcaggacaaagatagaccaacttagttagtcttgttttggggaatgttgctacataactagtcaatgggatctccttcttctggccagctattaggttggtgcaaaagttattgcggtttttgccattaaaatatggcaaaactgcaataatttttgcaccaacctaatactaaggccctctctcatcctcttgggggataggaaggctgagcaggaaacatcagtttttgtaaattttttagcacttttttgacttctgagaggaaaaaaaaatcacaataggctgatttcttatgttggattccctggtaaagactgagaaataactgcatgcagaaggtttctaaggaattctataagagataaacctggaaaggaagtaagaaaggcaggaatggggagagagaaaagctgatcctctttctagttgtaactgtggcctcagctgatactacagggagtgtggaaattgagatggcctcttggagttaacctaagttaaggaaaagggactaggccttagtatcccttaatcagcccatcattagtaatgggctacaactgagggcaattccctgtgacagacacatctgctggaggaactcctgtgttgtccctaaagcagagatctaagtgggccaatttagctcagttttttatccatatggacactaaaaaggcaagtatttaggaaaaatgtcatttccagacatatgttttattctataggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagtgagtaaaaagtacatattaccaacgtatatgagttcaggaaaaatggcactaaatagctcctcttcctccatgttttactaagtctccaacaaaacacacaggttctaagaatataggtagctatttctgtggtcaccgtttcatatgtgtagtgtgtttatgcatattttcataaatcttatgtgaaatatgaaaaccttgaatcaaatattagaaataaatactcccaaattcctttaaatatgtaagggtcaaggccaagttatattaactttcctaacaaatataattgtagtgtatcaaaaatattcttaaattttcattggcataatttatttgaggttaaatgccatatattagcccctttgcctccttttccctgcatgcctaacatgctataaggcacttagtaggtgctaaagaaaggtttgagagtttgttgaataactcaatgaatagataaatgaaaagtggagacattaaatctacaagatgtaatgatgcagcaaatcctcacttcagggtgcaccgtatgcaagaatttcaagagtgggatgtcctggcaagacatagggtgtgtgtggagggggcgttgttgtgtgtgaagaggggtggggagattaaaaaaaaaaaaaacttgttctgagttaccgaatgtttttggttagccaaatatttctctttttacttccaaacccaacgttggcactaagtttggttacttgaaagctatttcatagaaggaagcacccaatagatacattattccaatttgaattaacatgttgcacatccccaataattatgggtgccccatctcactctgaagagcaagacatctctgtaactatctcctccccatttcccttcaggatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaaggtaagtcctttcatttatcggagggccttagagcagtaaccatactctgccatgtgaggcctgagagtgctttcagggctaaggttggcagagaccatgggaagtgaagaaaagcttccggtggttccagagagacaggcttttcttcaaaagaatatttgttaaatctaatgtgcttctagataagtaggcctattagtgaagggaatatattgtatttgtatagtgttgctggaaattcagaagaaagaaagttgggaaagtattcacagccccaacttaatagctgtaatttttgtatattctcttctaatattttccatgtttacatatttttagaaggttgtaaatattaagtatgtataatttcatgtcctgcttttaaaaaaacattatagaaagtgtttttcaatgtcttcacaggctttataatgatgactttaaatgatctcttcatgttctattgagaggatattgaataatttttctttcatcttgtgttagatactgagattgattcaatttccagccgcgccccaccccctccactcacccaatactttttttgcaaagggaggagaggagacctgaaactctacttatgaatatctcctcaggatcaattcacaggagattttttggttacctataaatttggttttattgtgtaataaagggcatcctaaataaacctcaggccattctaataactgtaaagataaactctaatagggacattaagcctaccttgacttttcattctccctgtacctcttttccatgtggaggagatgtgcatagaaccttatttttcccctcggaactcatgaatgtctggcagtagcagccagggaagaatttctgtggcaatccctgctagtctagattccatcaggctttctgagaagaggttcgaaggaagccagagattctgggagagtaagagcagactcagagggaaatttggtgggctaatagttttttcttaagttgtgtatttctgaggtcaagttacttatttactgccctgctagagtgaaggccagagcaggttcatgtaaactaccctgtgaaatgtccagagccttctgaaaatctatgtttctaggcattctgagcatcaagaaaaagtttaggtgacagaaagtggaattccacatggtaatgctgatagggcctgccaaatataatctgcttcatgatccaccccattttcagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggtaaggacaagactccaaggctcaggtccttcccatagtgtacagggcttacgaacttccccttggttattggtgtgtcttgtgtactattttttctaagtatgtttagtggatttggtgatccggtccattcactctcatttagtatcgccacattatatttagactgctcagattagaatcaaagccaaggagcctgtgagggaataaaagccatcactttgacattattagagcaattctcccaccaggcactctgaaaccaggtgattgagatgatgcacagggttattttggggaaaatttagctttctctttctctctgtctctctctctgtctctctgtctctctctctctgtctctgtgtgtgtgtgtgtgtgtgtgtaaaacagacactccccaacttaataatggttcaacttatgatttttcaactttacaatgaagtgaaagcaatatgcattcagtagaagccatacttcagtacaagccatacttcagtactgtattcaataaattacatgtggtcttaaaccttttattataaatagggttcatgttagatgattttgtgcaattgtaggctaatataagtgttctgagcacatttaaggtagtctagactaaactaactatgatgtttattaagttagatgtattaaacccattttagacttatggtattttcaatttagtgatggttttatcaggatataacaccattgtaagctgaggagcatctgtttatataacatacataagcatataaaggattctgtatatatatattttaatatgtatttatatatgtatcatatatatttatatgtactatgtatatatgtatttataaaatcatttaatttatatgcttttgtatgttttataatatactcactacatttataattattatgcatatatattgccaggtattattcttatgtatctagtcacatagattgtctaattttatcatgtcaccaaccctatgaagtagctcttattattttccacactttacagatgaaaaaactcagaccaggttaggtcattttcctaagagcacccaacaagtaagtgacagagacagaatgtgccagagcctgtcctttcagcatcttgcagtagttcatgattatcatttataaataaattactatatatctaatgaatgtgatatatatgcatgtatgtgtgtgtgtatgtgtgtgtacaatgagagtgctctttcaaaaatgtttggagaccactataataaagtagccaatagttctcaactgggacaattttgctctgctcctccccaagacacacaccagagacagttggcaatgtaaatatcctacaattaaaaagacagccccccacaacaaagaattatacagtcccaaatatcaacagtgctgaaattgacaaaccctgaaacaaggtaatgattcctggagtggtaacatctttgtaagtaagcaaacgttaatgacttggcctggaagcagcataagctatcaccatgagtgaggagctaaggcaagagtctctgcatatttctgtccagtgtctcagctggtgtcttagtccatttgtgctgctataacaaaacacccaagactgggtagtttgtaaagaacagaaatttattttctcaaagttctggaggctggcaagtccaagatcaagacaccaacaggtttggttgtctagcaaaggctgcatcttctgggtgggagaaatactgtgttttcacatggtggaaagaaaaagggaaggctcgtcaaatactgtgtgatgactcttttccaaagcccttaactcattcataagggatgatccttcatgtcttaatcacctttttaaggctccacttcttaatgctatcacataggcaacatctgaattttggagaggatacattcaaactgtagcaactgggcatacatagacattgactccacaaccctgggaatcttccatgtgcaccctgtcactgtgaagactgaattcccatttgggtttcaacatattgtttatcacagattctccaagtcttaaaggaatcttgtagcaaatatagattagggaaacataacgataagaattgttgctccataaaaagtggtttcaaaatgccagttctgcaatttaaaaacaaaacaaaaatgctttgataaaaataaaactcaggaaaaaaatctatagtatataaattgctttactgttctgttattttaaaagccatgcacaggtttcttttttaaatcagttatttatttgtattgaaaaagtaattattttgctttgcaaaactgatatctatagaattattaaattggagtgcccacctttcttaacctcctctatgaccatcatccatctagtgaatttcaaatctgatttgctttttaaaaataaatttaattaaccacttttatgaaaaatacctgttgctcaaactgaagcctcctagaatggtagcagaaaaacagtatgtgactatatacacatatgtgcgtgcacacacacacatacacacacactagctttaggcttgatttgatgtcttatgctaccaaagtattgctgcattttagtctaaaattgttacatctcttagtaattctcccaaaggagtggaagtatattagggtggagagaaaaagtcaaacatagagcagagagaaaaacagtgagacactattcatccatcaatgcctgactcaaatactgcggccctaacccttcccctattcttccacttcaccttccttctttgttctcattaggacgcttgtgcctccttcatgacacacatcataccctgttcgacatatgggattatttatatttatacttcgaagtctccctttctagactgtaaattgcttgagagagatccagtttatttatctttgtttacctttcagcatccagcagggtgccttggttagaatagcttgtgaaggatgtaaatacattgtatgtgcttttacagaatgtctcttttttttctgaattcatgtcctttcctgtaggccaatcactttgctgtgcaccatgatgaggagaaagatgtgatcacaggcctgaaacaaaagactttgtatggacggcccaactgggataatgaattcaagacaattgcaagtcaacaccctaagtaaggagtctgtcaccaagatgtttttgaggcttgcatctgcctaaagcggcagcccctatacatatctaaacttatatattttagaaactcaaatatgtatattactatataaagattgaattcatgcccaacagaagattccagatatcttcaactttaagaaggatctttaaattataccaaattacctggagattaattaaaaacaagtatttccaggtccccatctcagattttctcaacctgcctgtcccaagtagggccacagcttagttcttttctttagtcacctaaatttcattagtgtatctacttcttttaaagattcaatataatttatacatattgttaagaagacactgtccccactttcagttctaaaagcttctgggtctaaaatcttaagttgacagatgtctcaaggtgctttctgctctcactaaaactttagtcattataaaaccttgagggggatcccttatcttgctagaacacctaagaaactcaagagatcaccatacgtgtacccttcagactattgctttttgcactgtaaggagcatacaaagtgcctggggatctctttaaaatgcagataccaatttagaagatttgaggtagggccaggtaatctgcattttttaaaaagctgacgccaaggctactgatcagaaaccacactttgaacagggcttcagactctaaaatttagagaaatgaagccacactgagtggttggcatagttagcttgttcctaatttcaagatgccagggggcacagagccctgaaggaaagtagcccacggactcatgaattcaccaccattttctctgtgatagaagtttccaaaaaccttggttggattttacttttgccagggaagtcaactaccttttgaactatccagatgctcacacaaacaggctgaaccacactccctctgagcaatatgatccctttgctatttgtggaaaagaaaaaggagcagaggggactctgccctggggcctcaaattaacgggaaattcacctacctgctttgtagacatctcatcccaaagcttgaaattgtctttttttttctttcccaaaagtaccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatattgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttccttttttattctctcaagccaccagctgccagccaccagcagccagctgccagcctagctttttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattcctacggggaattcttaaaactgtgctcaactattaaaatgaatgagctttc

SEQ ID NO: 1670 - DNA, 14330 bp, Homo sapiens
  source 1..14330: mol_type = genomic DNA
aactagcccagccgcgcggagcgcctgggagaggagaaggagccgacctgccgagatggaggcgaccggcacctgggcgctgctgctggcgctggcgctgctcctgctgctgacgctggcgctgtccgggaccagggcccgaggccacctgccccccgggcccacgccgctaccactgctgggaaacctcctgcagctacggcccggggcgctgtattcagggctcatgcgggtaaggggctctggggacgtcctggctaggggtgggaggattcctgggagagaaacccgagtgccagggtgaggggcttttcgggtatcctagggaggaggcaggggcaggggtcccaaggcaaaggggctgctgctgtcctggggttgggggcaggagcaggttgtccagggctgagaaggggagaggtgcccgggagagaggatcgtggggtgggggaccagggctaggaggggcagagacctctgcctacagaatcctgggaaggtgatgggcagggaccgaggctgaaagagacaggagtcctccagccgaggagaagctgatgcagctgggcttgtcccagagggagaggtagctggagccatacaggtggggcatgctgaagagggcacaaagaagaaaagggggaggcgtccctgcggggagttggaggcagagaagaggctggagggttgcaggctcagagagggggtcccgctgaaggaatctgccagcagagaatgcaggatgggaggatgggtggagctcagttgggagttcctgggactggggaggaaggagagcaagaaagaaggcagaggcagccccagccttaggggatagcaggtgggagtgggcagaggcctgaagtttcccattcaaaaggattctgggtgacttcaaggacgtagaaaaaagggtggggtcttgggggagagatggggcggatactcagcagtgtctgctccagaatttcagggttttgtggtgactgaaaggggtggctggatatttggggggcagggagggccctaaggaattaagggagacccaaactgcttctggattgcccagcgtcagaggttagggttcagcaggaagcaagggaacgacaggaagttgggggatgccactgaaggatgtactgggggaggaggcccgggagcctagtgcaaaaagagaactgagcctcagctatttctgctgggatgggggcaggttcctggtagagggcgtagaagctagacccggtggctcctcaagtgacaggggccatgatggagacaccttggatcgaagaggtcacagcaccctcctctttcttcctccctacccccagctgagtaagaagtacggaccggtgttcaccatctacctgggaccgtggcggcctgtggtggtcctggttgggcaggaggctgtgcgggaggccctgggaggtcaggctgaggagttcagcggccggggaaccgtagcgatgctggaagggacttttgatggccatggtaagtcaagggctgctaggccctccgctcacagcctgccaccacttactggtgtgtgacctttgcacatggcttagtccctctgttgcctcatctgtcaaatggagtgataacagtgcccatcagccgggtgcagtggctagtgcctgaaatcccaacactttgggaggcggaggtgggtggatcacttgaggtcaggagttcgagaccagcctggccaacatggtgaaaccctgtctctactaaaaatataaaaattagctgggcatggtggtgcgtacctgtaatcccagatacttgggaggttgaggcaggagaatcgcttgaacccgggaggcagatgttgcagtgaaccaagactgtgccactgcactccagtctgggcaacagagtgagcctccatctcaaacaaacaaacaaaaagcagtgcccatcatgtaggattgagtgattgagtgaggactgagccttgtgcaaagtgagcactcactaatcaccaggttgtagtatcagtgataaccatcaatgatccaggtaaagccctgagggttcagaaagatgccggagcgctttcaaggtgctggggattggtgggcaagccctcgaataatagaaacagttctctgtattacaacagaaagcaggaggcccatgctgggtgctgccaggaactcagtagtaactaagacagcaccggtgctgcttccccagcgcacctaggccagtggggaaacagactcaccacacagtcccagcccagagtggtcagggccaagatggggaagcacggggagaaaggtcagggtgggatggggaggggtcagggcaagaggggtcagggccaggctgagggaagccctgggactgtaggaatttagaggaggtacctgacccggcatgtttggtgagggagcttcaggaagtcttcctggaagagaggctgtcggagctgagactcataagatgagtggggagggtgttccaggcagaaagaccagcacctacaaaagcatgactttgagagaagcattcatccattcaactgatgaattttcagactgggcacgctggctcatgcctgtaatcccagcactttggaaggctgaatggggaggatgacttgagcctaggcatttgtgacaagcctgggcaacatggtgagaccctgcctccacaaaacaaacaaacaaacaaaaaatcattatacctggtaccatgggtaccaggtacatagaaatgactcaggcagatatggtgtcctctcctactgtgggagaggcgggcttatactgcagtaagacaatagagggagggaatataatcctaaaatgagaggtacagatttgagagcaaacacagggcacaggcatatgtacgagggtaaagagggaatcagggaaggcttctcagagaaggtgacatttaagccgggacatgaaggatgaacgagttagttcaccaaggatgggatggaaaggggtgagagtgatggaggcagagggaactgcaggatcataggcctagacaggggatcctgacgcccttgaggaagtgagagaagaccagcgcagtcgtagtgggttaagtaacaaagctgagaagccagggaaatccctggtcatgcagggcctgtgagtcacgtcagagtgtttgggcttttgtttttcctgggagcagtcgattttaagcagggaacagctgtattcagagttgggaagatcctgtggttgctgcctgaaggggatgaaactggaggctaggagcccagggtgatagggaggatccagggtgatggggaggctgggaggtccgcggtgatggaccagggctggggccaggggatggggaggaaggagtaattgggagaggcctggggctctggccgaggaatggatggtgggctgaaacagggagaggagagatgcttaggccactttggaacacagtagggcaaggacaggagacacccaaggggaagtgcccaagagaccacgacaggctggcattggacagggaaggtctgtctggagcaggtgtcttggataagggaggaaaatggtgcagttccatcctcctccctctctgttcaacctctaaactacatggggcacaggacccagtgggactccataaatgatgggatgggtggatggaaggaaggaaggaggaaacaactcttcattcatcctggttatttacagaacaggccaggtgcggtgctcacgcttgccattctagcactttgggaggctgaggtgggtggattacctcaggtcaggagttcaagaccagcctagacaacgtagagaaaccccatctctactgaagatataaaattagctgggcgtagtggcatatgcctgtaatcccagctagtcgggaagctgaggcaggagaatcgcttgaacccgagaggcagaggttgcggtgagctgagatcgtgccattgcactccagcctgggtgacaaagcaagacctcgtctcaataataataataattacaaaacagaaggagcctgggtcatcccagctacctacttttcaggagaatgtactcccttacccaagggcaaaggatgggagaaccagtttgattatgcatttattgagcacctactgagtcctcatccctgggctaggctggaatggactcagatggagcctgaagagtccccctcagggaacctcactagaaagaaggaggaatcggccgggcgcggtggctcacgcctgtaatcccaacactttgggaggctgaggtgggtggatcacaaggtcaggagatcgagaccatcctggctaacacagtgaaaccccatctctactaaaaatacaaaaaatgagccaggcatggtggcgggcgcctgtagtcccagctactcaggaggctgaggcaggagaattgcttgaacccgggaggcagaggttgcagtgagacgagatcacgccactgcactccagcctgggcaacagagcgagattccgtctcaaaaaaaaaaagaaagaaaggaagaagggggaatgggggagaggggccggtccctttttgagtctagccttctgcgcaggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggtcagcatggcggggtcaccccagggtctccagccgagtgaaagggaaaactctcctactgtggctgggggtggccccaacccaggtcctggaatgggcaggaggggaagccttgaactctagggctggcctgggggttctgttcactgccaccttctgtctctgtcccactgtctctccgaggctgtcatgacatctctctgtgtgtctctggtgctatcatcccattcttcctgggtctccatctctctctctgtctcttttctttctctctcctttcctctattttttgggccctcagtctatctctgtttctgtctccctgtctgtgtgatggtcactctgtttctttctccctgtctgtttctctgtccctatctgtctgtatccttctttgcctgtttagctctctccctgcgctgtccatccatctttccctgcctccctgtctctctctggttgggttcagctccaacctgctcccctctgcctggctccatcacagcctacctccctgcccccattccccccaggacgcccattcgatccctccctgctgctggcccaggccacctccaacgtagtctgctccctcctctttggcctccgcttctcctatgaggataaggagttccaggccgtggtccgggcagctggtggtaccctgctgggagtcagctcccaggggggtcaggtgagtgggtgggacccctctccaactaccttccctgaaggttcctgccaaggtcccatgagaactagctgcccttctccccacagacctacgagatgttctcctggttcctgcggcccctgccaggcccccacaagcagctcctccaccacgtcagcaccttggctgccttcacagtccggcaggtgcagcagcaccaggggaacctggatgcttcgggccccgcacgtgaccttgtcgatgccttcctgctgaagatggcacaggtgtgggaagggtgcagggaccccctctctgaatgggcatggtgacctggcaggtccccagccaggtgtccctggggacctcaattgggttcctctctctttctctctctgcatgtctctgtgagtatgagtgtctctgtgcatgtgtgtgcatcccttctctgcacatctgtctgtccctttcagggcgttgctctcactgcctctcccgcccccgacctgggcatttgtgccgggctgtctgtctctccagcatctctcctctttctccctcccacctcggcccttgtgttcaggccccatgcccagggtcctacaccagcaatccccaggatcacttcatcccatcccctgcagcctccccagacttttatgtaaattcacaattttatgtgaattatggtcatttattaggaagccttgcaatatcaagttatgttaataaagtccactttattaattatataagaacaatatttcttttccttttttttttcttttctttttaaagagacaggatctctttctgttgcccaggctagagtacagttgcaaaatcatagctcactgcaaccttgaactcctgggctcaagcaatcctcctgcctcgggctcctgagtagctgggacaacaggtgtgcaccaccacacctggctaaattttttttttttctttgtagagatagactctcactatgttacccaggctggtcttgaattcctgggctcatgtaatcctcctgctgccttgaactcccaaagtgctgggactataggcataagacatcatgcccggtcgggcacagtggctcatgcctgtaatctcaggactttgggaggccgagacgggcggatcacctgaggtcgggagttcgagaccagcctgaccaacatggagaaaccccatctctactaaaaaaaaaaatacaaaattagccggacgtggtggcacatgcctgtaatcccagctactagggaggctgaggcaggagaatcgcttgaacccgggaggcttaggttgcggtgagctgagattgcaccattgcactccagcctgggcaacaagagcgaaattccatctcaaaaaaaaaaaaaaagaaaaaaagaaaaaagacaccatgccctataagtaaactagaattaaggtgactcctaaggaaataaatagtttttaactgtacgaacttttggaagaatggggccaattctttaattaaatgcagcctccctgtttgtggagaaagaaaaatttttcttaaccctattgccccatttcttttctcttttattgaatattttttagttttaactatagtaaaatacacataacgtttaccatcttaaccatttttaggtatacagtacagtagtgttcagtacattcatactgttatgcaatcagtctccagaactcttcatgttgcaaagctgaaactctatacccattaaacaactgcctgttcctccctcctccaacccctggcaatcacctttttttttttgagatgaagtctcactctgtcacccaggctagagtgcggtggctcgatctcggctcactgcaagctccgcctcccgggttcatgccattctcctgcctcagtctcccaagcagctgggactacaggtgcccgtcaccacgcctggctaattttttgtatttttagtagagatggagtttcatcgtgttagccaggctgatctcaaactcctggcctcaagtgatccacccgcctcggcctcccaaagtgctgggactacaggcgtgagccactgtgcctggccaggaagtagactcttgatattagttctctctggttgaaatgtttttaaaaatgaaagagaatgactaataacaaaaacacagaaagttataaggattgatgaagatgtggagactttgaaacccatgtataccattggtgggaatgtgaaacgacgcagccctgtggaaaatggtacagcagttacctgaggtcaggagtttgaaaccaacctggccaacatgcagaaaccccgtctccattaaatgtacaaaaattagccaggcatggtggtgcgcacctgtaatcccagctactcgggaggctgaggcaggagaattgcttgaacccaggaggcggaggttgcagtgagccgagatcgtgccactgcactcagcctgggcaacaaagcaagactctgtctcaaaaaaaaaaagtctacttcccaaccttcccaaaaatttatctaaaccccgtgacaaaactttaacttgtgtttccgaccccaggcttggctgttctggacatttacttcccaaaggctgtgttctctcagcccctctgcctggtttctttcaggaggaacaaaacccaggcacagaattcaccaacaagaacatgctgatgacagtcatttatttgctgtttgctgggacgatgacggtcagcaccacggtcggctataccctcctgctcctgatgaaataccctcatgtccaaagtaagagccttttccacttgccaggccttgggaacagaagtcagggttctaggctgagcaaggtggctcacgcctataatcccagcactttgggaggctgaggcgggctgatcacttgagaataggagtttaagaccagcctggccaacacagtgaaaccccatctctactgaaaatacaaaaattagcgggtgtggtggcatgcacttgtaatcccagcactcaggtggctgaggagtgagaattgtttgagcccaggaggtagaagttgcagtgagctgacatcacaccactgcactccagcctgggcgacagagcgagacactgtttcaaaaaaaaaaaagtgagaattctagagggaagagtgggtgggccaagcagacaggctgagttagatctttgaggcatcgatgggcatggcgtttgagatgtcgaggagccagaagaggttcaggagttgctgattgcagtatgaggcacagtgaaaaacaaggcaggtgtctgtgggcctcatcgccttagtgatacattaggtgccttatcctgagccatggggagcaatgcaatgactttgagcaggggagggcaaggtcaaattggttttttatttttattttttttactttttgtgggggatagactctcactctgttgcccaggctggagtgcagtagtgcgatctcggcccactgcaacctccggcctcctgggttcaagcaattctcctgcctcagcctcccaagtagctaggattacaagcatgcaccaccacgcccagctaacttttgtatgtttagtagagacagggtttccccatgttggccaggctggtcccgaactcctgacctcaagtgatctgcccacctcagccttgcaaagtgctgggattacaggcatgagccaaggcacccagcccaactctagcattttcgggtcaggcagctgctgtgggccatggggacgggctgacctggaatatgggagtggaggtcctggtagtgttgcaggagtggaattagctgtgacttccagcagtgacttgggttctctgagtctgtttcctcacctaggaaatggggatggataacaatatgtacctcacaagggtgctatgggaattaagaaagtatggatgagccaggcatggtggcttatacctgtaatcccagcactttgggaggctgaggtgggaggatcacttgaggctaggagttcaagatcagcctgggcagcataatgaggccctgtctctaccgaaaatagaaaaattagctgggtgtggtggtgcgtgcctgtggtcatagctactcaggagactgaggtggaaggatcacctgagcccaggaggtgagatgaaggctattacagtgagccgtcattgtactactgcaccagcctgggcaacagagtaagaccctgtctcaaaaaaaaaagagagagagagaaggccaggtacggtggctcacatctgtaatcccagcactttgggaggccaaggcaggtggatcacctgaggtcaggagttcgagaccagcctcgctaacatggtgaaaccctgtctctattgaaaatacaaaaatgagctgggcatgatggcaggcgtctgtagtcccagctactcgggaggctgaggtgggagaatctcctgaacccgggaggcggagttgcagcaagccaggatcgcgccactgcactccagcctgggtggcagagcgtgtaatcccagctactcaggaggctgaggcgggagaatcgcttgaatccgggaggcagaggttgtggtgagccaagatcgcaccattgcactccagcctgggcaacaagagcaaaactccgttgcaaaaaaaaataataataataaaatgaaataaaataaaataaaataagagagagagaagatagatggaacacccaacacacaagatgtgtggtctttgggctcagtgagggctgggggaccactcctccccacctgtcagcctcaccccaaactacagctatgcaagcagatgggcttctgagaggaggatccctgggccctacccccgtctgactcctgccctcctcttgcttgcagagtgggtacgtgaggagctgaatcgggagctgggggctggccaggcaccaagcctaggggaccgtacccgcctcccttacaccgacgcggttctgcatgaggcgcagcggctgctggcgctggtgcccatgggaataccccgcaccctcatgcggaccacccgcttccgagggtacaccctgccccaggtgggtatgcgtatggctgccacccatggttctctgcctcggggcctgagcccgggtggtttgctgtcagtgtctccctgactttttcttgatcttagtgtctctctctctctctctctgtctttatctccctctctttctctgtctctgtcttcctcctccactcctacccccctgcatctttcttctccttctttctctgacaccccctccctttctgcatatattttttttctttttttgagacagagtctcgcactgtcgcccgggctggagtgcaatggcgtgatctcagctcactgcaacctccgcctcccaggttcaagtgattctcctgcctcagcctcctgagtagctgggattacaggtgcccaccaccacgcccagctaattttttgtatttttagtagacacggggtttcattatgttggtcaggctggtcttgaactcctgacctcgtgatctgcccgcttcggcctcccaaagtgctgggattacaggcgtgagccaccgcacccagccatgctttctgcatcttttaactctttctgtttctttttggtttgtgttttcttcccctttgactctatctctgggccccatctgccccacagatctcccaattctacctccttccaaggtggttgggacaatcgaatgaggtaacatacagagaagcagtttgaaaactgaggagcaagtccaggactaagggaagccctcttgacccttagcccctgctgcagacacattctctcctctgtctctctctctcaatctcagtgcccttcactggagagcagctccgatgcagaaccaaaagggggcgatgtttccccagaaaccccagcagtttatgcaagcagctccctcctccaccttcactgcagaatcaaacctatggcagttaggatccagtgctgctatgctgctattttctttttcttcttcttctttttttttttttttttttttccgagatggagtctcgctctgttgcccaggctggagtgcactggcgtgatctcggctcactgcaacctccgcctcccaggttcaagcaattctcttgcctcagcctcctgggtagctgggattacaggtgtatgccaccacacccggctaatttttgtctttttagtagagatgggttttcaccatgttggtcaggctggtctcaaactcctgacctcatgaactgcctgcctcggcctcctaaagtgctgggattacaggcgtgagccactgcacctggcctaccccctcctgttttgtagatggggccttgggcaaatcacttccccccctgaacctcaatatatccctcctctacattagaaacaataatagtatcaacttgaagctgtaagataatgcttgtaaaacaaacaccaactcaactcttgggaaccggtcctgtgtaccaggcagcaacaatttaatgatgataatgacaggtatccaggcttgaggacctgctctgcaccaggggttattctgagtgctttgcatatctattatctcatttaatctttaaagcaaccctataccattatcatgcccatcttacagataaggaaactgagagcttgaaaagtttttagaggatttgccaaggtcccccagcctgcaaatagtagattcaagatttgaactcagagactatgccttaactactattctttgcctttctttctttctttttttctttctttctttctttctttctttctttctttctttctctctctctctttctttctctctttctttctttctttctctctctctctctttctttcttttctttttctttctctctctctctctttcttcctttcttccttcctcccttcctcccttcctcccttcctgtcttcctctctttctctctttctttcttgacagggtctctctttgtctcccaggctggggtgcagtggtacaagcatagctcacagcagccttgaactcctaggctcaagtgatcctcccacgtcagcctcctgagcagctgggacaacgggctcataccaccatgcctggctaattttttaatttttcctagagacaaggtcttgttatattgcccaggctggtctcaaactcctgggctcaaatgcttctctcacctcagcctcccacgtggctgggattacaggcatgagccactgcacgccactcaacactccacaaatgttgatgccattaggttttgtgaactagtgtccctggcacccgagacttgtactccacactcgaggaccaaatggactggggtgggaaggggtttatagtttcattattatttcccctcagggcacggaggtcttccccctccttggctccatcctgcatgaccccaacatcttcaagcacccagaagagttcaacccagaccgtttcctggatgcagatggacggttcaggaagcatgaggcgttcctgcccttctccttaggtatctgctgcagccctgggtatcacaagcaggtgctggcgaactccaggcatctgtgccagctgggggcacccttctgcaccctgggcttactgttggctcctccacctgctgttccccccgtgggcctgggtgtgaggaatactgactcagccctctctctctctctctcctcaccagggaagcgtgtctgccttggagagggcctggcaaaagcggagctcttcctcttcttcaccaccatcctacaagccttctccctggagagcccgtgcccgccggacaccctgagcctcaagcccaccgtcagtggccttttcaacattcccccagccttccagctgcaagtccgtcccactgaccttcactccaccacgcagaccagatgaaggaaggcaacttggaagtggtgggtgcccaggacggtgcctccagcctcaacagtgggcatggacagggttaatgtctccagagtgtacactgcaggcagccacatttacacgcctgcagttgttttccggagtctgtcccacggcccacacgctcacttgactcatgctgctaagatgcacaaccgcacacccatacacaactacaagggccacaaagcaactgctgggttagctttccacagacataaatatagtccatctgcaatcacaagcacatagccaggtaacccaccaactcccctggatctgcagcccacacgtgggagtctggctgtcaccttcacaagccacagaaacggccacacatgttcacagctcacacgccctctccattcatcgaacttctcagtgtccctgtccctggtgcctggcacagggaacagcatgccccctccggggtcatgccacccagagactgtcgctgtctatggccccaactcatgctccctctcttggctacaccactctcccagcctgtgaccaccgatgtccacacacccccaaccacttgtccacacagctacccacgtacgacatcgtcctggctccccagagtatcttcccactgagacacgccgcccccacagaggcacagtccccagccacctctgcaactgcagccctcagtcacccctttttaagcaccctgattctaccaaatgcaaacacatctgggtctgcgattatgcacagagactttggacatacgaggaccctcagaccggaggaacacctgcccaaccccaacacgtgcttatgtaaccacgtggaaagcggcccctgctgcccctccacacacacatacacactcactgatctacagcccctgttcggcgtcagagtccccactagacccagtggaaggggttagagaccaagtaggggccagtttccaattcaccctgtcagggagtgagccggatctgacgttccttgtgacttaagggtccggcttgggaattaaagtttgtttctggcctttagccta

SEQ ID NO: 1671 - DNA, 47224 bp, Homo sapiens
  source 1..47224: mol_type = genomic DNA
ttagttttttttaatttatttttcttgagatggggtcttgctttgttgcccaggctgggcacaatcagctcactgcagtttcaacctcctgggctcaatccatcctgccacctaagccttccaagtagcgaggactacaggtgcacaccaccatgtctggctaacattttgtggagacagggtctccctgtgtgttgcccaggctggactcaaaaccctgagctcaagcgagcctcccaaagtactgggattgcaggcaggagttactgtgcctggccaccatttaattcttgagcattttcttttatattctaattgtccgcttctaatttggccaccgtattcacatcaaggttaagtgacttaacatctttggggataaataaggtgctgattttgtctatagccatcagtttatcatactagatccaagtttgtcaatttaaatcaggtgtgtttatgagcaaagatatgatcatgctgaatgttccatgtgtacttcaggagatacattctgctagtttggggtggtgtgttctataaatgtcaatttaatccagtcggcttatgattttcagttctatattcttactgattaatgtgtatatactagttctgttactaaggagggatgttaaattaatccctagctgtaattgtgcattagtttgtctcttttcagctgttctagcttcataaatttttggagctgttaggtgcatatacgtttaggattattttgtcttcttggtgaactagaccttttatcattaggaaactgtccatataaccactccatttttaattgtttacatggtttttccatccttttaacctatcaatcacttgaattgactttctttatagacagcagatcactgggttatgttggttttttccgtgtctcttgtcattgatgcacttagaccatttacatttaatgtaatcattgatacgtatgggtttagttctaccatttttttttctttttttttttttttttttttgagacagagttttgctcttgttgcccaggctggagtgcaatgacacaatctcagctcactgcaaccaccacctcccaggttcaagtgattctcctgccttggcctcctgcgtagctgggattacaggcatgagccaccgtgcctggcctttttcttttttaaacagggtcttgctctgtcacccagactagaggtgcagtggcacagtcatggctcactgcagcctcaatctcctgggctcaagtgatcctcaagggcctccagagtagcccaccaccatgcctggcttttttttttttttttttttttgtaagtagagacacatttcactgtgttggccaggctggtgtcgaactcctgggctcaagccattgcccacctcaaagtgctgggattacaagtgtgagccaccacacccaaccaggttatttgaacatttttaagtactgtattttctctattgtaatattgactgtcatctctgtgcaggttttttagtggttgctctaggttgaaacgctttgaattcttaggtatctaagagtgagcattttctttttttgactgctatactctcaccagttgccagcttctcatataaatattgtaaatgctctcgtttaggtaactcagcttctggagttgagggaacttcaaaatcagaagagctctgggaatctgcatttgtgctaagatttagcaaacttttttcctcgggtatatgtgtctcactgcttagagtagttggttctccagtactaggaactattgtcacatctttatctctgcttttcaaatcagagtaagtatcctttgggcaaattacattttgttccatgagagaggcaggaatattctctttgattgttggtctgtagtcagctttgtccaaggaagtaatatccccactgtttctctcttgggaagataacaaaacagtatcagattggctgtcccagccttgacttccttgttctgttatgtgtgttgactgggaagaattctgggaggagatgtgagttgattctccatcagagtcactgaaaagctttggtgactgagatccccctgccactgtggaggaagggaagttttccaaactctcatctgtgatttcatcatttcttttaaagaatacttcccactggggtacatccccatcagccttttgcaggtgaagtacagagcccagatctccttgcagtgaagctgggattcctacttcttcttcactttcactgttggattcttcacaatctacaaagtttgtgaaacgagagctctgcatacactctgctctgcagcatcctggggtttgtctcagtttttcaggctgcttttctgatactgcagtcattgaaaatacctcagggtgaaaagtttccgggtatggaactttgtgccttaaaggtattggcagaggatcatcaaagagatagtcatcttcctcctctgtgggacaaacaaaacaggtttataggaaacaaggcaaagggagccaatttgtagtatttatctgtacttttaattcttggaattgcaaagaatagggaggccactcttcttcaaagggaaaagatattcttgggatatgctgaacaatttaactgccatccttcaactttttataataaatgccagagtatcagtggagaatatagagcagtcactctgctctatatgtaagcctggctgatcattacgatcatatgcaaaacttcaaaaaaagaaaaaaaaaaaaaacaggtttctgtatctcattccagacctactgaatccctgaggaagataggaccaaataatttgatttttaagttctacagctgatatctgttcagccaggtttgcaaagcctgtgtgctctgcaaatagtagatgctcagtgggttggctgacttaggaaaattaaattgctttttattaaggtttttcttctgtgagcatcttattgacatgttttatgcacaaggttgcaacaggttaaatcaactttaaagcaaaatactgaataatcaacgtgtcaagaacttaaaattcaaaacattaataagcatgctgtgtcaacaaatgttcttaaaatgaaaaaagccttacttagaaaaacaaatattttcccatcttgtaacagtatctaacctaggaagaaagttaaatgcacccaagactactgtgtatggcaacttcttgttctactgctgaatctggtgttataataatccacttaaatgatgtggctaaacactgcatttttaagacactaatataaaggaccatagagaccattatccagctcccatgttccccgtgtgaagctaggcccagagaaaagggtgtgccaatacacacgacccaacctcattcttaaaggttcagtgttatgacttgtaactgaacttagggcttaaggtcactaagatatctaacgactgtatttggaatcatcctagactgcagaatgtagattttaagccaaagatcatatgtatgttttaggtccctcactactatgccaaagttgttttttgagttttatacagtcacagttcagcctctacctctcaggctcaggagatccacccccatgcccagctaattttttttagacagtgtttccccttgttgcccaggttggttttgaactcctgcactcaggcaatccaccccctcggcctcccaaattgctggaattagaggcatgagccactttgcctagcccaaaattacctttttatgaaatatttttgtatgatctctaagttgaacagttctgcattccaaatcagtgactatgcctgatcccaaaagacatttatcaaaaaggagtgtggattgggtagatgcataaaaggcacaaaagattaaaggaagaaaggacttttgcttccaggtaagatggagtaacggactagatttaacctcccacttgaaataacgaaaaatcagaaactatctctcaagaaaatggacatcgagcaattaaggacaatgacatgagaaataagacacagatgagtcctatgattgcctgactccctgcttcataacagattccagtcagggagggaacatctggatagagcccatggacatccttgatgtgaggtggaagtggaacattgaagaaataaatgtacctggagtttacagagcagaagaccagagaggagagtgctgcacagaaactctgaaaagctgcagaggcgtccccaccacgtgttcagtgcactaagcagcatgtgcttgtaaggaaactacctgcagccaggcaacgaatcactcaaacaaaaggaaagaaagtgcccagaactcaccgtgccaggaacagtgtcttgtcctggtcccaacagccagagtggaaaacctcatgatccatgggcatttgtaaaagaaccaagaagagccttgcctcagtagtggggaaaattaaccatatactaaatgctactctgttcctgcataacaaaggtaaaagacacgaaaagatcaaactataaacatgctaaccacatgccagaacaaagctcaagaatgtttttagaaatcccaaaattatgcaggacctaaaaaggtaaaattcagaatgtatggcattcaaaaacaaattatcagaaattcaagaagcaggaagatacagtcaaaactgactgtaaaattatgtaacatgggagtcaattttcatgatcttggatcaaatagtttcttagatatgacaccaaagcatatgcaataaaagaaaaaaatagacaaatttaacttaaaacctttacgcttcaagacaccatcaagaaggtgaaaagacaagtctgagaaaatatttcctaatcatgtcagataaaggactgataccagactttaactcttacaactcaatacaaaggtcaataatccagttgaaatgggggcaaaagatcagaatagacatttcactgaagaagttacataaatggccaataagcacatgaaagaaagctcaacattagtcattagagaaatgcaaatcaaaactgcagggtaccaccatacactaggatggctatactaaaaaagacggaagtgttggctaatatgtgaaggaactggaatctttacatattgccggagagaatgtaaaatgtattcagtgtgggaatgtttggcagttccttggagtgttaaaacagattgaccatatgttatgaactgaacgcttcctgtcaaaattcatatgtggaagccctaaagccagtgtggctgttatctagagatggacctctagggaaataattaaaccatcataaggctggagacttgatctgcctaagtgctagaattacaggcttgagccactgtgcccagcctaatttttactttttttttaagcagagacaagttttcaccatgttggccaggttggtcttgaactcctgatctcaggtgatccatccgcctcggcctcccaaagtgctgggattataggcgtgagccactatgcctggcctcctgtttaagctacctagtatgtgttattttcttagggcagcccaagccaactatatgactccaaaattctaccccccacaagaaataaaacccaacagaaagatacgtaaagacttgtactcaaattttcatagcattattatttaaaaaggagaagcaacccagatgtccatcagctggtgagtggataaataaaatgttgtatgcctgtacaattgaatattggttggcaataaaaaggtatgaaatactgatatatgccacagtatagatgtaccttgaaaagataatgcgaaataaaagccaggcacaaaatagcacatggtgtataatttcttttttttctttttgagacagagtctcgctctgtcgcccacactggagtgcagtggtgtgatctcactgcaagctctgcctcctgggttcacgccattctgcctccgctgccctaatagctgggactacaggtgcccgccaccacacctggctaattttttgtgtttttagtagagacggggtttcaccgtgttagccaggatggtctcgatctctctgaccacatgatccacccgccttggcctcccaaagtgctgggattacaggcgtgagccactgtgcctggccaatagctgggactacaggcgcccgccaccacacctggctaattttttgtgtttttagtagagacggggtttcaccgtgttagccaggatggtctcgatctctctgacctcatgatccacctgccttggcctcccaaagtgctgggattacaggcgcgagccactgtgcctggccatatgagttctcttatatgaagtgtccagaaaacacaaatctatagagacaaaccatagattagttgcggcctaaggccgggaatagtaatggggagtgactggaaatagacataaagtttcttttttgggtaacaaaaaatgttccaaaattagatagtggggatgattgtacaattctgttatactaacagtcgtggaattgttcacctataatggatgaatttatggtgtatcaattatacttcaataaagcttaaaaaataattttgtattgtggagtttataaagttaataacagagaatgtatgacaataacagcacagactgggagaagaggaatggaaatatactgctggaacattcctataccatatttggagtaatatatcatttatcttttcactctgatatgttaaagatgtatacggtcagtcctctgtatccacaggttccacatctgtagatttgactgaccacagatcaaacatatttggaaaaaagcaaaaattaaaatacaaaaaacacaaaaattgatacagtataacaactagttaccaagcatttacactgtattaggtataagtaatccagagatgattttaagtatatgggaggatatgtgtaggttatatgcaaatgtaacaccatttaatatgacttgagcatctgcagattttggtactcttgggggggtcctggaaccaatcccccaaggatactaagggatgactgcattataagccactaaaataagaaatcagtgagttacacagccaataacccaacaagagattaaacagaatcagtcagtaattacttgacctgaaagaaggccaaaaaagaataaagaacaaatggaacaaatagcaagaggataaacttaaacctgaccatatcaatgggtaccattaaactaagtggactaagcactgcaattaaaagccagaaaataccaggttggccataaaaacatccaacaacatactgcttacaagaaacccactttaaatataaagactagttaaaaatacagagatggaaaaagatacatcaagccaatattaatgagaagaaattcaaatggctctagtagattgtagaactaagaatgttaccaggggatagactcatttcctaaagataaaggtatcaatccctcaagaggatataagaatcttaaacttgtgtatacctattaatagtgcctcaaatagatgaagcaaatgccaatagaactaatcaaggcaaaataggcaagtccacaattacaactggagattgcaacacccctctctggcaataattgatagaacaagaatgtagaagacctgaacaacattgtcaactaacttagcctagttgacatttatagaacacttcatccaacaacagtagtacatatatttctttgaagtacacattaaacatttaccaggtttaatgtgtaaattggtccacaattgatggtccgtaaatattctggaccataaatttcaaaagtaccaggccaggtgtggtggctcacgcctgtaatcccaacattttgggaggcaggtggatcacctgaggtcaggagtttgagaccagcctggccaacatggcaaaaccctgtggctactaaaaatacaaaacattagccaggtatggtggcgtgagcctgtaattccagctacttcggatgctgacacaggagaatcacttgaacctgggaggcagaggttgcaatgagccaagattgtgtgactgcactccagcctggggaacagagagaatccatctcattaaaaaaaaaaaaaatcatacaaagtatgttctctaaccacaataacattaatttagataacagaataatccctgggaagtcctccaaaattcagaaactagtaacaaatttctaaataacccatgtgtcaaagaaaaaaagtcaaaggaaaaatttaaaaatgttttgaatgacaatgaaaacaagacaaatttatgggatgctgctaaagagggaaaattatagcactaaatgcctacattagaaaataaggtctcaaatcaacgacctcagcttccatattaagaaacttaaaaatgaaaagcaaataaaattccaagtaagcagataaagatcagagtggaattcaatgaaatagaaaactaccccgtgccaaaaaaacaaaaaagagagaaaatgaaaataaaaccaaaaacttcttatttgagaagatcagtaaaactggtaaacctctagctagactaatcaagaaaaaaatgagagaagacacaaactactaatatcaggagcaagaggattaatatcagtagattctacagatagtaaaataataaacattaagaacaagtttatgccaaaaaattaagcaacatggataagacaaattctttgacagattcaagttaccaaagttaactcaataaaaaaaaaaataacctgaatagtcctgtgcctattagagaaatcacatttgtagttaaaaaaaaaaaaccttcccacaaagaaaactcctttcccacccagatggcttcactggtaaattctaccagtcatttaagaaagatataatgccaatcctcgaaaaatttttccagagactgagaataaacacctcacaacaatgaggccagcagtatcctgataccaaaaccacacaattacaaggaaaagacaaaactccagatcaatatcccttctgaaagtaaatgagaaaattcttaccataatacttaaaaaggataatatgccatgactaagtgggattagagaaatgcaagtttggtttaacactcaaaaatcagtgtatgtcaccatattaacagagtataaagaaaaacaatatgatcatctcaacaaatacagaaaaagcgttagacaaaacccattatccattgttgatatctctccacctaccaagaacagaagggaagtaattctgcctgacacaaagcctatacttatcattatacttaatggtgaaataatgaacttaatggtgaaacaatgaatgctttctccttgagattgggaacaaggcagtgacacccactcttgccacttgtttcacactgtagtggtagtctagacaagaaagagaaaaacatcctggctgaaaaggaagaagcaaaactgtctatatacacaaacaatgatgatcttatatagaaaccgcaatggaatctacaagaaaaggcactagaactgatacttgagattagcaaggttgcaggatacaagatcaaaaatcaattgcacaggttgcattgcatatccctaatccaaaagtctgacatctgaactacaaaggaaatccttattgcagcattttagattttctgattaaagaggttcaaccattaaatgcaaatgcaaatgttccaaaattcaaagaagtccaaaatccaaaacacttctgctcccaagcattttgaataagggacactcagcctatatttctatatactaacaacaatcaggaattgaaacttaaaaagtaataccatgtgcaacagtatcccccaaaatgaaatacttagggattgatttacacagacttatacgctggaaatcataaaacactgctgagagaaattagagcagacttaagtaaactgagaggtataccatgttcatggatctgaaaattcagtattgttaagatgccagttcttgccaaattgatcaacagatttaaaacaatcctcatcaaaacctcaggagaggacatttttgtacaaattggcgtatgattctaaaattcatatggaaatgcagaggacctaggataaccaaaacaactttgaaaatgaacaaggctggagaacttaaagcacctgacttcaagatttacaaagctacagtaatcgagatgggtgatattggtgtcaagatagagattatgaaacataagaaagaatccagaaaataatctccacatatcttgtaaattgactctcaagaaaagtgctaaagcaattcagtgaattaagatagtgtttccaacaaatggtttaagaacatttggatatccatacagacacacacacaaaattacctgggatctacatttgaaccatatttttaaaaacaaaaatgaatcacagatctaaatgtaaaacctaaaattgtaacaacttctggcagaaaacaggagaaaatatttatgcctttgggtcaaagatttcttagatatgatacaaaaaaaagtaaaaattgataagttcacttaaaatttaaaatttctgctcttcaaaatactctgctaaaaagattgaaaagattacctacagagtagaagaaaatctttgtatacacctgatatatttaaaaaaaaaaaacaaaaaaaacttgtatccagaaacttaggaaaacttagtaatatgatgggtgcagtggctcatgcatgtaattccagcactttaggaggccaaggcaggcagattgcttgagctcaggagtccgagaccagcttgggcaacatggtgaaactccatgtctacaaaaaatataaaaattagccaggcatggtggcatgtgcctgtactacttgggaggctgaagtgggaggatcacttgagcttgggaggttgaggttgcagtgagctgtgattgtgccactgtactccagtctgggtgacagcaagactctgtctcaaaacaaaacaaacccaacaatttaaaaatgagtaaagatttgaatagacacttcaccaatgaagatacatggatggcaaatacgcacattaaaagatgcacaaccttgctagtcattagagaaatgcaaattaaaaccacaaagagctatcactgcacacctattaggatatttaaaattaaaaagtctaaccataccaagtattggcaacgatgtggagcaactgaactctcatacacttctcctgggaacacaaaatggtcaaaccactttggaaaacattttggcagtttcttaaagatacagctaccatatgacccattcttaggtgtgaaagcctacgtccatacaaaagtttgtacatgaatgttcatggcagctttctttttaataagaaagacactggaaacaacccaaaaatacatcaacaggtgaatggatcagcaacttgtagtatatccctgaggtggcctactccttatcaataaaagagggtgaactattgatacatgcaacaacatgaatgaatctctgatgcactgagtaaaataacccagacgtactatatgattctatttatatgaaattctagaacatgcaaactatagtgacagaaggcagatcagtggatgccttggcatgggtgagaaccggagggaattacaaaggggcataagaaaacttgaaggtgataatttcagtatcttaattgtagtcatggtttctcaagtatatgcatatacaaaaaatttatcaaattgtacaccttacatgtgcagtttatatcaattatacctcaggaaagctgttttttaaaaaaaaaaaaaaagaaaaaaaccttagtaaatttgtaaggattagaggatgcattacataatagagttaacatctgaaattaatggaactgtttttctaaaaccttttaattattgaaacaaaaacaaatgtggttttttttgggcaccagttataggcttactatatcagtcttggaattgtcatctaaatgttttaaaattagattctccatgagcagaaatgcagaagcagagatgagacaggcctagattagaatcccaggcccatcacttacttcttgctagtccttagggacttaagtctctaaacttcagtttcctcatcattataattgggatggtaccccttgtaagtttgtttagaggcttatctataacatatgtaagggacctagcacaatacctgccattaataggtgttcaaaaaatagtatcatcattatctcgtgtgttttggtcaagtatttactgcatggcagagtaactgactttccaccaaaggaatgaaaatcaagaatcctaaccacgaaatagggctgctggaaagccccagagctttgctcagaatctaacgttctgattactactgcagagcttgcctctgtccttcactagaaaaatcaaagtagcaatgaaagaaggtacaaagtatagagaaaaatccttctgtataaacactactgatcaacttgatcagaaatgatgatgagaaaagtctattatcagcatttactagtatcttaagaaaatgttcaaggataacaaaccagcctctctatgtcctaagaaaatgttcaaggataacaaaccagcctctctttatggcctctactgatcttagggtgtatttccagaaagctgagaacaccacacacgatggcaccgttttcaccacttgttttaacccagagaaggagagcagactcctgattttacaggctgaagacaggaaggcaaagtacttcctgagaccatgtgtcaagtctgacctgtggtgggtcccaggtccactctgcccaaggccacttctcccagacccaagctccctggaaagcagtgtttgcagggagcccacccctctgaacccaggaccatttttcttacctgagtctcggtgaactgttctagctctcttcagttttcccagtggtttatactttggctccgtactttgggaagaccggcataaaggctttaagctgaaatgaatcagaatatttgatttttccttttgaggaagttgttagaaggtagacatcattgatagtattacaaatttttttgattttgttttttaatttcttggatccctgtttttaacaaaatcttgaccataagggaaatcacacaactactttggaggattgaaaagcagttctaaactgatttcatagttaaaaatcactttgatgtaataaagtggcaaatataagcaattaaatgcaacccggttgatgtttatcttattgttacatcagtagactaaggtaaaacttagatctttgctcttggaatgcaaaaaaagcaggtccctatcctgaaaacctatgaatacagtgacatcctctggcattcgggatacaatataactagctgcttctcctgccctgttcagtagggtttacttatatctcacaggaatctccacaaatttatcttgtcattctaggtccttaggctgaaagctaagacaaagtggagataaaatacaaaaaggcagagaaataagatttgaagacgtcctacccctttcgaaggcctcactgccaactgcctcctcctggcagattccgggaagcctttaggatgatctacaacataccatttgaacagggccatgaggtgcccaacctgaaacttctttacagccacccccattttacgtcctcacccctgttcccacagctgttctctggatccatccccttcaacctttccaggagttctgatccattactgtgtctctttacatcatttcagctattctcctgggttaacttttcaaagtaaggttgtcttcccccacctacctacaacagaattgtctgctagaaatgaaggatgggggccgggtgcggtggctcatgcctggaatcccagcactttgggaggccaaggcaggtggatcatttgaggtcaggaattcaagaccagcctggccaacatggtaagaccccgtctctattaaaaatacaaatattagccaggtgtggtggtgggcgcctggaatcacaactactcacaaggcttgaggcaggaaaatcgcttgaacccaagaggtggagtttgcagtgagccgaggttgcaccactgcactccagcctgggtgacagagccagactctgtctcaaaaaaaaaaaagatgcaggataaggaatgaatatgcattttaacaagcacctcggctgggcacggtggctcacacctgtaatcccagcacttggggaggcctaggtgggcagatcacgagaggtcaagagatcaagaccatcctggctaacatggtgaaaccccgtctctactaaaaatacaaaaaattagccgggcgtggtcgcgggcgcctgtagtcccagctactcgggaggctgaggcaggagaatggtgtgaacctgggatggggagcttgtagtgagccgagatcgcgccactgcactccaacctgggtgacagagcgagactccatctcaaaaaaagaaaaaaaaaacaagcacctgaagtgattcctaaacacatccaagtttatgtatattcaagtttagttctacaggcatatttaagtctcagctattttaagatcaagcctcctgattctgttgcctcctgttgccatcttgtctctaactttcccttcactgtcaaactttttatatagtctgtcctcagtattttccatttcctcactttttacctatttctcgactgaaatctggcttgtaactcacaagtctactgaattgctctcactgagcacacacaaatgacctaattaccaaggaaacgggacacctggtagtccccatattatttgacttctcaagacactccatgggcaccctctgcttacccttccctttgctctcatcccgctgtctgggccactctctccatcttggcccagcttctcctccttcacttctaccttgaatgtgctgcccagggttctggcctcagctctatgatccctcctcccactcctggtgacttcttcttttctcatggttttagttctcacctgcactgccaactccaattctgtgtctccaacccagacctctctccagagattctccatcctcctttccatcgacatctgcaagcctggtcctgtctgtccccatcggggtctgcgaagcagattccctgacacggggcctcattccttctgcacccattgagcttgtgtgctgcctttgcacccggcctctccgtgagactggagctctgctaggacaggctgtgtcttaggcaaattggaacccaagctccattcccaccatatggctggcactaaagaaatcattcatgggccgggtgcagtggctcatgcctgtaatcccaacactttgggaggctgagacaggtggatcacttgagctcgggagttcgagaccatcctggtcaacatggcaaaaccttgtctctactaaaaatacaaaaattagccgggcatgatggcatgcacctgtagtcacagctactcgggaggctgaggcaggagaatcgtttgaacccaggaggtggaggttgcagtgagccgagatcatgccactgtactccagcctgggtgacagagtgagaccctgtctaaaaaaaaaaaaaaaatcattcatgaatgcataaatgaaacccaaagaagaggtaagaaaatggtaatactgtagtaaaagacatccatgaatacgattgcacctctcctttggcttcagttatccattcagtagacacttgacaacctacttggcatggtgctaggtgcttttcttacactatctccctgtatcatctctttcttttttaagaagaccaacaagtaggcatcaatattcctattttgctgattcagaatgactagctcagagaagtgatctggccaagctcacactgcactgttagtaagtggcggagctgggttgcaacccaggagaagctgacaacactacctataccttctgccacactgtggaactaaaggaaacactccaggaaaaaatggaaatgagtatcagttcagaaatgtcccaaaacaaacagattctagacttgtaaacattcaggcaaactctcctttgtgtcctagccaagagccaccaagggggacaccaagtcccacaaccagtgactactcacatttcgacaactttatccatagttgtgccaactggaatgacatttggatatgcgttcacaggacagaggtagctcaagaaatctttaatctagaaaaaggaaaatcacatggatcaacaatctctacgatgaaacaggttgttaggggagataaagggaggctggggaaagagaagcagaactctcttatggctgtggttctcaatgctggctgcacgtggggatcaccagggacctcttgggaaaaaaatatccaatgcctgggcctcactcccaaagatctcctgaacactgagtactagtgggcctagaaatcagtacatttaaatattccccaggtgattctgatccacagtaagagctgagaatcaccaatgggactcaaagattcttttttttttctcttttttaatatattgctttccttgtccaagaaggtcagttgcttatgtttaacaaatcccttttcaaataagttagaatttagctgggcattaactataatatacacaaaaacccaaggtctcagaattgcatttcttagctgggcacagtggtacatgtctgtgatcccagctactcaaggctgaggcaggaggattgcttaagcccagggatttgaggccagcctgggcaacacagagacacctcatctccaaaaaagaacaacaaaagaattgcacttatttactcctaccaataatcattaacgatgccaagagaattacacctttgaggttacttgatttgttcaaatggttcattctcattgggcagaacaccatgcattcgtcactgattccagggaaggatccaaacactgcccattgtaccttggtgttggagtcaccaaggaaaacacaatgcagtcaagcactggagggagcaatgcttcacttactgagaaaagaccaagcaagatcaaatccaacaatgtgcactggtctccagtgaccagtgtgtctctccctgcagccaacacagggcaacctgcctacatgcaaccctctcctgccacacaggaaggaacccccatcatgctgtctgaaataaggacagctggggtgtgcctaagggccattgacacacaggcttaagtagaacaaagggacacacatcaagtacgaagcagagaaagatgtttccacacaaggtactgagctgccgcaggctgtgtgctcacgctaacgggagtgcttgctctctctcactcgcgtgcgctctctctcaataaggaagtgtcccattcttatgtggccagtgagggttgaaagactgtgcacatagactgcctctcccaatgattaattctaaacaaacaattacatgcaaaaacttcatgaataccttgactttttgcaaagttcagaatgctaaacagaggaactctgtcactattcctcaaaacatctctacaacctagaggaacttcagctttgtctcttattagacattggtgagcttgtgatctcagtcaagttacctaatgtctctaattttagattcttcatttaaaagtataaatgagattatgcatgtgaagtgcttagcttggtatctggtgaaacagtcaataaaatcatccaggccaggcgtggtggctcacacctgtaattccagcactttgggaggccgagccgggtggatcacaaggtcaggagttcgagaccaacctggctaacacggtgaaaccccgtctctactaaaaatacaaaaaattagctgggtgtggtcgtgggcgccgtagtcccagctactcaagaagttgaggcaggagaatggtgtgaacccgggaggcggaggttgcagtgagccgagatcacgccactgcactccagcctgggcaataaagcgagactccatctcaaaaaaataaataaataaaaattaaaaaattaaaaaaaaaatcatccattactaagttgataatgagaacacaaagacttttatgcccttctgcaaatggacagactagaacccaatgtaattattagtatcccaccaaactgaaagaggcagaaacccaagaattgccaataactctacataaaaataaaagggctactttaagacagtggaaaggcaggaagatctattctttaaatagttttcacaaacagtatcttttgtaccttcacaggaggcatgcaaatagaaatcattacctgcccgcccaacaccgatttgatttgcacaaagctgaggctggtagaaatctgagacttttgaagggaataaaggatttaaaaaaaaaaaaaaaaaaaaaaagtaaagtcaagcctataccagaaatggttcactactacttctcagagatgaaatggccccaaggagataagagacacccaataaaggagcaccccctctcatttatataagttgactcccttttatcaaatgcctgccttaaaataaggcatcaatagcgccaattctctttattcacagtagttatactctataaattatagtcaccataaatgctgaattagcaaatactgagccattgctgctagggaaaatacagggttcctgccatcctttggtgacatcgttttcaccagccaattaatacataaccttgttttatgtgtgtttctgttgaaagacaccttatttaatagacactttgatccattaacattgaactcatggtcaatagccctataacccatgcctatctaacatacatattttctctagaagccacgttacagtcctcccgtgcttaggaacactcgataggacttcagtattatgactggtcaccatttaaataagatcaccaacaaaaagcacaaaaatatgaaaaacatggcacttaatagatggcaaaaaggaaactttcgatatggtttggctgcgtccctacccaaatttcatcttgaactgtagcttccatcatccccatgtgtcggagggaccagtgggaggcaatttaatcacgggggtggctacctccatactgttctaatgacagttctcacgagatctgatggttttataaggggcttttccccactttcactctgcacttcttgctgccgccatgtgaagaaggatgtgtttgctatgattgtaaattccctgaggcctccccagccctgcggaactatgagtcaattaaacctctttccttcctcatacccatctcgggcatgtccttagagcagcaggagaacagactgatacacttgttgacagagtaagagctgaaagaaggcagagcattgccttgttctacctgagccgagaacgtgcacgtcaggtgattcaaaattttcaccactctccacaagtccacaaaggatcacaaaagcactgtaaatattgatactgaggtcacaggtcagtttcagtgagtaggccaacacataaaaatagaatccatgaagccaggtgcagtgacttacacgtgtaacccagcactttgggaggccaaggcagacggattacctgacgtcagttcaaaaccagcctggccaatgtggtaaaaccctgtctctgctaaaaatacaaaaattttagctgggcatggtggtgggcacctgtagtcccagctattcgggaggctgaggcaggagaatcacctgaacccaggaggcagaggttgcagtgagccgagaacacaccactgtaccccaacctgggcgacagagtaaaacactgtctcaaccaaaaaaaaaaaaaaaaaggaatccatgaataatgaggatgaactgcatttaggaaaaaaaaactaaaaggaaatgaaacttacatagaaacagagatgcttctgagagtcaggggactacctgtcaactaccaaggctgcagaacactgagcgataagggttatgagtatatgggatcctcttacctcactgtaggaggagtgaaaagaaaaacaagctctgtatgaactctctccagtcctaaagggaagtgaaaacacaaaataaaaagatcactgagcaaaactaaaactaagcaaagctggcccttctcatttaggctattctagcatgaaaccactctaatgggctcgcttcagcagcaagtgtcgaaatcaccctaaatcaggaatttcttcttgggatagcagggaaccttttccagaagtggaaacctgttgtagaccgcgtgtggtggctcacgcctataatcccagcactatgggaggccgacgcgtacggattgcctgagctcaggagttcgagaccagcctagcaaacatagtgaaactctgtctctactgaaaacacaaaaagttagctcggcatggtggtagtacatgcctgtaatcccagctactagtgaggctgaggcaggagaatcacttgaaccgggaggcagaggctgcagtgagctgagatcacaccacttcactccagcctgagtgacagagtgagattctttctccacacaaaaaaaaaagaagggagggagggagggagggacctcttgcagatattctgaacagccaaagttaaggaaatgttgctaaaatattaagatcattatagtcactcctctattccaccaagggttctgttctctctgacatcagtttttcctcttagccaagcactcagatgggagggagggagtggggggggagaaaggagagggagggaagaagggatggaggagagggagggagggagggagggacctgttgcagaaattttaaacagccaaagttaaggaaatattgctaaaatattgtgatcatgatagtcactcctctgctccaccaagggttctgttctgtatgacatcaatttgttactctaagccaagcactcagatgccttcagtctccaaccatctcatcaacctacccagagggaacctcaggatacaccagctgatgggagtgtaactggtttgggagtagcatcccctccatttaaataaaatttaaatttaagaaattaattataatatataattatattcttgggcttaggctagactgtgcttaaatgaaattaaatcagacaatttactcaaagtttctctcagaagacctatgatattgctctcttacctcacaattacatttgtttttctgctcctttctccaaaccacatggtggatggcttaatgctgattatgtggagtggaattctatttctggaagtaattccacagggtaatttgctccactgaaaatattcctctgcctaaaaaagataaaaagcatagaaaaacagttctacattttctacaaatctgttgtaggcagagtctcaaaaacaaaagtagaaaagtttccagacacgaaaaaataaaaaataaaaaaaaagcagcaaaacaatgtagacatgaagaaacaatcagataattccaaattggggaatattgtgcaaaacaactgggctggactcttcaaaaccatcaatgtgaagacaagcaaaaggctagacaaacgatctatatatcaaaggagaccctttagacctgactgaacgcaatggacgaccctcaaataaatcctggatgcccctgtccccctattctacaagctataaaggacactatgggaagaactggggacatctgaacacggactgtgtaacagctaatagtactatatgaacacaaaatgttctgaggaagggtattgtactgtggttatataggaaaatgttcttattctcaagagccacaggctgaaggatttggggtgacgtaccatggagtctgtaactactctcaattggtttggagtggggagttggttataagtacagagacagaggaagagaggtgcaaagtgttggcaacgcagcaaatccaaacgaagggtgtatggtgtttttttttttttttttagacagtctcgctttgtcactcaggctggagtgtggtggtaccatctcaactcactaaaacctctgccttctgggttcaagcaagtctcatgtgtcatcctcccaagtagctgaaattataggcacacaccaccacacccagctaaattttctatttttagttacaggatttcaccatgttggctgggctggtctcgaactcctgacctcaagagatctgcccaccttggcctcctaaactgttggaattacaggcgagagccactgggcccagacccttgtaccagtcttacaactttactgtttaagaagttttcagggccggttgtggtggcttatgcctataatcccagcactctgggaggctgaggcaggtggatcacttgaggtcaggagtccaagaccagtctgaccaacatggtgaaactctgtctctactaaaaatacaaaactagccaggcatggtggcgcatgcctgtaatcccagctacttgggaggctgaggcgggagaatcgcttgaacccaggaggtggagattgcagtgagcccagattgcgccactgcactccagcctgggcaacggagcgaaactctatctcaaaaaaccatttttttttaattaaaaaaaaaaaaaagatctcagcctgggcaatatagtgggattccatctctacaaaaaaatgtaaaaattagccaggtgggtggtacacaactgcagtcccagctattcaggaggccgaggcaggaagatcacttgagcctggggggtcgaggctacagtgagcaatgattgcaccactgcactccagcctgggtgacagagcaagactctataaaataaattcattaattcaaattaaaaagttttcaaaataaatttggagggaaaaaaactaacaaatacaagtgttttcaaaaggttgaaaaaaaatgggacaacttttccaaagtcattattttgaaatccagaaccttccaaaccattaacgttccatcccactcaaatttctttggggtgcctttggtgctgtttcttaggaaggtgcagattagagttaagagtggactctatgagctgtggacctacctgttaatattctaaaggagtgcgtgacctaaaaaaatcttttaagcggctagaaatagcatctcaaggaaagtagccctgacagcaaaggaattactaactaagctactttgtgggatgtgagaaaattcacagcaaaaagaaatttgccaattcaaggatttatggggcaaggggcccaatactatgagtccaacagaaaaagggacaaaaaggtgtatgttttatttatttacttgagacggggtttcactctgtcacccaggctggagtgcagtggtacaatcttggcttactgcaacctccacctcccaaactcaagcaattctcccacctcagcttcgtaagtatctgggactccaggcatgcaccaccacactcagcaccttttttttttttttttttttttttttgtattttttgtagtgacggggtttcaccacgttacccaggctggtctcgaactcctagactcaagcgatccacctgccttggcctcccaaagtgctgggattacagatgtgagccactaagtttatgggttttgtttgttttttttgaggcagagtcttgctctgtcacccagactggagtgcagtggtgacatcttggctcactgcaacctccgcctcctaggttcaagtgattctcatgcctcagcctccctagtagctagggctacaggcacacaccaccatgcccagctaatttttttatttttactagagacggggttttgccacactgagcagactggtttcgaactgctgacctcaagtgatccacacgcctcggcctcttaaagcactagcattacaggcatgagccaccacacccggccggtttacgttttatgtatacatttttatccatccaagaatccactggacgtgtctgtatatgtgaatatatatgtgtatttatatgtgcatacatgcacacaaagtgaagaaataaatccctgaatgcaacatagaatatgcagcttaccaatcagcaaaaataatttacactgcagctctcaccgtggcctacaggaaaacattccatgctgtggatcagaattctctcttgtttgaaattatgctttatcgtaagggctaggcaactaggcttttggctaatggaaccattattactacaataatagtgatctaaatgaataaatgcaatgtttactttaaaaattacacaggatttaatgctaaggtattttaaaatttagagaaaaataatgatcactcaaaccactacatttaaagatcactaattagccttaataattttaattgaaacaatattttttaaagcaaattcaaaatgaaagtcttgtactcagcgtttgacaagagaaggaggttctgtgttggcattagaaaacgaatgaggctgggtgtggtggctcatgcctgtaatcccagcactttgggaggccaaggtgtgtggtcacgaggttaggagttcgagaccagcctggccaatatggtgaaaccctgtctctactaaaaatacaaaaattacccaggtgtggtagcgggagcctgtaatctcagctactcgggaggctgaggcaagagaatcgcttgaatgtgggaggcagagcttgcagtgagccgagatggcaccattgcactccagcctgggccacagagtgagaccatctcaaacaaaaaaacaaaacaacaaaaaacaaaagaagacaaatgacatgtgacttgcaaagacactggaaacatccattagaaataggaccatcaagacatgaaactattttaaagtgtgaaaaaaagttatgtctagatatttatctcaagtagaagaaaaagtttataaacacgctcatgtcatgagtctcaaaaagcacaggatgggcgcagtggctcatgcctgtaatcccaacactttggaaggccaaggagagcagatcacttgagatcaggagttcaagacccccctggccaacatggcgaaaccccatctctacttacaaaaattagccaagcatggtggtgcatgcctgtaatcccagctacataggaggctgaggcaggagaatcgcttgaactcaggaggcagaggttgcagtgagccaagatggccccactgcactccaacctgggcaacagagcaaggctcgtctcaaaaataaataaataataaataaatcaataaaattacaaaaattagccagaagtcatggtgcatgtcggtggtcccagctacataggaggctgaggcaggacaatcacttgaacctaggagatggaggctgcagtgagccaagagtgggccactgcactccagtctgggcaacagaaggagaatgtctcgaaatatataaatacatatataaatagcacaaatgtttaagttataagctataatatattactgatttcattacaaataaatttgaattatcaaacgtgtatgaatagatttcatcagaaaactataaagatctggttgggggtggtggctcacgcctgtagtaccagcactttgggaggccgagggaggcggatcacgaggtcaggagattgagaccatcctggctaacatggctaacctcgtctgtagtaaaaataacaaaaaattagccgtgcatggtggcgggcgcctgtagtcccagctactcaggaggctgaggcaggagaacacgtgaacccagggggcggagcttgcagtgagcctagatcgcaccactgcactccagcctgggcgacagagtgagactccatctcaaaaaaaaaaagtacagatctgtgtctatttactagtgacgaaaagtgtggtcatggaatatggcaatgtacagttccatgaccttgagctaacaacttaggattgcagcctcaggttttacatttgtaaagcgaagagcctataaatggaagccctgacctttcttctttttcatagattacacaaacaatacgagaggaatcacttgcacacgtaccttgggatgccggcatgcatggatctgagtgttgcggtctgttgtgagatgatgaaggatctcaggcatgttcctaaacatgtctagcttattcacatgaacctaaggcaaataatacatacatgcaaattatgtgaaatgtatttcctataaattgttcaaggttaattactcagggcaaaacacccagttagtgaattaaccctctcttctttcttgaaaagtagtttttggctattcagtgcactctggtattccgccagcatgtcaacaggcacaaggctgactggccaggatcgctgccatcactgacgtcagtgaacaattatggacactcggctcagggatgtcatttaatgatgttaatgttgtccttcagtccttcaagagaaattcagttaatattcctcgtacacctactatgtgtcgagctttattctaaatgctgggaataaagcagtaatccacacagacaaaaacaatcaagaatcatctaccctcagccaggtgctgtggcttatgcctgtattcccagcactttgagaggcggaggccggtggatcacttgaggtcaggagatcgagaccagcctggccaacatggtgaagccccatctctactaaaaatacaaaaattagccaggtatggtggctcaggcctgtaatccaagctactcgggagtctgaggcaagagaatcacttgaacccaggaggcagaggttgcagtgaactgagaccgtgccactgcactccagcctggacgacagagcaagacagtctcaaaaaagaaaaaaaaaaatcaagaatcaccttaaaggcatatacatgatgtacaacagaggagcatgtactgcaaataatccactgccatatctccttgttcaaatttattttcaatgctggtcacaatcactaaatttatttcatgacccaaagtttgggaaaaatactttgtctatgcggcatttcactgaaggctcttgtaagccattttggcttctgtcaattttctcccaggaggatgtgactgaactaagatgatatattccttcagagggcccgcgaacctctgctgcagacacgtcttgttagggtgcttccatctgtccctgtttgcagttatttagcaggcgaggagggggaggaaaggtgagctgggaggatggaagggagcaagagaaaagaatgaacagactgggaacactggctcaggcctataatcccagcactttaggaggccgaggcaggcagatagcttgaggtcaggagttcaagaccagcctggccaacatggtgaaatgtcgtctgtgctaaaaatacaaaaattagctaggcatggtggctcacgcctgtaatcccagctactcaggaggctgagccaggagaattgcttgaacccgggaggtggaggctgcagtgagccgaggtcgcgtcactacactccagcctgggcaacatagcaagactccctctcaaaaaaaaaaaaaaaagaaaaaagaaaagaaaagaatgaacagtcaccatacctggactcctaattcttcactaaggttggtgaacagatattcatagccataagccgctttgcagttcagccacacaacatggtacgggctccgagtgatccagcttcggaccagctctaagactccacttaaacactcctcctagacaggattttaaagagacatttaacaggtggagagccgcacatagccttttccttcccaacagtcccaggtactcacacctacggggacagttaggatatgacctgtcaccctacaaacttcctactaaaaacacgggcacacccagatgataaccctgttcctccaggcagacttacccgacttggaatttggtaaaatcttggatcacagaacgtagtatccaaatatacactttggatgtctttgactctgaaaagaaaaaaaattgatgttagccatccaatgtgatataaattatgtgtaactttttttgttttttgagatggagtttcgctctgttgcccaggctgaagtgcaatgtctgctcactaccacctcctccacctcccgggttcaagcaattctcctacctcagcctcccaactatctgggatcatgggtttgtgccaccacaccttgctaatttttgtattttttagtagagacggggtttcaccatgttgaccaggctggtctcgaactcctggcctcaagtgatgcacccacctcagcctcccaaagtgctgggattacaggccagaactcccaaagtgctgggattacacccggccagagcaataaaactttattcagtcatacacagaagaactgtacaagaggccaggcacagtggctcatgcctgtaatcccagcactttgggaggccaaggggggcagatcacctgaagtcaggagttcaagaccagcctgcccaacatggcaaaaccccatctccactaaaaatacaaaattagctgggcgtggtggcacgtacctgttatcccagctacttgggaggctgaggcaggagaatcgcttgaactctgggcgacacagcaagactccatttcacaaaaataaaataaaataaaataaaacctatacgaggcccagtacctgcccccggagtgcagaagctccattctagcagcttctccttgcgccaatctgaagtctcctgtgtacaggacagttccattattgccctgaaataaaaacctgaaaaagaaatatatcccagtgacttctgagtctcatataaactcccaataaagcaaatacatgtgagctgcatactaaatgcttcctgcaaacatatccattacaatacaatggtaatggaattccacagtaatttgaaccacaccaggcactcagctgtcacctcttccctcgggtagaaaataacagaatggagatgctacccagtttgtaatagatgttccttgtgatatgttagcactttcaattatatgttgagatcattcttgctcatggagagagaaatacacgtgatgataaaatacaaggtcactggggaaacagctgctgaagacttccatttatttatttttattttgagataagagtcttgctctgtcccccaggctgcaaggcagtggctcaatcttggctcactgcaacttccaccttctgggatcaagcaattccccagtagctgggactacaggggtgtgccaccacacccggctaatgtttatactttttgtaaagtcaaggtttcaccatgttggccaggctggtcttgaattcctggcctcaagtgatgcacctgccttggcctcccaaagtgccgggattacaggtgtgagccaccacacctggccatgaagacttccattttataagaaacgtttcaaatctgatcttcacctcagtccccctagttcaatttgggaacaaatgtgttttaaatgactagaaaaaaaatcaaatctccctctatgtattctttctttctttttttttttttttttaaaaaaaaaactcactgcagcctccaactcccaagctcaagcaatcctcccgcgtcagcctcccaaagcactgggattacagacatgtgccactgcacccagccccctattaattttagaccctaaaaatttatttctacaaatacaatatgtgtctacatataataaaatgacaaaataaatgacccccttacataactgatcccggacagtgaccagctggtaagagagtcacaacaatctcttccttctaaaaagaaaataaagaaaaaatagtaatggaaagcagttatcattaggacctagctcaacaaagccctccttcacagaacacatttatgtaccttttaacaatgtgccttttctcccaatttcctcacactccaaatcctagaaacaagtggaatccttgtccactcaacaaacagaattcccatgggactgagcaatttcaccactagttatagaaccaagataagcgaaaaccgatggccacacaaaaatgtgtgcctgactgttcacagcagcattcttcatactagccaaaaggtggaaccagttcaaatgtctatcagctgatgcatcaatcaggaaaatgtggtctagccatacaatgaaatattatttggccataaaaagaaccgacacgtgctgcaacatggatgatccttgaaaacatcctcagtgaaagaagccggataagaaatgaacacatgttgtatgattccactcatatgaaatatccggaataggtgaacccatggagacagagagtccaatacagtagtggttgccgggggttggggaaggagagaatagggagggattgcgatcgctaaaggcttcttcccttggggtgctgaaaatattctgaaattgattgtggtgatggatacacaagtgtgtgactcgatttctatctcaataaagctatttacttttttttttttttttttttttgagatggagtctcactctgtcacccaggctggagtgcgatggtgtgatcttggctcactgcaacctctgcctcctgggttcaagtaattctcctgcctcagcctccccagctgggattataggcgcctgccatcacgcctggctaattttttgtatttttagtagagatggggtttcaccatgttcgccaggccagtcttgaactcttgacctcaagtgatacatctgcctcggcctcccaaagtgctgggattacaggtgagagccaccaagcccggccactatttaacaatttttaaagcctgagccaggtgcggtggctcatgcctgtaattctagcactttgggaggccaaggtgaacgaatcccttgaggtcaggagtttcagaccagtctggccaacatggcgaaaccctgtctctactaaaaatacaaaaattagctgcgcatggtggtgggcagcacctgtaatcccagctactcaggaggctgaggcaagagaatcgcttgaaaccaggaggtagaggttgcagtgagccaagatcgccctactgcactccagcctgggcgacagagtaaggctcagtctcaaaaaaaaaaaaaaaaaaaaaaaagattaaagcctggatgaggcctggtcccgattcacactgcacatcatactgttcggcaagggcaagacctgcaggcactactgcctctccagccatcagtaagtggggagagctctgcacacaccaggtcactgctcagtgacagggactcctcatggaagtctccattcattctggaggaccctttcgagtgggtctccccctggttggagctggataaacaatgcataaaagtcatggcacacaggaagaaacataaaaaatcaaagtggtggcaggactgctcaaaagtcagcctgctgtcggcccccagttcagggaatgcctttcaccaatatccctgattgtgacaaggccacagaccaccacagtattccccggaaaagcagttggcagagtccaggatggcatttacaaaggttcacctattttttttttcctttttaatcctcactaaactggctctgtagtcctccctcaggataatttgatgggaagaatacttcaacttcaactgtctgatcttcaccaaagaagaaatatctgaaaaggtcagtttctgttcaacaacacaacacaccctcaaagttaaacacggcaaagcagtgtgctataatcaagcaacaaagccaatattaaccaaaataggaaaatacctaccagctgtaaaggttaaaaaaaggggggctgtatgtctatagtcctacttattaaaaccatacattcacaaaagtactacctcaaaatttaatgatgaaaaataatttttttccacttggcagagccccttttctgaataagggttcagaaaaaaagtacaatattcatgaattacctgcaaaaatattaatcaccattttaaattctgagcattataaaactcagtaaatgtgacaataacatcatgtagtaatatcaacaccagggttcccatcattagcatgtaataaggaacaaatgtgacaaaaaataagccatgcccaatcctttacaacatgggaaataaatacatcactgttaaggactaaatgttcgtgtccctccccaaaattcctatgttgaaatcctaacccccaaagtggttttattaggaggcttttgggaggtgattagttattgggcatagaagccttgtgagtgacatcagtgcctttataaaagacacccaggggagcttgtctgcccctttactatgggaggacacagggaaaaagacagcatctaagaaccaggaagtggccaggcacagtgactcacgcctgtcaccccagaactttgggaggccaaggcaggcggatcacttgaggtcaggagttcaagatgagtctgaccaacatggtgaaaccccttctctactaaaaatacaataattagctgggctctggtcgtggtggcaggcgcctgtaatcccagctactagagaggctgaggcaggagaatcgcttgaacccaggaggtggaggttgcagtgagccaagatcacaccactgcactccagcctgggtgacggagtgagactctgtctcaaaaaaaaaaaagaaccaggaagtgggccctcaccagacacgaaatctgctggagactggatcttggatttccagtctctagaaccctaagcaacaagtgtctattgtataagccactcagtctacggtagttttgtgagtccagcccaaatggacttacacaatcacaaagggatttttttgcccctaaaaccccactcaatgactagatttttatttatggttaaatgagcattcaaaatcaaagagaaagattgagggtatagctgaggggtggagcatctgactgcaaaatcaaagagaaatataaacaatcattttagcaccacatttttttaaaaaaatcaatatttaatatttagttacctctcctgatgcttcatccactaaagatatctgggtaggagtctcgatttcaatagatatctataaaaataaaataagagaccatgtatatagcagtttttcatggctttatatgcctttgctgtctgaaacacagaaatggggcaaagagaagtttcagactctctatataaacaattccgattacattgtaataaatattttaacagttagaaaaaattgtaaagaaaataatacctgtcttgaggcagatttggtaatacggagtaaacgccttgtaaatgcatataatcctctgacacaattctgtttccatgaattcatttttcctccttcatctccccatccctaccactcccattcccctctctctctgaattctgagtctttgtaaaaacgtggtcctgtgtcctaacttttgtgcctcagaacacagtctggatgggtctgtgacatggatgcttcatacacggttcttttattttttttttttttctcagatgcattctcgctctgtcacccaggctggagcgcagtggtgtggtatcggctcactgcaaccaccgcctcctgggttcacgcgattctcctgcctcagcctcccaagtagctgggatgacaggcgcccgctactacgcaaggctgagttttttgtacttttagtagagacagggttttgacatgttggccaggctggtctccaactcctaacctcaggatcaactgcctcagctttccaaagtgctgggattacaggcgtgagccaccacacccagcctcatgcactggttctaagtgctgccgaacgctccctggtacatttccccctgccatcaaaacagagactagcacataagaggcattcagtaagtatctgatgaatagatcaatgtgatttttcacctttttagtccactaatgtcctaaaacttacagtgtctaaggtttgggtgttaaagtatttttgcatttctggaatgaaacatcttattcatgatgtactatttaacactgctagattcagttactgtctttatgaggattcttacattttcatgtatgaaatgggtttttccccatttattatttttgagatagggtctcgctctgtcgcccaggctggggcgcagtggcacgatctcagcttgctgcaacctctgcctcccaggttcaagcaattctcctgcctcaccctcctgagcagctgggactacaggcacccgccaccatgcctggctaatgttttgtagcagagatggggtttcaccatattggccagactggtctcgaactcctgacctcaggtgatccctccacctcagcctcccaaagtgctgcgattacaggtgtgagccactgagctagtcctcttttctaatatatctatttaatgctatcaatttcccttcaaggacaaatttagctatgttccacacattctgacatgccacatttccattgtccatcagctcctttatttatttatttattttgagacaggctctcgctgtgttagccagcctggagtgcagtggcacagtcacggctcactataacctcaaacttcggggctcaagtgatttttctgcctcagccttctgagtggctgggactacaggcacactctactataccaggctagtttttaaggtttttttgtagacatggggttttgcagtattgcccaggccggtttcgaactcctggactcacacaattgtcccaccttggcctcccgaagtgctaggactacacatgagagcccccaagcctagccatatcagttctacatattgtatgttttctttatcgtacaatttcctttttaaccaaagggtcagttattgtatgcatttagtttccacgtgtatgggaagattttagctgtccctttgtttctgatctccaacatcattgccttcttttgtgacacagtacatggttagtttttgtaagtgtcatgagcaccccccaaaatactattttcttccttgggtttaaagttctgttcattagtccacattcacacattttctgcatcctgtttcctgcctccttctttcagcatctgggaggggcatgttaagctcttcagtgacaattgttgatttcctatttcttgccctgattctgccgtggccttgtttgtactatgtcaactcacctaagctggaactgtttcctagaacccctttccatgttgttgcccacagtaaacattaagaaggcagatgtgaactagtagggattttttaatgctctgaagggcgccagaaatggtaacagctagtgaacattgctgaccttctggcttaactcagagtctggggcagggccgcagcaacatcagcttctgctgggtgcccgtgtgcagctcctccgagtcctggggcaggtgcatgtgcttcagagccaaagcgggagaccagcactattgaggccagaggaagtgagagacagaagtgggtttcggtctgtcctagtgggccattctgccttccagtttgtctctgttcccctccacttctcttccagctttccttcctgactgctggccgggctgacctgtagtaacttcaagctgaatgccagagacaacaggaacaaccctgctgttgtgactgctctgcagagggaggacaaatccccttctcaatcaaaggtcagatgtggaggtggatgatatcatgcacacaaacacacgtgcacacactatgtgtgcatactcacacacgcatgcacatacacacacgcgagcacacacacgacagagaatgagaagaaaacttcagtcacatcacaggactttcggggagggcagtgcagtccctgagctggggacagaagtgtttcctgtggcttaagagagagtaggagcaagtagccctggtttccactttggtgcgggttgggcctggacatgcctggtttgaacttcgccttagtgctaaggcaggcatgggcctttttgtcagcttgcccaaatgtgggtaggagggaggcactggctgcaagcagcttaagagcaaacagaagcccggcatagtggctcacacctgtaatcccagcccttgggtggccgaggcgggaggatcacctgagggcaggagtacaagaccagcctcgccaacatggcaaaaccccatctctactaaaaaatacaaaaattagccaggtgtggtggttcaggcctgtaatcccagccactagggaggcggaggcagggagaattgcttgaaccggttagatggaggttgcggtgagctgagatcacgcctctgcgctccagcctgtgacagagtgagactatctcaaaaaaaggaaaaaaaaaagtaaacagactctttgtgacactgggacaaattgctctgccaactcccacaatgatttaagaactaatccatgtaatgaacccacattctgttaagtcattgtggttctcctcagatcaagcactgggtgacaggttctcgcagtttctacttcagctggatgctattttgtcaattgcacatacgtccatatgacccatggctccttttaacagtgacaccctcttcaaaccttgtctttctttgccttctagtctactttctgatattaaaaactgccactctgacattttggccttctgattggttagtaattttttcttcttcccccaaaatttcaaatttcaacctgtatttatccttctgttttatctatgtctcttatagactaatactcatgaatttgtctaacttttttgtttgtttttgaagatggagtctcgctctgtcacccaggctggagtgtagtggcacgatctcagctcactgcaacctccgcctcccaggttcaagcgattctcctgcctcagcatcccaaggagctgggactacaggcaccgccaccacacccaattttttgcatttttagtagacacggggtttcgccctgttggccaggctgttctctatctgacctcaggtgagctgcccgcctcggcctcccaaagtgctgggattacaagcgtgagccactgggcccagccagatttgtctgatttttttaacttaaactgagaatttgtcttttgaccaaaggtacaattaaatcctttcctatatatagtcatatataattggactttttctgccttctttgcattttctattcaccagactttttcctccccttgactacctcatattggacagatgcattttattctgccagaccgaaagttacccattctatctgtattcttctagctgtcatcccttccttatgacagcctgtaatttgtttatttttcttactctatcccacaatttaaataaaaggatttagcaattatgttaatgaacactttacactctaaaatattaaaatgtggccaggcatggtggctcacacctgtaattccaacactttgggagtggatccacttggaaccaagtgggtggaaccaaggtgggtggatcacctgaagtcaggagtttgagacctgcctgaccaacacagtgaaatcctctgcctactaaaaacacaaatattagccgggtatggtggtgggattctgtagtcccagctacttgggaggctgaggcaggagaatcacttgaacccaggaggcagaggttgcagtgagccgagtttgagccactgcactccagcctcggcagcagagcgagactccatctcaaaaacaaaaaatagaaaatattaaaatgcatcttagcaagagggtcaatgagattaagcaaacaaaactgagacctagatctcactcttgaggaagaaggaaaacatatcaacaactaccaaatgttgacttctgccatattgttcaatgccaacagacttaattttttttttcttttttttttttttttttttagatggagtcccactctgttgcccaggctggagtgcagtggcgtgatctcagctcattgcaaccattgcttcctgggttcaagcaattatcctgcctcagcctcacaagtagctgggactacaagtgtgtgccacgacacctggccaaattttgtatttttagtagagacagggttttaccatgttggccaggctggtcatgaactcctgacctcaagtgatccatccgccaaggcctcccaaagtgctgggattataggtgtaagccaccatgtccggccagagactcaatattctaattaatgtggataactgaagtatgttacaaactgaggcaaagtttttgtcaatctacctctaaaaatacttcccacttaaaaaaaattaagttattaaaaaaataaaacttacaattcgtttcttccaaaatctgtatttcgggctcgttaacaacaactccttagtcacaggtgaacagtatagataaaccttcaagctgaaaggaaaaaagaaaaaaactttcagtacaatccaaaatgagccatcttggtgactaagaaatctatttcatcatacatctaataatttcatttgagaccagtctgaccaacatggtgaaaccccatccctaataaaaacacaaatactagcctggcatggttatgaaatctatttcatcatacatctaataattcagaaattacgctggcacaaaatctgttagagtcactctcaacatacctatgcacaccatttcagtgccaccaagagcacaaggtgggggtggaaacacggtgtccctggacctcctccaacagtggtccctcaccattgttacttggaaatacgcgcttgtatgtgatcaggtgtgtctggaaagataccgccacacattacactacctctggaaaaggtgtgttgagaacagaaacttctgctttttactgtataagtctattctttttttttttttttttttttttgagatggagtcttgctctgttacccaggctggagtgcaatggtgtgatctcgtctcactgcaaactccacttcccaggttcaagcgattctcctgcctcagcctcccgagtagctgggattacaagcacgcgccatgatgccggactaatttttgtatttttgtagagatggagtttgaccacgttggccaggctggtctcgaactcctgacctcgggtgatccacccacctcggcctcccaaagtgatgggattacaggcgagagccactgcgcccggcctattctttttttttttttttaatgaacagaaattaatttcataataaactttttttttctttttttttgagatggagtcttgatctgtcactcaggctggagtgcggtggcgcgatctcggctcaaagcaaccttccgcctcccgggttcaagcgattctcctgtcttagcctcttgagtagctgggactacatgcgcaccaccacgcccagctaactttttgtatttttaatagaaatggggtttcaccgtgttggccaggctggtctcgatatcctgacctcaactgatccacccacctcagcctcccaaagtgatgggattacaggcatgagccaccgcgcccagaccataataaacttttaaaacttaacgctatcattttgaggttaggaatatagtctacggtagattgtattttccaaagatggccacacaatgacatacaccatccatacatgctctccttacaaaatagatactaaaattcctccactgactggcggggtctatgttccctccccttgaacctgggcagttttctgtaattaccttcaccatagaatgcggtggaagtaattgcatggcttttgaggttagatctccaggtagtacaacttcctcctagctctctcttaggacatacgctttttaaccctgagtctccatttaacaggtctggccatcctgacagactcacgctaaagagatttttttttttagggggaggggagctcactgtcacccaggctggaatgcaagctatcctcccacatcagcagcctgagcacctgggactacagcacatgccaccacacctggctcatttttcctattttctgcagagatgaggtctccctacgttgcccaggttggtttcaaactcctatgctcaggtcatcctcccacctcagcttcccaaaggcctgggattataagcctaagccactacgcctggcctaaagagacttttagagatagagatgccgcacgcctgtaatcccagcactttgggaagccaaggtgggcagatcacttgaagtcaggagtttgagaccagcctgaccaacatggtgaaaccccatctctactgaaaaataaaaaattagttgggcttagaggcacgtgcctgtagtcctagctgcttgggaggctgagctgggagaattgcttgaacctgggaggcagagattgcagtgagccaacatcacgctactgcactcctgcctgggcagcagagttcgactctgtttcaaacaaacaaacaaacaaacaaacaaacaaaaaaacatgccaaatggttctagcccctagctgtgtgagttttcccagcccaggtatcagacatggataagggagtcttcagatcttaaggggctgacatctgaagactctgctcactgatgtttgatacctgggctgggaaaccattcccattctaccctgtcaatccctgatccacagaaactgagcaataagacatgatcagtgttaagtcactccattttgaagtaatttgttacgcagcagcagatgactgatacataggctctgcaatcagacagacctggctggaatcctggtcctgccacttactggctgtgtgacactgggcaactaatttaacctctctggttcctcagtttcctcatctgtaaaatagaaataatagtaggatctattcaaaaggttatcaagaagctctaatgacaatgtcaggtacaagtgtgcagagccttgcatctgtgtggctcactaatgcattctccacctccagtacaatgcccgacatgtcacaggtgaccaaaaaaaattactgaggccaggagtggtggctcatgcctgtaatcccaacactttgggaggctgaggcaggcagatcacttgaggtcaggagttcgagaccagcctggcgaacatggtaaaacccctctctaccgaaaatacaaaaagtagctgggcgtggtggtgggtgcctgtaatcccagctactccggtggctgaggcaaaagaatcactcgaaaagaagttgcagtgagctgagatcgtgccactgcactccagcctgggcgacagagcaacaccctgtcacaaaagtcaataagtaaatacaaataaagtaataaaaaattattggccaggtgcaaaggctcatgcctataagcccagggctttgggaggccaagatgggagatcacttgaagccaggagtttacaaccagcctgggcaacatggtaagtccccgtctctacaaaaaaaaaaaaaattgttgaacaaaaaatacacagtgccaagatacagtaagtattcaataaacgttagctatcattatcaagaagacagagtattgctatcaattagcagagaagcctgacatccactggcccttttcaaatatgtatcttgagaagggggaatttagatgtaggcaatggctgcaagagaagcatctaacagttcagctttaagaaaaaatccagtattatatgatcctttacaatggaacagccattctctctcatatactcttacagaaataacatggagtgagttactgctgtacctagcagcatagataaatcacacaaatacaaagttaagtaaagtaaaacaaatataaaagggtatatttggggccaggtgccagtggctcacatctataatgccagccctttggaagaatgaggcaggaggatcacctgaggccaggagttcgagatcagcctgggcgacatagcaaaactccatctctgttttttttgttgctgtcgttgttgttgttgttgtttttagagagtgtatttggtaggattatatatatatatatatatatcaagttcacaaacagccaaagctaacccatgatgacaaaagtcagaatagaggttacctttgggaggagggaatgagttgggaggtaagaggggtctgggatattggtactgtcctatttcttaatctgggtgatgcgttcattttgtaaatgactatatgcttggatgtatatacttttctgtacagttgttatctctcaattaaaatgtttgcttaaaaacacaagtagcaaaataaattacctgcactccaaccttcttttcaaggtaggggctcttaatcctttcatgtgatctaaaaacaaaagaacaaaaactcatgaatatgtttttccagaggattccttagcccaagggaaacagtcgtcttctttttcagcttcaagagaaaacccatgaggtttgcttttataagaattgattcacatgggctatgagctctttcttctgcaagtgaagaatcctcctcagaacaggaccggctgcccatttctgagccatccaagtcaatttaaaaggagagtgattctgtgcatcataggccagagtttaaatcactctgggcagccacagaagaatgagaactgcttctagccctccactcttacttcatttcaatccaaccatccttcgagccaagctctatgggacccattcactttctgccacttaaatcagtctatctagaaattcaagttcgtggtcatggagtctgctgggaaatcactcaggttcagagtaagtgtttcgtcatcttctcagcctactgtgatggattgaaaggggaatattactatccacaaagacttgctccacagcgctccacattaacagacacagacaacagaaaggtagcaattagaccgactattacattaagtatatcatgcattccaatatattctgaatctttagcaagtaaaggcccagacaacaatgatcaaacagctctaaattgtttaactaaaccagttggacatggtggctcttgcctgtaatcccaacactttgggaggccgacgtaggcggatcacctgaggtcagaagttcaagaccaaccttgccaacatggtaaaaccccatctctactaaaaatacaaaaattagccatgaatagtagcacacccctataatcccagctactcgggtggctgaggcaggacaatcacttgaacatgggaggtagaggttgcagtgagccaaggccataacactgcacttcggcctgggcgacagagtgagacttcatctcaaaaacaaacaaacggctgggcgcggtggctcatgcctgtaaccccagcactttgggaggccgaggcaggcggatcacctgaggttgggagttcgagaccagcctgaccaatacggagataccctgtctccactaaaaatataaaattagctggggctggtggcgcatggctgtaatcccagctacttgggaggctgagataggagaattgcttgaaccccgaaggcagaggttgcggtgagctgagattgtaccattgcactccagcctgggcaactagagtgaaactccatctcaaaaataaataataaccaaaaaaaaaaaaaaaaaaacaagaacaataaattgcttagctaaaccaaaccaattctaattaccacgagcaccaccacacacacacacaagcaccccctcaatttatatgtcgtgtggccatcattagacccagtgaaagcagagcagtcaccacatgtcacttggcagcccttgattgtatatatgcctccaggagagtccacctgtctcccactgggtaaattccctcaagggatatctggtccagtcttttagggcctatgggtatatccctgggcagcattctccgtaattggagtttccaaagagtttgcgccatggcaaagaggaggctgaatgcagactctgcatcctgctcccacactgactaagcaggcagcaccctgcatggtgcatcatggtcccccatcctcaccaccctgaggccccttccagctggtagtcacaagaactggatgggtttgctttgtgtggctggaactgcacccaggtctgcttttccagggaggttttccttttccttggcaaccatcataaattgtcccctctaggggatttccccaaccctgggccactatctcaggtctcaggggtcggggggccctctcatctttcagaacttactgatgatgcttagtaaagcccaccctgcacacagcattggcttccagatggcccacaaataagcatcaggtgggtccatagcctactccgaattatatcaaaatgtgatgtggggctgggtgtggtagctcacacctgtcatcccagcactttgggaggctgaggtgagtggatcacctgcacccaggagttcgataccagcctgggcaacatggggaaatcctgtctctctataaaaaatagaaaaattagccaggcatgatggtgcatgtctgtaatcccaactactcaggtgggagtacttgctgaggtgggaggattggttgagtccaggaggtgaaggctgcagtgagccgagatcgcaccactgcactccagcctgggtgacagagcaaaaccctgtctcaaaaaaaaaaaaaaaaaaaaaaaaaaaaaaaaggaagtgatgtggatgggtttccatgcattttttctagcaaaagagtccatacagtttctcatgtttgagctgctatcacaagataccatagataccatagttggccttcacaccagcgctgtaaggaaaggtagtgttttggttgccttcaacaccaaaaaggtatttctcacagttcaggaagctgggaagatcaagatgcggggcgatttggtttctggagagggcacttttcctaacttacagacagccgccttctcactatgcactcacatggctttcctaggccccgcatgaggacagagcgccctctctcttccttctcttgtaaggaaactaatcctatcagagtaggacaccacggtaggaccccacttaaacttattttcctcctaaaagccccagccccaaatacagtcgctttgggggttagggcttcaacatatgaattttgtggagatagtccatatcataatcaaagaagcctgtgtcccaaaaaggtgaaaagccaacagaaggcaatgtgagaaacctccaaaagcagaagttgtgttttcacccttgatgagtttatgtcctggttgactaagcagatccacatgtggtcagagaacagaaaaagttgttatagactgttcaacagtagggaagagtccatttctggcttaatgcacaaacttatgatgatttcaaattcctttagatttattatttctccaaactcagccatcctaaacacgaagtgcaagtttcggaagtatactttaatcctggctagcccattttgagttcagagactccagtgcggctctacacaaaaagtaaaaataggcatatcctcgtccagcagtggattctcaatgaaaaacaaaaccagaaatgtgtcaggcacagcggctcacacctgtaatcctaacactttgggaggctgaggtgggtggatctacctgaggccaggagttcgagaccagcctggccaacatggtgaaacatcatctctactaaaaacacaaaaattacctgggtgtggtggtgcgtgcctgtaactccagctacttgggaggctgaggcacgagaatcgcttgaacccaggaggcggaggttgcagtgaacagagatcacgccactgcactccagcctggtgatggagactccacctcaaaataataataaaaatacaaacattagctaggcatggtggctgactcctgtagtcccaactacttgagcagagagcatgtgccacactgtactccagcctgggcgacaaagggagaccctgtctccaaaaaaaagaaaaagaagaaggagatgctcaaagacgtgcacgatgcgaatacggcaacgcacgagaagaggtccagattttcccattaaagagaaatcactggtggctttgtggaaaaaaaaagcagagacatttcgcagaagcagtaacttcaacgatttatagtccaagtgattgattccacacacaaaacaacatagctggccttcacaccaaccctgtgaggaaaggctgtgtttggatacctgtaatttactttaaaatactttcctactgcgcaggtacagataggtttgttacgctgattgactccacagggtagtgggagcttcctgctccagcacgctgcaaggccacacagcaggaggcagcaactccagtgattccgtttatcattttctccaattaacactaatggctgggcgaattagcacaatgagcattaaaactgttttccctggtaaaagttagtgacttgttagcacaatagaagtgaaaatgaacaatggttgtcaagttagcggtatttaaactctggaacttagctccaatctctgcttggagcatcagcgacactctaaccttaatccctaaatcggcccagctgtgaaaggatccagctgtgaaatcatagtagcttttcaggttgcctgataccatctagaagggaaacatccctccaacctaaactagaacgaaactttcatattggatacggacagaacacccaaaggccaaggagcttgcacttcgtggagctcttaggcgggctgttccacagttgtgtgtgtgtctgagtctcctgcttgctgaccaatgtttgagggtgtggtcaaatggatctgaaacttgttttcttcatacatggtagcgaggctctgagggaagtactaaccctcgccaatctctgatcatcggccaccagcaaagctaccaagagaaactactagcagtgcttgaccaagccggcccggggcgcaactggcaggcgccgttacgccgcgttgaccacatccgaaaatagatgaagcctttgagaggctgaagagcccgactgggacaaggcgtgtgctggccgccccctcgctggcttcccacaggctgcagctccttgctccagggccggccccctcctgtcctctctccagcccccagcgccccgggagcgggcgacgcgcagccctcactcacctttgtggcagtgggacaggaagtaggcgcgggccctcaggttctccctatcgaagcggtctatggagatagttggatactcggccatctgcccctcgaaagaactcatagcgccgccgatcccagagtccgggaccccaaaaccgcagctgaagccaaggccagccctgaccgcgccgccacttccgggaagc

SEQ ID NO: 1672 - DNA, 47224 bp, Homo sapiens; identical to SEQ ID NO: 1671
  source 1..47224: mol_type = genomic DNA

SEQ ID NO: 1673 - DNA, 47224 bp, Homo sapiens; identical to SEQ ID NO: 1671
  source 1..47224: mol_type = genomic DNA

SEQ ID NO: 1674 - DNA, 47224 bp, Homo sapiens; identical to SEQ ID NO: 1671
  source 1..47224: mol_type = genomic DNA

SEQ ID NO: 1675 - DNA, 39491 bp, Homo sapiens
  source 1..39491: mol_type = genomic DNA
ctaatcaccaaacatctgcttccttctctgtagctgtgaccctgataccgcgtggtgtgctccgaacacatggtgcccagaacgaaggcggcgtccagaagccctaggtcccagaggtccgctcagcggcaggcgcataaggcggggccggcgcgggcctttccttccatcggaaccgttctcccggggctgagtccctgcccggactccgaacgccgaagaccaggggccggaagcgcgcgccgccactgccacgccgtgtcagtcgggagggagggagcgagcaggcgaagccgcggaggacggggtgaagatggcggccttctccggtgcgtttgtggaaactctgggggtggtggggcggcttgttgcacgcctcagccctggggccgcccgcggagagctaaaggggcgggagcggacaggggtcagggagacagaagggcgctgtccgctgcagtccctgatggacccgcgttgcgggatcaggggcggccgcggctcgggttcggaggacgattcttcccaggagcgggccggaacgtccctccccctgccctttcccttctaccagtctccacttggctttcctgccagtgcaccttcggctgcaaaatctaggcggcggcgttgctctggcggctcccagacgcctgggcctcctgcctcttaacgtggcagtgaccctttgggaacccttttctgcccgcggctcatctgggcttggccaggcagagaggcgagacggcgtggggaggagtcattggggaaaaatgacgatcctgcctctgtccagttttttcaggcccttccaaaacgtcccaggcataaacctgatctttatttgttcttaaacgttgttatatcaacattaatgttcagtgttgaagctaaagggaaagcattttcattaacgtacgcaccagtccaacataagtttggaaaattcatatttatttgccgtctgctaccctcctttattccaaatatgatttgatatggcttatcgaaccctacagttgatattttcgcctcttgctttatcatcctcctgttaggcatccagttttaggaagctgtaatcagccttaaatgcgctaaacgtgatacatttatgtagcacttatgtaacgtttattgctatataaatgtatcacgttaggcctaatgtcctttaatgttattaactttttaagatgacttcagatgtagtattttatattttttagttttcttctgtaagaatattaggaattccatatctccagtcatgtaagatattttttttcttttttgggggggagaatgggggggtggggggatgtagtctccttctgtcgccccagctggagtgcaatggtgtgatcttggctcactgcagcctccacctcccaggttcaagcaattctcctgcctcagcctcctgagtagctgggattacaggcgcctaccaccatgccctgctcatttttgtattattagtagagacgggggtttcaccatgttggccaggctggtctcgaactcctgacctcaggtgatccgctcacctcggcttcccaaagtgcaacagtcatgtaagatttctgactgtttcagttacatcttctaataggattcaattggaaactgctcagagttgttgctgtttttcttttcccaacattctcctaaaacgattttagagccaaggtctgtaggatagttctaggtagtcattttataggttcacatctttgggagtcatacacaaatttcatgaatgttagaggtaaaggactggaaaaagtctgtgatatgaaataagacaaaactggaatttcacgaatgtttctaatttttccttaactgttaaaagtattatacttaaggtccgctttcaaagaaaacttgcagggaacatgaccagaatggtacaagagattgtctggaatttactgaaaatgatatgttgtttcttgtataacaattttgcaaagagcttcagcttgcagtattccgtatgcagtaagaacacaccactcctttgtttcaagcagtttgcattttaggagagagaacatagactgtaatacaggttaattcttaggaaggtctgcctggatattcaactttagatcttcattagtttatctgtggcttttttttttcctgagattaagagctaggaaagtcgccaggtgcagtggcttatgcctgtaatcccagcactttgggagtccaaggtgggcagatcacgaggtcaggagattgagaccatcctggctaacacagtgaaaccccgtctctactaaaaatatgaaaaaaaattagcgggcgtggtggcatgcgcctgtagccccagctcctcgggaggctgaggcaggagaattgcttgaatctgggagacggagtttgcagtgagtggagatcatgcccctacactccagcctgggtgacagagtgagactgtctcaaaaaaaaacaaaagaaaagaaaaaaaagaaaaagagttaggagagccttctttgaaaatgatgatccttctcatctgatgcaaagaaaaagctacataattttatgaagaatattttcagtttgtatgtttgctttatgccttttcacaatggcaagaaatacagaatttcagaattggttatttctggggcttgggaatgtttgattcttgttcttttttttataggaatatatatttttatgataaagctatattttataaatacagacttaaaataaaaatcacttgtcttttggaaggaaagtttaagtaatccaactaactactccatatataattaccctctacagttcatatgagaaatgataaaatgacaaaacccggttaggagcaactcatctctattcatttaggatgggccttgaagtagaattattgagatatgtatacagttaagaactcagcagttcttcagctgacatttccaggtgcccacgttttcaccactgacccctccctcttcagttattcagaattttgattatggctgccaataaatgtgggtgctcgccacttgtctattcatttttttccaattgctgagggtattcacatggtcctagaatagccaaggcacataactgccacattgtctctaaatgcaacaaccctgtctattcttggcagacttttcacgagtcatgagaggtaaacaggcactgtagtggctacagtttattaggtgacaaccatgctccagttgcattacatgattatctctggtcttcatatagccctgcaaggtaggcaatatcagccccattttgtgtggagaaaacagatttatagctttgcctaaggtcacttgctaataagtgagaacttagatttgaactcaggtctttctccagaacttgtgctctttcaacagtgccacgctcagtagatttgatgtaactgagctatccttcaaaatctttaccctgttttatgaatagtaattttgagagcaatgcaatttatcatttcagtttatgtggtttttaaaattaatttttactttcagagatgggtgtaatgcctgagattgcacaagctgtggaagagatggattggctgtaagtacataaagcctaaatgtacctgggagaggatgttttataatttaaacagttgttagtgattttatcaaatatttttgtgtctagttgggtaagtgaaaatcaggttttttttgtgattttctaaattatggaaagtttcctttttttaaccttgacatatttctagtggaataagatggatcgtatttaccacgtaaaattttcttttaggcaaattaacgtgacttaatttgcttaggcgatttttttccccagtaactaaaattcttcaaatatgattcttttagcctcccaactgatatccaggctgaatctatcccattgatcttaggaggaggtgatgtacttatggtaagtttaaatttggtgaggtgattggtagctggggacacactctaagaattgcataggcttacaaatgctactttacctttattcacaaacatttatgatacatatactgtattcagactattaggtaaaagcttcaaacaggtaagtatttactcctgagaagcttaaacccactagggcaataagacatgtataagaatgaatctcgtatcagagagaatgtggcttcttcgtaagagatgcagagtagtatagaattcaagtgggaatccagttgtccttttgcttgaaggatcatagggactgcttaaaggaagtagatttctttttttttgtttttgttttttggaaaaggccaagctctgttgcccaagctggagtgcagtggtgtgtttatagttcactgcagcctcaaactcctcggttcaagcaatcttcctatttcagcctcccaattaggtgggactacaggtacacaccaccacatccagctaatttattgtatttttttgtagagacagggtctcactatgctgcccagtctggtctccaactcccagcctcaagcgatcctcctgtcttggcctcccaaagtgctggagttataagtgtgggccagatttttcgcaagggaagataaaagagaaatgctttttaggtagagagaatatcagcaaaacagcgaatagtagaatgtaggatatgaccctggaatatttcagttggttggtagcataaaatatgtgtctgaggggggataaacttgaaataaaattgtagagagataatgggtcagattatttgggctctttctcaagtgtcttgttaaagaatttgagtgttagtcttctatgaagactaatctgagtagcagattgtagtatagctctgggattagatgttgttcggatacttttataataatctagattagaatgatgagagcttccgtttgaatggtagcaatgggaaagggaagagaagattcttaagggtatgggaaaggtaacaagatgggctgtagttggagttgacagaggaaccctggatatctggaggcactgtgaaaataaaggtagccagtcaaatgttaaagatttctacatactatggtgttagtttgatttctttaatagacaacttaatctgtaaaatcaacttttttcccctcattcaggctgcagaaacaggaagtggcaaaactggtgtaagtaataaattatatttactttctctctaaaagttgaattttaaaataactttgaacagtagtttttactttgaaatatttaataaaatagcaacctccaaaaggtaaggaattaattacttgctactgaaaatgatatttttgttgccagctaattatgaagagctaaaaaaagtatgaccttaagaacatagttttaaatgggcgttagagagttacaatagctttagtgtttatactcacttctgaattttaatatgatgactcttaaaataaaaaggttacatacagaagttgatctcctactggcctggactagagaaataatttgtcggactggatggtatttttcctctttagtgtaggttcattctaccagtctccattgttctatctttttgtgatgttagctgcgtcctatttccttcattcagtccactctgtgttgtctgatgggtatttttggtttgggtaaatgaaattgtagtagcaatctggaatatgtatgattagttgatgtgtgtgcataacttttgtcatttatattggttattaaattgtcgttaatatgtgaatactaatatagataccttttgtttctttgataggcttttagtattccagttatccagatagtttatgaaactctgaaagaccaacaggaaggcaaaaaaggaaaaacaacaattaaaactggtgcttcaggtaatttttgtaaattgatatttccttttatataaatcattggttctcatcactgacagttaggaaagtgagatttgggtatgcatttttaaaatcttgtcagtatctggggggtggtattgggatctggaaccctggaaaccagggatgctaaatgttgttgagagcctaaacactgcaaggttgtccctcctaaaatactaatagtgttccctttgagaaaacactagcattttggagattacatttcaatattatagtgtttttcttaaccttataactttctatgcttaatgctaaaggaaaataggtacattttacaaaaatattaaggaaggattttacaaataatttatggagtaaaaacccatgctggtgggaagtattgccttacagggaacagaggcattttttttcctctaagataagaagggaaccacctaggaagttaaaatataaattttaaagttgtttcttatgtgcagtcctatctacatggaaattggtctttttattaggtttctgatactgtctctaccgtaatcaatcttaccgcagtttcttcatctttaaattgtgttgcttctgttgaatgttttctaaatttcattctatcttaattaatcttttgttttgttatattttaataatattttttccacattttaagtcactcttgtttcattatacaaaacaggattgttacaaaacagcaagttgaagaccagtgaacctgtcatattaacatattcttttcagttgtttgaaagtaatgttatacataaaatgtataatgtagaatctgtgaactcatgtaaattagagatagataattgatgtaactatttacactattggcctattctaaaatagtttcagaatttgtaacaactgtgccgtcatttatgagaaatggtggtaaaagaaaacactcctaaaggagaataaccatagtgataatggttctgaaagtcacatcctatgaggaataaagaaagtagaaatttaaacatggagaagaagtaaaaatggagatgggataattgttaaattattgaagagaactagagagaaagtaattattctagaaagtaggaccaggaccaattagaaatagtttagatgaagatttctgtttaacttaaagtacttcctaatagctacattgagccacaatgcaagggaaaacctcaaagttatttctacaatgttcaaagtgtttaagctgatgatggatatcttttgaccagaaataatctagaaaggatttctaccgtgagtggaaagttggtctagaaagcacgtagagctctctttattacaattcttagtttatacgtatacatacatcttaacaaactatcaagatgtgtcagaaaaggaaaatgccaatcttataaaaaggcggatgaaaaaaatgtgtgacttttgaatgtggtattgaattaagataaaggacttgctttttttttgatagttacaagataattagactctgaaatgttgatcagttatttcctttataattgaagtcaacttgtttggttacttaaacttctttttaatagtgacctaggagtaaggacagagatcagtatcatctgatagagagcacactgaagcaagcaagtgaggagaaaaggttttaggtccagatagaccagtgatgattatcttcaacatgtctgatttttcagttgcgtttttgcttttaataaaaacaagttttacttgtgtattctaaataatatataaaaccatattgaatctagaggaattaaggtacataaaatacttgtttttttttttaatagagcgttttattttatttatttatttatttatttatttttgagatggagtctcgctctgtcgcccaggctggagtgcagtggctcgatctctgctcactgcagtctccacctcctgggctcaagcgattctcctgcctcagcctcccgagtagctgggattacagtcacacgccaccatgcctggctaatttttgtatttttttttttagtagagatgaggtttcaccacgttggccaggctggtcttgaactcctgacctcaagtgaaccacccacgtcagcttcccaaagtgctgagattacagtcgtgagtcaccgcacccggccaagcattttaaattttatatatctgtgggtaacttttcttattttaatttgtttagtgctgaacaaatggcagatgaacccatatgacagaggatctgcttttggtaagtggatagactttccatcagctcatttgtaattcagaaactttaaaaaataatacatgagaacaccaagtaaataagattaagatttaatttaccagatattagaatttagtcactatcattaaacagtatagaactgacataggaatagacagtggaacataatggaaataaatctcagcacatatgagaagttatatgcaggaaaaataattatatttcatttcagtgagacaaaaggatggtttattaagtaaagggtgctgacacgatccatctggagcaatataaaattgacttctatctcatatcataattagaaataaattccatgtgtatttaggacttaaatatatatgtatgaatttgaatacagaaaactacatgtataatttagcagtggcaaaactttcctaacccaaatagaaaatgcagaaattataaaagaaagtatttataggtggagttggacagtcctccttcttggggttaacagaccttacagtggcttttatccaattcaccaggctggctgttcacttgggaataacctccatcatgcatagagccatctgtgattgttccatagtgagcagcgagacctgcatcaactcaaatatgcccttctattctgctgcatttaaaactaaggatactttcctaaagcagttactctcagaatgcattttagtaaagactcctcaggaagcttatgatactgatctacaaaatgtaacagttccttcacactataccctccagtttcagagtgttttggttttgctcttccccacatttactgccttcttggagaccacaggtcttagaagtactttttgttggccctgcataatttttcccttgggggtcagctttgaagctggtgaccaaagctcagatggactgaaatctgaatgtagtctcacatcaagggctgacccagcactcttttacttcattttagctattacagataatagtaaccaaaggactgtatactttttttcttatttgcattttcttttttttttttttttttttttttttgagacagagtctcgctctgttgcccaggctggagtgcagtggcgcgatctcagctcactgcaagctccacctcacgggttcttatttgtgttttcttatgcatccagtgaaccagctccccaggagttggatccaactctaaattccactgataatttttatcattagtaactgtgtgtagcacagctgtggctctgtaccataggtgatcttgtggccaccaagaaacctaaagttcctcatcccctacccttttatcctttttctttccaaaccacagttctgtgagccaaggcagttctagcaaaccctgattctgacaccaattctgagaatatagagaaataaataaactccattttccctgtatactctctcagcatgcttctgacagcagatgtgtggggttttttcccacaagtcaagcaagcagtcagttctcagcatttacgagttgagaactgatggagtaagtaacagacacatgtttgtttattcttggtttcccatactttcccattatggtttcttccagctgagaactgtaattcaattcaattctgacaccgtcttcatgaagatagcatcatatcccacaggttgagggttcaatcacacaagactgtcccccacatctgatgcccaggttgtggcttatgcttctaacctattggctataaatcagggttcctacaattccttcctcaggttcaattaatttgctagagtggctcacagaactcggggaaatatgtttactggtttatttttaaagctattataaagaatactgatgaagagatgcataagctgaagtacaggaaggggcttggagcttctcccctccctgggcatgacacccttcaggaaccgtcatgtgttcagctatcctggaagctcctagataactttttaaaagttcagttctacataattcagtacccatatgggtaagaattcatactttgaataattaaatttctgaaaagtgtaggaagatgtgtgttgaggtgcttaacagtttgttctactttcaagtacagaatacgagttggaaagatgaaccaggacagaaattatagtttttttccagtacagacaaaaagctgaatctttacttaaaaccatttagtatgtggacatcactgagactgatcatgatgtatagtatagaatatacctcatcttttagagcccttataatattagcaagtaacaaatacatgcttatttattcatgctttctcctagtttcccatatggtttcttccatggattgaggaacaagctagagacagttctgttatcttttagttatatagtcactcaagctctaatttaagtataaaatcaggacgaatattgatgagcgagttgtgcatcatccttgagtacgtttctttaaagggctccagagaatagttatctaaacacatttgtattgatggtgcaactactattagtgcaagtcaggttaagagctgtgttgaatcctttctagacttgttgctgtaaaatcttaccttagttaacagatggcagcatagaaaatagcccccaacatagccaaggacacccagggaatgaaatggttaattacacttgggaaatactactatcactcaggaatcagtaagtctcagtctctggaacattgcaacaaatgaaggaattatcttgttagtgagactgaatgattttttttggtggtagggggtgggaatgtatgatttataaaacctgtactgacgtgtttttctgtgttttcttctcaaatccagcaattgggtcagatggtctttgttgtcaaagcagagaagtaaaggaatggcatgggtgtagagctactaaaggattaatgaaaggtatttgaacagcatctgcacttgtataaacttttgaggcaaggtattaatacgtgagggtttttttgttgttgtttgtttgtttttgagatggagtctcgcacgtcgcccgggctggagggcccgggctggagggcagtggtgccatctcggctcactgcaacctccacctcccgggttcaagcaattctcctaccgcagcttcccgagtagctgggattacaggcgcccaccaccatgcctggctaatttttgtacttttagtagagatgggtttcaccatgttggccaggctggttttgaactcctaacctcaggtgatctgcttgccttagcctcctaaagtgctgcctgcaggcgtgagccactatgcctggcccatgagtttttaaaaatagctttaagtcgaggatctgggaaggtgtttgatggtacaaatatacctataattcttcatttggtacatacctgtgtaattcagaaacaatgggaagatgacttcatggtaaatgaatcgtgtgtgtgatttatataaatctcaatgtattttacccttgtagggaaacactactatgaagtatcctgtcatgaccaagggttatgcagggtcgggtggtctaccatgcaggcctctttggacctaggtaagtgtttctaaaataactgaattgattgatttacatttgggggataacattttattatttggggaagcaaaataataaatttaaccataaaaaggttttattttaaagacatggaaacaatatttatctgtaccccaccctgttccaaaaaggatttgaaggaacttacaaaaagtacagatattatagcagtatgaaatgagggataagaatatgaatggagtcagggtaaagttagtgtgtgtgaatctgtaccacacagtaccatatagatgcttcatgttattgtaaacttgcatctgaatttcttagtggacaaagcagagagggatgcagtatcactggtgtccctagtctcacacacgctctgtggcctaagcactgtttagttttttgcaggattcagaaacttagggaatagttttcctgtgggtttatgaaatggacatactatgtgaataaaattacttcttttagaggtcttttaattttatattttctcttaccagaaaagtaaaatattttttaaatctaggtactgacaagtttggatttggctttggtggaacaggaaagaaatcccataacaaacaatttgataattatggagaggtaagcgattatgttatgacttcaacatagcataagtaagttttcttgcatacttaatcactcatgacagaatgagggtatacaaatgattctcaaaatgagcagattttctgtatattttccacagaaagtttggatttggactttagtgaagaaatattgtcaagctagataaatatgtagtagttataatttttcttttatgccatttgtcatcccctccaaaatacattacgttgtcttctcttttcacctcattttgattttggctttgatacatgttattctcatttcttattattgatcatgatgagtctaaatatagttcgtctggtgagctgaaatctacagtagtgtgaatgagcctaaatatgttgattctaacaagcctgtcaaatgcttgtactattgtatatgtcatatgctctaataggcatttttgatttaaataattattttgaaacacatacttttgatgcagctatattttaactttatttaagaatttactttctattaatagcatttgactttctggtgttctaggaattcactatgcatgataccattggatgttacctggatatagataagggacatgtcaagttctccaaaaatggtaagctctatatggatcttagtagtgaaaagatacatgatattcaataattgtggtttttaaaaatccccccaccctgtttttcaaatccccgtccctccctccctgcctttacttgaactaatatttattgagcattgactatgtgtaaggtaccctggtaagtactggaggcacagaagaaaatggaatagacatttggggcttacacactagtggtgaaagacagacatataataccatgttaggtggtagtaagtgctgtgaaggagggtataaagcaggggaaggaagtggagagtcatagcggtttgggggtttgtgcttttgtgtagggcagtcaaaaggcttgataagggacatttaggtagagatccaaatgagttgggtggtaggccatgcagatttctgcaaagggaatagtaaatgtggatgccctgagatggaagcgtgcttgaggtgtctgagtcacagcgaggaagccactagatctggagtgctctggggataaaggacggtggtagaatgttagatgagtgaggtggtgaggccaggccatggagagccatatgggccatgatctaaactttggtttttattttgagtgaaatggaaagccatgagggttttgagcagaggggtggcatcatctgtctttagtttaacagtaccattctggctgctttgttgaagacacattggagggtggggtgagattgcctagggattgagggtagttaaagagaagaagagatctgaggcctgggttcctgtggttaggggtcagcaaattgaggagaatccagcagaggggaatgaggaggaaggccaggaggagaaccaagaaagcatgggtcctacagtcctggtgaaggaagtgtttgaaggatcagggagcaatcactgttcagtgctgcggatgggtctagtctagcaagatgaagaatgtgcattaactgctgcatttgacaagtggaaagcattagagagctgttttggtggagcaaaggggtgagggtggggagcctcctaataaggagccagttcaatagagaatgagatgaaagaaagtggatacagtgtaaatggaaatcggagtttcactacaaaagggaggagaaaaatggaaggtaaatggagggagaggtgagttcaagggaggttttcttgtgtgttttactgtgagagtatgtttatatgctttgaaatgtctaatggaaatgaacttgtagacagggagtaatgaaaaatgtagaggggtagaagtgacagtttcaggagtaaagtaaaaaaatgaagaagctggccttaggcagcacagtttatccatagtgacaggagagaggcatgaatgcaggtaagctggtagatttgacattgtcagcatgaggaaggtcttttctgattgttttaatctctctctctctcttgttttttaaggaaaagatcttggtctggcatttgaaataccaccacatatgaaaaaccaagccctctttcctgcctgtgttttgaaggtaattaggaatctagttagaaaaaatttgctgtggttgtaagctgcttactcttcattattttgtatacgatggttttcaattagggtaggaattttaattttctgttttattcaatgctagaatgctgaactgaaatttaacttcggtgaagaggaatttaagtttccaccaaaagatggctttgttgctctttccaaggcaccggatggttacattgtcaaatcacagcactcaggtattatacctgcaagggtaaggatttctagaatagtgagaataattgatgagaactccagtaagtaaggcgtctcatagtgagttacatatactttccttgctggtttagtcacacatctttttttaacacagcagtaaaattcatttttaaaacctaattcataaactcttaagtatttggtttcagtgtaggcattttgggatcgcaatcataacggtaatgatatctaatatttatagaatgtgtgcttattcagtgccagggcaccacattaagtgctttacatggtttagtcttcacaacaaccctataaggtagtagttttcccattttacagacaacctaacgaatagggactttaagtgatttgcccaaggtcacagagcaaataagtggtagaactgaattcaaatctaagcagtctgacttccaagtttatactcttatccattgtatatctaatatttaaagtatatttcataacttgtttgtcacaaaacaagtgagtcatttttgtagacatatcaatcaattagaattattccaagtagatttttattgttgttttaagagaggggatctcactgtgtcacccaggctgctggagtgcagtggcgccatcatagctcactgcagccttgaatacctggactcaagtgatcgtcccaccttgggccgcccaaagtgctaggattgcaggtgtcagtcaccccaccagcccaaatagttttaatttaaagtagcctttgttttagaaatctaaggtttattctgtttgactgtcttctctactttttgacaattattatgtaaaatgttgatattagaatatttgtcctaatgttttataagtaacagtattataaagtgtgctttgaatgtgttctcatcttttttattccctaaggtaatgcacaggtgacacaaacaaagtttctccccaatgctccgaaagctctcattgttgaaccttcccgggagttagctgaacaaactttgaacaacatcaagcagtttaagaaatacattgataatcctaaattaaggtaaatcttccttttgtgctgaaatgcttattgtcttttggtttgaagttttttggaagaagaataaggtagagaaaaatgaagtagaaattcagtgtgtatacataatacacgtgtgtgagtatgtaaatatactttaataatttccatatacaactcctgtttgtttgctaaatggtaagtatgatttttttaaaattgagattttttttttcctgtgtctcttacatgaaaagtcatggttagtcaaacagcattggagtaaaaatctaatttttggttttttttctgagaccgggatctcaatctgtcgcccaggctggagtgtagtgatatgattgtagctcactgcaaccttgacctcctggactcaagcagtcctcccacttgagtagttgggactgcaggcacatgccaccttagtagagatagggtttcactatgttgcttaggctagtctcaaactcctgggtgcaaatgatcctcctgcttcagcctcccagagtgctggaattacaggcatgagccactgtgcctggccctaacaattttttgaagagagcatttcattcactgttaaatttatttcttccctaaatctctatagaaaatgtgccactctatttctagcatgttagtaaacttggcgaggtttattctagactgcatcacggtggtggctttcttccatttggacattcagattggtcactgtctagttataagactctttccaccattggaaggataccataaattaaagtgaccttgctcagtagcaatccctttgactttgaagaaggctataccatataagtaatacactctgttagtcaatttgacacttgatttttgttaattttgtctttaattactttttaaacttgaaacattcacacaccataaaactcattatttgaaagtgcacaattcagccaggtgtggtgactcacgcctgtattcccagtactttggggggccgaggtgggcggtcacctgaggtcaggagttcaagaccagcccagccaacacggtgaaaccccatctctactaaaatacaaaaattagctgggcttcgtggcagagacctgtaatcccagctactcgggaggccaaggcatgagaattgcttgaacccaggaggtggaggttgcattgaggccaagattgcgccattgcactccagcctgggcaacagagtaagactccgtctcaaaaaaaaaaaaaaaagcaagtgtttcttggttcattggtttttagtatattcacaaggtgtgtaactgtcaccactatcaaatttcagaagctttgaatattttgacatcacaaaagcctgtgtttttttttaggttttttttttttttttttttttatgaagtctcgctatgttgcccaggctgaagtaagtggctgttcacaggttcagtcttcctacactgtagccttgaactcctagactcaaggaattctctctcttgcctcagcctcccgagtagctgagaatacaggcacatgccactgtttcaggcaggcctgtctttttaatattgatcttatttacaggttgaacaaacttatttagggataaattatgtaaaataattactaattttgttttgaagattgatgcatgttccttattcagcaaatgttcatctaccttccatatgtgaagttttaggctgggagccagggcttcaacaatgaaaattaatcttcctttcacagaattaagtgtgaaagtgtggggatagtgtggaggggagagaaacaaaacaaatacaataaatgccttgagcataccatgtaaccagggcatctgcttagtgtaagaaactcagggacgtctttataaaaggatttgggaagaatgtaaaatgctagtgtgaattgatttttgtgctgtgattatgtataaaaatgaacatgattatagacaaaagttagaggggaagatgaataataaaatcaatttattggttaagatggtaaagtcatgggccacttgtttggtattcggtacaaatggacattttctttcttaaaacccagctgaagtcatgatctttgaatgaagctaagctggctgtcccagcccagccatctgcccctcctctgatacactgactgtacatgcctttccctgatccttacatactgtcatgtgttacttttccttactttttaattttcttaatttttatttcctttttagagctatacttgctttaagtttcttgctttgaatatgcaaagcttttatctaactcagttttacattccttagtgcaggggtggttcttttatattcttcaaccctacagtgctttgcgtataagcatcaattatcatgtgtatgtgtgtttaccttctgccaagtttatagggataaatatatctgattataaatgtggataaaagtaaaagtattgttggaaaaaaaaatgatagtttaggacaatagtccaaacctaggaacttgaggacctcatttaaaaatataaaatgtattggttccctcccctggatatactgaatcagaatttccagagaataggaattagaatctttttttatttgtttgttttttaagaaaagcagctcctccaggtgattctttttggttttggttttatttttgagatgaggtctcactctgtcacctaggctggagtacagtggtgcctcatagctcactgcagtctcaaactctagggctcaagcaatcctcccacctaagcctccagagtagctgggactgcaagcaagtgccacagtgcttggctaattttattttttgtggagacatggtcttgctatgttgtgcaggctggtctcgaactcctggcctcaagcaatccttgtgtctccgcctccgaaagtgctggattataggtgtgagctactgcatctggcctttactctcctgatactgtcctttggaagtcttaattttgatgaaatccaatttatctgtttttctcttttgtcatggtgttttgatgttgtagttaagatagactatgcctaacccaaggtcatgaaaattttatttgtgttgtcttctgagttttatgtttaggttctacatttaggtctgtgatacatttagagttaatttctgtgtatggcatgagaaagggttttaacttcagtcttttgcatgtgcatatccatgtgtcccagtgccagttggccagtcattgaaatgagaaacattcaaacacaaaagggtactgtgaaaagtgagtcttctttcactcctttccccaatttctagttatcctttctggaggcaacgttttaaattgatttttgtatattccttcagggcattttatatacatacaagtatatatgtctgaaaacatagattgaaaccaggttttaaagaaccttgaattatcctaatgtagaagaatatgtagatgagaataattttttccatgttacaagctcacgcattctctttcgtgactttaccgcacttcagcaatagatacagctacggggatttaactgctttgtttcccaccttccccagacttgtttttttttttattttttattttttaatttatttattttttattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacctcctactacacaaacacggcaaccatccgatttcccactcttttccccacctctccccactttctactccacaaaaccgccattgtcatcatggcccgttctcaatgagctgccgggcacacctcccagacggggtggtggccgggcagaggggctcctcacctcccagtagggacggccgggcagaggctccccccacctcccggacggggcggctggccgggcagggggctgacccccccacctccctcccggacggggcggctggccgggcggggggctgaccccccgacctccctcccggacggggcggctggccgggcagaggggctcctcacttcccagtaggggtggccgggcagaggcaccccccacctcccggacggggcggctggccgggcggggggctgacccccccacctccctcccggacggggcgactggccgggcggggggctgacccccccacctccctcccggacggggtggctggccgggcggggggctgacccccccacctccctcccggacggggcggctggccgggcagaggggctcctcacttcccagtaggggcggctgggcagaggcgcccctcacctcccggacggggcggctggccgggcggggagctgacccccccaccttcctcccggacgaggcggctggccgggcggggggctgaccccaccacctccctcccggacagggcggctggccgggcagaggggctcctcacttcccagtaggggcggctgggtagaggctcccctctcctcccggagggggcggctggctggcggggcctgacccccccacctccctcccggacggggcggctggccgggcggggggctgaccccccccacctccctcctggacggggcggctggcctggcggtgggtgacccccacctccttcctggacggggtggctgccgggcggtgacgctcctcacttctcagacggggcggccgggcagagacgctcctcacctcccagacggggtcgcggccgggtagaggcgctcctcacatcccagacggggcggcggggcagaggcgccccccacatctcagacgatgggcagctgggcagagacgctcctcacttcctagatgggatggcggccgggaagaggcgctcctcacttcctagatgggatggtggccgggaagaggtgctcctcacttcctagatgggatggcggccgggcagagacgctcctcactttccagactgggcagccaggcagaggggctcctcacgtcccagatgatgggcggccaggcagagacgctcctcacttcccagacggggtggcggccgggcagaggctgcaatctcggcactttgggaggccaaggcaggcggctgggaggtggaggttgtagcgagccgagatcacgccactgcactccagcctgggcaacattgagcactgagtgagggagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggtggcgcgtgcctgcaatcgcaggcactcggcaagctgaggcaggagaatcaggctgggaggttgcagtgagccgagatggcagcagtacagtccagcttcggctcggtatcagagggagaccgtggaaagagagggagagggagaccgtggggagagggagagggggagggggagggagagggcagcgtgtaacctttgtaacttcccccagacttgttttattgtaggcttttttcctcaattactttctcaaccttaatttccacctaaaataaatggatgcagatcaaacaatgtaaagcagactttaatttttttttttttatattatcatcttgatatttatttcagggagcttctgataattggaggtgttgcagcccgggatcagctctctgttttggaaaatggagtaagttgtagttttaatttttaaaacataatgtcatgggctgtcgttttagcaatacagctctgttttgtttcaagaaaatttaagtgaggctgaaattagagcaaggtcagaggagtatgtttgttcaaagacatcttgcaagtgcgccttttcttctcctggaagtatacaaagtctctcccagacctctcaagcaaaattccagcatacatgattttttgttgtttaccctctgaacatttgagaatttccttctggccttcatgggtaaagagtcattctttttggggagataagtgaaaaagaagaaactggagttaagaacaaaagtagaggtaaaatagattgcagagaaggatagaagttcctgcagtgactcttgggaaggatgaataatgataagacagtgggtaatagttccagtgaggagagacatgagttcaattatgtgtaaggggaagtcgcaaaggctgtgctcagccatgccattacgaaggacaaagctaagaggatctgatctccactgttggagaagaagtttaggaattttttttttttttttttttgagaaggagtttcactcttgtcgcccaggctggagtgccatgacatgttctcggctcattgcaacctctgcctcttgggttcaagcagttctcctgcctcagcctcctcagtagctgggattacaggcacccgccaccatgttggctgatttttttgtattttcaccatgttggccaggctggtcttgaactcctgacctcaggtgatccacccgccctggcctcccaaagtgctgggattacaggagtgaactactgcgcctggccgaagtttaggaaatttttaactgtttatcagttctgtgaaggtaggacttcatgaaatatttttcgtgtgtgaaataacttacagcttataaatttctcttttatttcctttcctaaatatttaatcattaaagctaaaccatccgatattgagtcatgacaagcaattgtgtcctttctccaattccattggtgctcttgtcaaactaaattttgtgccacacagactttacatttgacctggtatgccatattaagagcaaggaatcatattaccatacttgttaatactattctaagatgagtaatattgctttgatatgtttttatttagtgctatggttttaatgtccccaccaaaactcatgttgaaatttaattgcccatataatggtattggaaggcgggggcttttaacagatgattagatcgcgagggctttgtcctcatgaatgggttaatgcctttgctgtaggagcgggttagttattgcaggagtttcggcccgttttcctctctttgttgctcctttctgccatgagatgaccctcactagttgctgctggcactatgctcttgaacttccccaaacctccagaaatgtgacaaatattcttttctttataaattatctactttgtgatattctgttaaaacagcagaaaatgagctgaaacatttagtgtgttttattttattttagtggttgtaagagagatttaataagtttattcccaatcttgcttcctcaaacccatttttcccataagataatatgtttctcaattcctattttcctaaagcttatagagcttttagggaattaaatctgctttcatcaggatgtctcaaaatttggtactaacttgaagcaattggaaaggtagtgttataccagagcattctttgcagaattcaattctactctacttcttaggggatctaatatgatctttatctgttcttctctctgtcttacattctctgcttctgttatcttccaccacactctggttcagccttagccctgtgttgggtcttatgctggggcagaagtcagcttggcaatgagagtagaagaattttagttttctaatcttttagtcttacggtattatgcaacatgtgccactgaggtcatataaataaagatgtctcacaggcttttctgatctaactgacttaaaaaaacaaaacaaaaccctgagaggccttgtgtctgtcttcatgcccactttacctgctgaaattcggaaggaggaaactcacgtggttagaatactgtactaaactgatgtcatagaaccagatggtattttgttcactgctgtgtacagcacctgtctcagtgtttggcacatagtagattcttaatacattggacagattttatcttcacattttcagacaatattttctaggttgaacttgctgtaattatcagtgcagatgaaacaatagcttcagaaatgtctgctttatttttcatgggataataagtgcctcatattggatcaagttaaaagttctgtttattcgaggggtgagatattgaagtaatggaactagaggaataactttgctaatagaaaactatatttttagtacagggtggagaaaacaggtaaaaaagaatggaagtgttgttttttaatgcctgccaattaaggagtagaggttttgaattgtctgatttactgaatgatcttatgtaataccttatttgtgctcacataaatacatcatatacacactttatatatttttatttatttatttatttatttttggagatggagtctcgttctgttgcccaggctggagtgcagtggtgtgatctcagctcactgcaacgtctgcctcccaggttcaagcagttctcctccctcagcctcctgagtagctgggactagatgtgcacgccgccatgcccggctaattttgtgtgtgtgtgtgtgtgtgtgtgtattttagtagagacggggtttcaccattttgcccaggctggtcttgaactcctgagctcaggcaatctgcctgcctcggcctcccaaagtgctaggattacaggcgtgagccaccgcgccggcccatatacacactttaaaaatacctcatctttattgactgctttctagaaatgggtcaggcactgtactaaaaacataacatgttcttactcagtacttacaataatcctctgagatggtactcttccccatttttacagattaagaagagggcttatatcaaatattaagtaacttacctaagatcatacaactcataggtagaactttactctgaaacctgtgtgtctaatcaccatacctatggacttgactacaagatatgtgtgggagaatgcaaaatgttaactgtttgtactggcaccgaggctcactgttctcttctatgtatgtttgaaaagttttatttagtattctaaacttccgttttctcattgaatagggatgattatagtagtatttaccttagtggtaacatgaaataaaacatgtacttgtaaaacattttgcagagtgcctgttcattataagtacttgacaaatagtaactattactgttttcctggacagtctgatcaccattactattaactataaccaaatttattgagcacctgggacactctgcgtctagtgctttacgcatcttatctcttaattatcacaaccatcttgaaaaagagaaggtattcccccaattcaaaaatgggaaaattggtactagaggagattaaataaattaaggtcacagagcagagtagtggtggaactgggacttgaactctaggttccgttgagttccagtgaattcatcagatttttgcttggaaaatataaattttatgcattagaatgtatatcagttaaggatgtcaaaatcaattttggtcaaaatcttcacattaatttcaaaccaagtatcagttgaacatatggcattatctgtaactccttttttttttttataaatttagagttgactgactacttcaatatgcatgtttttattaaaaagacagttattggttgctattttaacgtaattatactgtttctttagttttcattaagtggttggtttgctttttttcaggtagatatagttgtaggtactccgggaagactagatgacttggtgtcaactggaaagctgaacttatctcaagttagattcctggtcctggatgaagctgtatgttgaaatataatcatactttttaaaaagtttacttatattttttgagataaaatatataaaatgaagaagaaatataattcagtcatgatcctactacctagagataatcattgttatcagtttggtatattttcatatactttttatttatatattattttatgtagttgaaatcaagatatgaggaatctgggaaaaattttaaaaatgtaatgtcataagtatttcctgtaattgtacataatttataaatgctgtctagtggtctattatatggctacttcatggtatatttaattactcttatttctaggtatgtaggcagatttgatttttgctccaaataaccagctttgtttgtacatacattttctacatactataaatttgttccttgtgtcagagatacaaaatgtagaccatctggaaggacataaatgtgtttgagtctcttagacatacttccaaatcattttcaggttgggttacctagttcctcagcactgagggtttttaattttttatatgaaaagtctgttgaaggatatatgttagaagctgttgactgaaattttcattctagattattagattatggttttggattgcttattgtcactttttcatattttagtcacaagaaacttaaaattgaatttataaattatctttatccaacaaaataattttgaaaatataggactatgtatatgcatgaattagtttccttatattttgtttgatttagaaaaaagatttttgatactgattaaaacttacgtttttttccatactgattaaaaacttaatttattctttgtttctcatgcaggatgggcttctttctcaaggttattctgattttataaataggatgcacaatcagattcctcaggttacctctgatggaaaaagacttcaggtataaaatttatcaatgcatcttaaaatgcatgtaaacaattgttatgtataatgttacgggatcccagggggtgttgcttttctggctggaaacctctgcggctagtgatgcccttgcccgggttttgctcagttccacccacttggcctggcaggctgtgctcagctctcactaccagcctggaccccatgcctcccaagggtgagccaggcgcggagtggtgaggcgtgtatgagcgaacgtggggtctggccatggcacacagccaggcacattggctgcggcagggcgggtagctccaggcactggcatgggcaccggctctctgtgaggctggtggccaggccccgaggcttcaggtcttccccagttgaaggtggggcttcaccggggactagcccccttccgcccaggagcctgtctgcctcctgctgctgttcatggtgcccagactgttcatgccaagggacacgtgcaggccagcactgggccgtcctcagcctgccttggccctccttccgtgttcgctggcgcccaaaggctggaaggggccaaagtggcagtgggttggtgtatcaatgctacctcaagtgtgcacacccagctggcccaagcttgagacagtgcccaacctcggccttaactttgttctgtgatcagagtgggtgttgacagcagggagaggccaggcagtggaagcagacatctccgaacctgtgggggcaagggagggccttttagggccccccgagtgcagagatgtctgggtccgcagccataacttgggcagctgcagccatgcctgggatggtggagctcctgcctgccctggctcccaccaccaccctgggcccagctccatctcagggctcctctctctctgcccctctgtgcccaacctcactgctccccctctggcaggcgactcggcccagccccattgaggtggctcccagggcagtgggctccagggtcctcccaggggtggactctagagactgtccgcctcctctctgtgccctccccgcagcagtggcgggcaagagcggcaacacggggccagggtccagagtggtggagactctgggcctgggagcgggtcctgcccagcttcgcgaaggttggggtggcccagtcagctgccttggggatgcggggcacagggaacccaccaccaccactgcagctcctgcagcctctcttgctgccgctgctcatgtctccccgctgcagccagcttgatggcagcagctgctcctgacggcctgttgctgccatcattaatgcttatgagcagggtcaaagggtttttgtttggtcccctctcattaaatttattactatgtaaaatgtttgctttacgttactggacgaaatagtatactcaaaggtaacagtcttaaaagctgcttttagaaatagaaggaaatttgaggaaattacttgggtgttgcagaaaactacaagtaaaaattcttagttactttgtcctgtagaccgtttagggtgtgtattccagattattagtactgttgcctgttcgaaggaaaaataacttcagctattgaaaaattgttgtcttctctgtagttatatccttctttcttaggaagcatttaagaaggacaagcttttgagagaaggggacagacagtaatacaggatttttggcttacaaaaatgactcattttacttagtttttgtagggacgtgaggaagagatggcatgatttctatgtgacagtgagggaactgaacctcagagaggttaacctgcccaaagtcataactctagttgtcgctacatagagtaaggtgttgaacttatctttggagtctaggctagcacactttgtgtttcatatcagtgtttgtgtgatttattaattattattataaaagttcatctcaatttggggtttcctcttcttaggtgattgtttgctctgccactttgcattctttcgatgtaaagaaactgtccgagaagataatgcattttcctacatgggttgacttaaaaggagaagactctgttccagatactgtacaccatgttgttgtcccagtaaatcccaaaactgacagactctgggaaaggcttggaaagagccacattagagtaagtggtttataatattaacatttatgtagaataaagcaatttataaactaggtcagccttgggctcttagtgatgcttaaggcaatcagttattgtatcaaagaaaagtccaatacatcgtaaacccttagacctttaaaaagcactgaataagtgatggactccatcttttgtttttctgtcttcgtaatattacttttgtgatcagcttccttgatacagtctttataagtaaataacatatatttatctaatttcagatacaatgatttccatttttagtagtattttagtaggagccctcatctgtgtcctcttgatgtactttgttctaaaaatcaatttcatgtggtcatcttgtcactttcttcactgtgattagatttgcctttatatagtaaggttatatttattataaatatacaatattttagaaaccacattttcattattattattacctttaaaagtggtcttagacctatagttaatgaaaggtttttctgaatctgaagaatgattttgcctacagattatattatgaagacatatatctgaaatacagtctaaagacaaatataaatctcccttttaaaacatgacatatattctgaatcattatttaaccactcctctatcctgtttttattccttgcttttgatagactgatgatgtacatgcaaaagataacacaagacctggtgctaatagtccaggtgagttaaaagagtcaaatgtgttgaaagattttgaaaatgaaatttataccttacctattctcatgaaggatgtgaggtgacctgcaaaattaaaacaggaaatttggaaataaaggcaacaaaaataataaaaaagaaatggggaaaagctgatactagtcaacttagaggaatatgaatcattgaatttatttttaattttttgagacagagtcatgttcttgtcacccaagctggagtgcaatggcacagtctcagctcaaggcaacctcggccacccgggttcaagcagttctcttcttgcctcagcctcccaagtagctgggatcgcccgccaccatgcctggctaatttttttatatttttagtagagatggggtttcaccatgttggccaggctggtcttaaactcctgacctcaggtgatcctcccacctcgacctcccaaagttctgggattacaggcatgagccaccatgcctggccttaatcattgaatttagatgttagtctcctggcatctaaatcactttttttttttttgtttttttgagacacggtctcactctgtcacccagactagagtgcactggtgcgattttggctcaccacaacctctgcctcccaggctcaagcagttctcctgcctcagcctcccgggtagctgggattacaggcacgtgccactaccacctggctaatttttgtgttttcagtagagatgaggtttcaccatgtgggccaggctggtcttgaactcctgacctcaaatgatccacccgccttggcttcacaaagtgctgggattataggcgtgagccactgcacccagccacaaatatttttgattatctaattctcatcataggaaaacagcgaatttttctagagagattattttatattgaccctgaattccataagaaatatcatgtaagtttctcatatcaggaatattgcataagaaagaaaactttctttagctatagctttgcaaaagatactgaaattgttttgaaatagttgttgacttttttgtgtgtggtagaatatacataacataaaacttagcattttaactattagtgtacagttcattggcattaagtacattcatattgttgtacaatcatcaccactgtccatctccagaactttttcatcttcttaaactgaaaatctgtatcattaaatatttatcaatttttaaaaagcctaacattaaattccgcctcaatgaagattcttctttgcagagctgagactctttgtttcaggttaaatagtgttttgaaaatataggaaggtacatcatgatacaaggttggtgcttagaaaacctagaagaatggatcttaaacccattaggctgcatgtctgacatgagatgtttcaggtggatcattcattggtgagggtcggactctgcttgcttcatggttgaatttcaactatatcaaaatggtgaattatctgaaatcttgattaaagatttgaactcagttttatatgtaggtctaaattaacaagacacatacttagttatccttattgttggagaagagcagagacactgtttgaaaatctgtcatcccaaatgcattttataaaattccagtttttattgcttcttatatttttcttgcataagttttgcttagtttagactaacaattagagatgatcagagagaccttagaaatatgttgggtcacagaattaaagtcttacattcagtggttgaggaataacaattatagcacagcttcacactgaaaaatagagagttggaggatggtgactaaaaaattactagagttttgtgttaaggtttttactgcgtagagtgaagtatgaactttctggtatttagattgatttagaaagtacattaattatttttaaaaggagttaaaataattgtataaagcatttattgagcatttagggaagttcatgcaaggcagaatatgatttgttcttcatgagagataacagttttgctgtatgtatttctgttaatttgtacgtgtgtatgtgtgtgttccctcataaggggtacggttatgggtgtttatataccccataaagtagcataaaaaatattaacagaaacaaaaataaatgaatgaatggtttaactcactgttttactctatctttacttcttgtccttatctatatataatacttttattaaaacaagtattcttttttaggaaaattaagcagtcagtctgtgactataattatgtgtattcatgacaagttcagattgaaattctgttggtttttgttgttgttatgatattcaagagatgtggtctgaagctattaaaatcctgaaaggggagtatgctgtccgggcaatcaaggaacataagatggatcaagcaattatcttctgtagaaccaaaattgactgtgataacttggagcagtactttatacaacaaggaggaggtaattttttctcacttgaaataaattgtgtttatatcctcttgtaatagattattaatctcatgttgatgcaatctagaacacatgcacagaatttaaagcagttgatggcatattttaagtatctatgcttattcagtacttttccatatgataagccctaggaaaaacaagagagaattttccacgtaggtacattttcattacagtaaacttgaatcacagcatcctaagagttttatattatatggaagaaggataaagtaatttattagtcttaaaatttaaaatatgatcactgaaataatagaatgtatgtcttttaaaccagtagatggggaaaggggaatgaggaaaaaaaacctaaacaagagcaagaaaggaaggggaataaaatgagaaaaattatggttagaaattatagaataagatcaatgttggaaaaatctgaatgtatgagtaaacactgtaagtatcagtggacacggtcttctgttataaagcatggattgttggactggatgaaatctagcaatacgctgtttacatggagcatacccaaaatctgaggacatagaaagatggaaaaggaatgaaaaaatattatgcatgtgtcagctaaaatattaaccaaaagaaagccagtctagctatattaataagagttgcagtagactttaagacaaatattactagaaataaagagtcactatgtaataaaatatccaagctacaatggaagtataagggttcagattttatgcttcttataacttcgagaatgtaaactgtattagtctgttcttatgctgctatgaagaactgcctgaggctgggtaatttataaaggaaagaggtttaattgactcacagttcttcagagctggggaagcaaacacgtccttctttacatggcagcaggaaggagaagtgccaagcaaagtaggaaaagccccttataaaaccatcagatctcatgaggactccgtcactatcacgagaacagcatgaggataaccacccacatgattctattatctcctaccaggtccctcccacatgtggggattatgggaactacaattcaagatgagatttggatggagacccagccaaattatatcataaaccaacatggaaaaattctcaatcagttgttatggaaatgcaaaataaaatgacagtataataccgttgtacatgctaaactaaaaatacaacaccgaattttggctgtggagcaactgcatacagttgttgagaatagattgttggtgagaatataaaatggtatgagcactttagcaaagggtcttgcagtcttttataaagctaaaaatgctgtcttatggcctagcaattaaactgctagatgtttacccaggataaatgaaaacacatattgacaaaaagatgctagaatggccatagcagctttatttataatattctaaaactgaaaacacactaagtgtccatcagtaggagaatggataaataaagtgtgaaatacagtggaatactactcagcagtgaaaaggaacagacttttccttgctgagtaaacacagcaatgatggatgaatctcagaaaccttatgccaaatgaaagaattcttactcaagaatatacactgtatcaatctatttatatgacatttttaaaaagtcagaactaatctgtgatggaaaaaatgtcagaacagtagtagtccccacaagggtggcagtagggataggctgggaaaggatatgagggtattttttggtgtgataatgatgttctgtatcctaatgggactttctcagcaaatctacttaagatttgtagatttcttgaatacaacttttacctcaaaagaaaaaactaaacaaatattgaattctagttaattatatgcatgccgaactctgtactgatgtctgcaatttacattgaaatgtacaaaaatatgaagatgagttgatggatggatacaggtataggtagatatgtggttaaagcaagtataataaaatgttaattgttgaatctaggtggtggatatacaactgttcatccttaaaattatttcagtgttgctacgtgtttgaaaatataaatattggaaaaatataaaaagtaaaaattggcagatatagaaggtaacatacaaatcccattattgtactgaggaaagactaacacattttgttataactgatgtacgtcaaggaaatagaaaactcaagaaggatatagaatatttgaactaatggtcatataaagaatacattacactgttcattacagtgagtgcttaagtaacacattttttttttcaagtcctggcaaacagacttgcttggttgttatagtgactgttttgtagtacttaattttcttcctgtctatgttttgaatggaggagttgattatgtagtaaggagtactgttgattaagtagtaatatccctttagttactttgatgctccttccctaaatattctggatgtagatgttacttctgcctagaaaacaagtttattacaccattactaacactcaaacacaatatataccagattacaggggtttaaaagaagggatcaaaggatccctctcccctccacacataccctaaccagagagttatagtgtgtatttgatacttccctaaaccacttgaatgcaggatgcaataaaatctcagctgtatacctctagaagttctggttagctgttatttcacctctgcataattaatttttgtgttattcattttgaatagatatctgtcaaaatgtattgtttccttgaattttcaagtatacttactgaacttaatttaccttggagaatagttaagtgccataattgttattttgttacatcccagtggttactctttttgttactgtgtctacttgaagagttttcttttggggggttggctaccactgcacttgcctctaaaataacacctctccatctttacagtttgctgctttgaatcttctgtggccatgaaactagataactatgttgcttaaaataccttgagaagagagcaggcttatgggcatggccttttaggaagcacattaacttgatgatgcttaattttggttcctccaagaatgatctcttttgcctactttttgagtcttagctttatggaggatagtgaggttcctggtgtacacataggcattttagttggtacactgcttgatccactcctcctacagattgggaagggtgacttaaaatgcccttaaaagcaggacaactttaatgctccgtagagttcattttaatggtacttcgtttgtgacataaattgtgttaaccatggtttatagcaagttggggcatagatttttatggaattgtgtggcactattgtagtctgaattttattggcttttttacatagtcttaggcagaagattttccaaggttaaatgcttaatgtgcttttcactaggacctgataaaaaaggacaccagttctcatgtgtttgtcttcatggtgacagaaagcctcatgagagaaagcaaaacttggaaagatttaaggtactgatacatagttgattgtttccttaatacttaagaggggcattatatctagttttaagcagttttaattaatattattaaagcaattattgtcctagaaatttcaaaatgtttctaccctaactaatgtgtcatcatcatgacaggaattagtcattgttgacactcaaatggtaaattatacattctctatcagcataacactactataacaggaattttcaatttcagaaattttagttaaattatttcaggtagatatttttaggagaagtatcattggatagttaagccatgtctatgtgccttaaaaacagtctccagcaatagccataaggaacttaatttgtagattaattaagacaggtatcagaatatggctatgtagaattaaaggtattttgatactgtttggggcagacctttccagttatatgcttgcagcacatgaacgggtcatatagctcttggtgtaagtgggtgggtaagtaaatggcttgagccatttagaactaaagatcggtaacctgtctacctgcaagcagtctcattaatttaataggccccagtgtatagcataagtatcattttctaagaaaaaagatgggaagtattgggttgaagaactttggcttacgtttccatgctgggcataattgatgcagatgtgaaaacacatcgcatggcctcgtttgaatgtgtgctacccttctcaaccgtaggcatttttctggaccataagtcagtatacccttcttccctcccccagatctctaattttgctgtgccttgaggcacaaatgacattgaaaggctaatttgtatttcttggtgagcaccaggggcctaccctcattttcctccccttgagaattttgtctgttacaaaaaatgtagcctccaggtaaaatatctagtattctgagtttatttgaatttaagagtaaagataatgcttatgtctgtacattgtattctgttttgtctttctcttcaatttctaaagatatttataaagattaagccaagttttagcaatagtttaatatctttgagtagaaaaagaaaagcaaaaatgaacccaatctctgatttaatcaccttaaatgtcatgtttcagcagatcatgacataaaacttcaagacttggtccagtaaattaggagtatgtcgacctctaatctgatagtaacacttgagtttttagaggtctcatttagtggaaggatagcatttgtttttattgtttagtatatgtgctaacaaactcctttctctcttcactgttctctttagaaaggagatgtaagattcttgatttgcacagatgtagctgctagaggaattgatatccacggtgttccttatggtaaaaagcaactttttatgcctgtagtgtgattgttacggaatctaaagtaaagccttctaatatgtttgaaaaatttagaaactactggcaattgttaataatggtttttatttatagttataaatgtcactctgcccgatgaaaagcaaaactacgtacatcgaattggcagagtaggaagagctgaaaggtacttctgcaattttttttcccccatttttaagcttgtatgctttaggaataaagtctaatagaaggcttttaaccatctttcaggatgggtctggcaatttccctggtggcaacagaaaaagaaaaggtaatctttgtagggctctattatattcattgtgtgtgttgtgattttagatgttggaaataaaagcagtttgattttcccatttaaatttaattcagctgcgtatggaatacaaatgaactttttaatgtcatcttttttcctatattcattgaatggacaaataatagggtgaaatttagaaaggaaaaatgcaaaatataatttttccaactagctttattgtactcatttccaccaaaaaatatttaaacattttctggcatggtgccatggaagacctttcatggtgaggggagatttattttgatataattacaaatttatagaaaagttgtattcataaagagctcccatatactcattgccaaattcagtagttgtacattttgcattatttgctttattattctcttatacaaaagatttgaacttatttttcttttgaacttttttatgttaatattgacatagtatgcttcaatatttactttttcatcctacttttatctgagaattccttttgatatctgacacccattttaggaaaacttttggattattctcaaaaagaactttttcagaagacctatttattcaatgagctactgaatagtagtggtaattggatgatatatcatacctataatctatttttctagtgccttgaggacagaaaacaattaaaaacaaatttagaataagatatttagcatgtctctatctccatgcatgttaatattttttcctttttaaatttaggtttggtaccatgtatgtagcagccgtggaaaagggtgttataacacaagactcaaggaagatggaggctgtaccatatggtacaacgagatgcaggtaagacttcgagttaggctcacaaataatgtattaaaatggtagaatagaaagcatttatcttcaaaaattatatcttggcttttatctgtttgtcacttataagggaaagtcgtagttggttataatgttatctgcactttgctaattgtaagttgtgaatttctctcttcagaaatctgacttccatttataccaagcattctggcctttccagctttatttaatgatgataaaatgcaactctttctaaatgaaatttttatttggaaattttctctccattacttagttactatctgagatagaagaacacctgaactgtaccatttctcaggttgagccggatataaaggtaccagtggatgaatttgatgggaaagttacctacggtcagaaaagggctgctggtggtaagctttgaattattttaaatacaattttaaatgtaaatatacctgttttgaacttcggtttgggaaggcagtactttcatttcattaggttaagagtatatttttagcgtgttaatcattccctccttattaccctcatagtactttgtccatacctgccttgtagcatttttaaattgtgtcatctttatgtgaatgaaagacttcagcttagctctttctcttgaagtgttaatgtcataagagtagttgaacattttgtggaattagtaggaaacaagagcataataggtgattttgaacaaggaatcagaagcctttgacttaactcaggtggtaattcagcatattatttcctctgcctgggatgcccttttgttagcttgttcctgaaaaattgtaagactcaggcctaactagttgtttccgagccaagggtgggtagaggtgttgggacagctgttagtgaggcctaattatttatttatattgaaataattgatttaacattttttaaagtcaaagttctggagataacttgcccagtagtacattttattgctgcaagcaaagtttaaagtgatataattgagccaaagtattgctgacaagttatttcaagcatgtcatttacattactttgttatttgtgtgtgatgcaggtggaagctataaaggccatgtggatattttggcacctactgttcaagagttggctgcccttgaaaaggaggcgcagacatctttcctgcatcttggctaccttcctaaccagctgttcagaaccttctgatttttacatttactgaataagatttgagtaatgaaagtctgtagtcttaaaactctaaaacagttgtactgcttccaagcagcagtatttatagtaacgtaagctattaatgctaactcttgcatgtcaagaaacattagtcttaggaattcttcaaaaaatggcatcccaatgaaaataaatttgatgactatattttcatgaa

SEQ ID NO: 1676 - DNA, 71023 bp, Homo sapiens
  source 1..71023: mol_type = genomic DNA
tcatttataaagaaaagaggcttaatagattcacagttccacatggctgaggaggcctcaggaaacttacaatcatggcagaaggggaagcaggcaagtcttacatggcagcagatgagagagagagtgtgtgtaaaggaggaattgtcaaacacttataaaaccatcagatctcatgagaactaactcactatcccaagaacagcatggggacaactgcccccgtgatccaatcacctcccgtcaggtccctcccttgacacatggggattataattcaagatgagatttgggtggggacatatagccaaaccatatcaaatagcaattaaaaaaaatcacataagaaaagacactcttaataaaatacaaatagaaaatgaaaaaaaaccaactcataaacttggtttaaataatccatttgtattgggtcttagtaagaatactactactagtaactattatcaagcaactactgtgtcatgtacttttcacacattcttttaattaaaaactctccactaacccttacagttcagtattatccttgttttacagatgaagaaaagccaaagagaagttatataactggcaagtttctctggctccccgcctgcaccactgctcaccagattgcatgaagagggaggcagctgtaacacctcatcccgttgatctccagggaactcagatacttgtttccacgtccaggaaaccgcaaactaagctctttgaagcatcagcaaaccttgctaagtgacacgtgaatgccatttggatacatattctaatctttcaagtagaaaggacagtcagactgcctcatctgtaacatccaagggatctgagaacagacattcagtccaggtgttgaacatcaacatcattataggaaaatggtcaaagagaacaatggcacacgttaagagaacatattaatagggcaagatgtatagtaaactaagttttcaagaagtattttatcatttttatgctctctactaaaagctgaccactgtagagtggatacacattgctacatacagcaactctacagtggacagcttttagtagtaagcataaaaatggctttatgttctcatgttctctgtgtagccataccacacgttgctacaccaggaacatgagtacatataaccattacatatacatacctgtatgtatgtatattagttacatatacatatgtacagtatatacatgtatatatattgaacccttggaagggatcagcaaagaggaggactcaataaaaaaagactagaatagaactagaagagagagaagcccagggagagcttcaagaagagtgctcaacagggccaaatgcgcagaggtcaaatagaaggttaagaagtgcccagtggatttggcaaccagagtcactggtaaccttcaaaagaacaatttcagtagattgttaagggcaaaagccagtttacagtaggttaaggagacaaagggagataaaaattcccaacattccattcattcatctatcccagtgtgtacagagtgattactgtgtgtttgttggcagttgactctaaaaagaaggctagaaatgaggctttttaatttttcccaagtactatgagctctgttggcctacaaaatactcagtgctgtgattcactcatttgtgctttgcatatataatatagtacaaactgctaaagatatttttaaaaaatatattttcacaggggtacaagcgatccatgattatacccactatgtttgtttcttctccactcaaagttactcattccctgtagctgaagattgaggacctgatatcatttggacatttctgctggatcaaatggtatcttctcaaaatgaaagtccttccacttcgagtacagtgtctgaactccagttgcaatatcctccaccacaaaactttcaatttttataactggaatctcaaatgtcttgtacttcacatggattccccagtcatggctgcagttctgtcgggcacagaatatctttgctcttttttcaaaacttgaaaactgctttggcttgggatgtggtctactcacaaagcattccttaaaagcatctccaagcacagtgtaatggcattcctacagatgaagggatggaataacacacaaaagagaacgttagaaccagtacataattgtgatttaaaaaaaaaaaaaagaaaaccccacaataatctgaggcaaagaacaggtgggtctcacttattttacaattggaggaaaaaaaaaaatagattcacccaaagtccagaggatccatgcacctgactcccctctacaggcagggtggggttgcaagtgaggacactgggcacctcataaagaagaagattaagaaggttccaggtaacccagcttctgaaggtagatactcattattcaaaaacagaagcgatgtttgctgaaaatttgtgaagctgaagttcaccagtggccctggcaggcacaatccaaaggatacagggaaaacgaccaaggtcaagatgcaattgaagaaggtcagggactaatgtgtccacaggccccacctagagtcaactttagagtaaacagctcagaaacaaatgcagatccaacatactagtccctcaggaaaacatagggtctaaaagggccatttttagtagaacaatcacccaaattggagctgaaaggaccttttacagctaaagaagcagacttagaaaggtaagggaacttagcaatatgactcctaataggctttttgcccaaacagctgagctgatgagagatttctgctttctgaagacgaacggaacatcctgaagtaataactcctcatctgagccagcccagcccctccactgtgccccccatgcaagagttataccccatatttctctttggagatttttctaaccctttctctgaaagttttaagaaagaaatataaggctgcaatagaaggctaatctgcagatgtcacattttacaaataaggagatattttgttttcattataaaagtgatccatagcccaaaaggaatgtttggaaaacataaggtagtaggaaaagagaaaaaaagtcatggaatctcaccaccaaaatattaatacattttggtatagttcccctagcctttgtttttctgtagcaaggtaggttttttgactttttctcttgacaatgacaatgaatgtatttgctgctgttgtttcacacagctacaaagtagcatctttacaattctgtgttctggttacttttttccttattaccattagtttgtaagcagtttttcattatactacataaacttcataattttttaaaataaactttactttggaacaattttagatttaaagaaaaattgcaaagatatcccagaaaatttctgcataccctttacccagtttccccaaatgttaacatctcatataccacagcacatttgtcaaaaccaagataattaacatcagtacattactattatctaaactacagattttaccactctttctctagttgtatcctttatctgttccaggagctaatccaggacacgtcattgcatttagcatgacttttttttttttttttttgagacagagtcttgctctgtcacccaggctggagcgcagtggcgcgatatcagctcaccgcaacctctgcctcccggttcaagcgattctcctgcctcagcctcccgagtaactaagattacagccacctgccactacgcccagctaacttttttatttttagtagagacggggtttcaccatgttggccgggctggtctcgaactcctgacctcgtgatcgcccaccttggcctcccaaagtgttttgattacaggcatgagccactatgcctggccaaaaactatttctttattattgaacatttagtatttttttttcacttcttagctttttttaaatacacagatcatggccacagtaacaatggaaataatagtagttttattataaatatttcaccaacagtaagctgtagctagtgctaaaacatgaccaggcactttgtaaaaaggcagcttacctctatcactcttacgtcagctgtgtaacatgccaaggctttgcactttctgcagagcagttttttattttccttatcaggtacaggttttggtttttcttgactatctctgatgaatttttcatgagtctgtatatgcagaatctaatgcaaaaagaaagaccgcaaatgtaatttgagtacaacatatatagcaagaaacaggcacagatacgtacaatacatatacatgcacgcacatgtataatcattcatatacaacttccatgaacatatggtacctgactttgtaaaatcacagattttattggttctcctaacttagtattagtcaatgcttaattgtggcctccaattagtctttcaatttcttcatcaaaaatgctcataaaagcactaaagatgtccatagaatagtcatatgaactatgctttctactttagtgtttggcaaaacttgggaaaaaaaacaaaacctgtaccagatatacaatatgcgctgtttcaggcataattatatccatttgcaggcacaaactcagtgagtgatacaacaggcagaagagcccctgatatggtttggctgtgtcctcacccaaatctcaacttgaattgtatcttaacagaattcccacgtgttatgggagggacccagggggaggtaattgaatcatggggggccagtctttcctgtgctattcttatgatagtgattgtgtctcacaagacctgatgggtttatcagcgtttccacttttgcttcttcctcatttttctcttgccgctgccatgtaagaagtgccttctgcctccctccgtgattctgaggcctccccagccatgtggaactgtaagtccaattaaacctctttgttttcccaatctcggttatgtctttgtcagtggcatgaaaacagactaatacagcccccaacatctaaaaccttttttctctctccccttcagccacagggaatattgttgcatatgtatagtatgattgtattctaattcaaaatctaggccttggctaagaacatggtccaacttagaaccatggacatgatattataaaactcttcataccaataaacagaaagatctcaaactgaatgaaaaaaaaagacaatcatagatgccaacactgagaagagaaagattttaaagcacctaataaagatgcttcgatgggcaattataaatacttttgaaacataaagagaaaacataaaggctcaacaatgaaatggaagacataaagtttagaactgaaagatacaaccaaaataaaaagttcaatggatgggctttccatagcagaatggaagggacaaagaaaagagtcagtgaactgaaagaacaacagaaattacccaatctgaacaacaaaaaaatacactggggaaaaaaaaagcgcaaagtctcaaggacccgtaggactataaaaaatgatgtcatggcactggagttctgcaaggagtgaagaaagagcagggcttaaaaagtattcacagaaatgacctccaaatatatcccaaatttaacaagctacatcaaccaggattcaagaagctgaacaagctccaaacaggataaaccccttcaaaaaacactctaagacaggttataattaaatttatgaaaactgaagaaaaaaatcttgaaagcagccagaaaaaaaaaaaaaaatgacaccttacccatagggggaaatcagtctgaataacaggagatttgtcattagaaacgatggaggctacctggaagtggcacaatattttttaaacgctgaaagaaaagaacagtccaccccagaaccctagactcagcaaaatgccaccttcaaaaataaaggagaaatgaagacattcttagatgaaggaacactgagaatctgtcatcagcagatttaccctaaaagaatggctaaaagaagttttctaaacagaggaaatgataaaaggaaccctgaagcctcatgaaggaagaaagaacacactgatttcctccatgtcttctatggaagattctgtccgtcccactggtttatggtttatggtggcgcctctccatatcagattatgctttcacgtgtcccaggtggatccagacagcctaggtgcaaatagtgtccctgtcacttagcagctatgtgatttggggcaagtgcctcgtttctttacatacaaaatgggacaatagcatctgcttcacggactgtcaggagataacatgagtttatgactgctcaggcctgcccagcacagggtaaatgcccatcaccgttgcctcttctctgttaggctagtcttatgctaagagccatgaaaatgttaatggggtggcttgtagttttgtattgataaggcaatctccattcattagggattgccttatcaatacgaaactactagctacccccatttttatttttctagaaatatagctattttcatctatttattattttatataaactctagaaccattttatcaagttaaaagtatcatttatgctttcaatatggtttgtgacacgtgaataagcaaatttggggtgaatgcacgtgtttaaaatattcagtcattccattcaagagcatggcatttcttttatcttaatatctcccagtaaaatttttttatttgtcctcatttctgcttcaaacttttctgattaggctggtagatgtaatggtgaaacagatgggttctaccaactctaccatgaactagctgtgtgatctactggcactgaagctattcaagtctcagtttcctgcctataaaatgacataggaggcactactgtatggattgctgtaaagcctattgatgtaagtaaagcatttgcagggactgttggagagtcagtgttctacatgcatgagctacacttattgtcactgcgaatggaaatctccctcccccttatatcttttaattggttacggatcatacatagataatatattgattaccataccacttcaaattcaaatttgctttatataaaaaaaaaattagatctagcttttttttttttttttttttttgagacagagtctcattttgtcacccaggctggaatgcagtggcacaatctcagctcactgcaacttccagctcctgggttcaaatgattctcctgcctcagcctcccaagtagctgggattacaggcaggtgccaccacatccagctaatttttgtatttttagtagagatggggcttcaccatgtcagccaggctggtcttgaactcctgacctcaggttatccacccacctcagcctcccaaagtgctggcattacaggtgtaagccaccacacccggcttcctttcccccactccccctttttgagatagattcctactatgttgccctggctggacttgaactcttgggcttaaatgatcctcccatgtagctggcgcaataggcgtgagccatcatgcccagctagacctagaatgttttgatttaaaaaaacaaatatactggctgggcacagtagctcacgcctgtaatcccagcactttgggatatgccgaggctggcatatcacttgagtccagagttcaagaccagcctgggcgacatagcaaagccccatctctactaaaactacaaaaattagtgatgcgtggtggcacacacctgtagtcctagctgcttgggaggctgagattgcagtgagccaatatcacaccactgcactccagcctgggctctgtctcaaaaaaataaataagaaataattaaaaaattaaaaaccaaatataatttccccttccccacttcttggccccatcccacctgaaattatcttcattatttttgtaaaaataaagggtgtccaggcctcctgtttttaatccaatttttcagttgtaaaactgttacattatatgtatttatcccattctttcctttggacaaatttctagaattgaaatccctgggttatatgatacacattttcctatgagcaattttaattttcttttttaatttctttttcagatatggttctaatcactacttaagcagaatagaggttaccaggaaagaaggtgaaaatataaccttgcctttcaggcatccaactttttaaaaaaattcacttataatggtattcaattatatactgaaattcaattaaatactaataatctcaaatattttaagtgttactctaggcaataggtataaatcctaataagttaaaactattacagctatacttaaaactaagtaaaaatcaataactgggtaaagaggctcaaccaatcataagttaagtctatggcatactgaccttcacccatgcaacctgtggctaaagaagcagcctagctccacacactgaggtggagaaaagcaaactatcttaattatgtgtagtcatgggtatgcatgttggaagttctttgttcagaatgaactttctttcaccccatctttattctctgctccatgaggaaagaaaaacagcttcctcctcattctgatttcaaataaaccttcacaaccacaactgtcataccgttcatcccttattcctccagaatgaaacaccaccaaatcctgaagcgtccaccatggaaatcagttcttggatacctctgggctgtctacatgttaagatggctgcagagtgaccagagaattctggggcgggggatggggagtgctctagtgacagcaggccacacacagacaatggacagtacagctggggcgctggggaagaaagcagtctgccagtactctgctcatccctctccctttcctgttcttgcagattgccctaaagagctccaagcttttgccctctgttctgcagagttccttccttccgttaaaacccatatacagggaccaggatgctcaaacccaaaccccaaacccttatcaaagcacccacaaaaggggggctcacccctagaaccataattccctttagtcttaagaatataagattttccctacctcgttatacttttactaagcctttttttgtttgtttttttgagacggagtcttactctgttgcccaggctggagtgcagtggcgcgatctcggctcactgcaagctctgcctcccgggttcacgccattctcctgcctcagcctcccgagtagctgggactacaggtgcccgtcaccgcgcctggctaattttttgtatttttagtagagacggggtttcaccgtggtctcaatctcctgacctcgtgatccacccgcctcggcctcccaaagtgctgggattacaggcatgagccaccgcgcccggcctttactaagcctttgaaagcaaatccttcccctttgagcagggcagctgggcctggtcatgtatgataggacagggataccaacacaactcaggcttcccagctgccagtaactcccagctacactggttatagggcttcttgttccctaccatctctgcctatctatctgtaagtgttacgggaaccccaaatgctattacatagcctgattcaacagatacttaacccatttcctcctcaccccactccttatcctggtgtgctggctacaaaagaatgcctacatctggtctagcctctctcttcctcaacagacttttactctgttgcttctgtcacatgagtctaagtagcttgtcacctaggagaagagataaaaattatgccatggctattaaaactcgtggttttaaaacgtgtattggcaatatattttacaaaatggaaaggtggctcagtgaagagagaatagagaatcccatccccagtaaaactaagggaggaactaaataatttccctgcaattcttctcactgaaaatgtggaagaggtggttctagataacttaatctcccagctttaggaagaaaaatgtttttagactagtaaacattgacaaagttttgatttgtgtcctaaaataagtgttaatctgctttagataattgatggtcaatactttttggagcacagagattatgactttttaaaattatagacactatggagttggtctattaaactgtaaggttcatcttcatgaagttaaactatgtctcacacttctgtccagtaacagctctcatttcttgggcacgtattttatgccaggcgctaagagatgcaatgcatacatctcatttatcctcatgaccaccctgggagttaaatactattattttccccactttttacatgaggagattgattatttaaaagacagagcaactgcctgaggtcacacatcttgcaactgatagaactgggatttgaaccatggattctagtgttaaagctctcccctagccctgcagtgatcatgcttccagagattctgagatgaaaatctctgcaatgggtctggagaaagtatgggtatgtgtttcttgactttctccaatctgatttcatgtttctgtgttacggaaattacaatgaaatgaaggtcattacactaagaggttgatctgaataggcatcccattccaaggtgtatatcattgtccacagctataaaaagacattccaatacctgcacagtgacctaggagcttttctctgaggactctttggagagagatttaaggaagagactaagaacagctgttttttccagtattaggatatagtcctcgagatgaactgtcaactagagaaatcctagctcaatttgccttttagatctgaaaacataacttcagttattagcactattaaatataatttaacctcattgacatttaaaaacagaatgaatttaatattcactaagtataaactttttgttgtaatataacactctaagcaatatgataaaagataccaaccatcctcctcacattccctgatagttatttatggtcagatgctggaagaataacgtagacttaccttttccctaaatactgcttcgtcccatgtctgaaggcgtaaaatagagtcattcatcattttttctttgtacatgtttatttgttctttttcaattacaccagcattactagtcagaaggaagcacttgctacctcttgctcttcctctgcctattagaaaataaatattttagttggtgtttttgacttaaagctctgatataatctgcaaataggtaaacaaatagaggtactcctaaaattcaactttggttcactgaatcccacttcccaggaaagttgagctgttaaagagtgaactcatgaggcaggattgcttgaacccaggagtttgaagctgcagtgagctaggattacaccactgcactctagcctgggtgacagagcaagacctatctcaaaaaaaaaaaaaaaaaaaaaaaaaaagactcaaatgcaggtgtgcacctgcatgttaaatatgtggaaaaactaggagcccaccttaggctggctttctcagggtctcaacaatgcagggtgattagacagccgtactgtcagaaacactgctttaaagatacctacatgaacccccagtatgacactgtgatggctctaagatgagcagtaaacaggccctccttcaagaaccttctagacaatgaggaaataagatctcttcataaccagcaaaacataggtggaaaattttaagtgctattacaaagacagatataaaaggttataggctttatatgttcaaaagagagatttttgccagctgggaggattagggtcaggtgatatggaggcaggggaagaggtaaaatgaagagtagcagtatctgagcagttccgtcaacaagcaataagtgaggaagtcaggttggcggaagtggataatgcacaaaagggaagaatgggaaataaagttggaatgaaataggtgttggattttggaaactctttagcatcaagtaaattggggaaccactggtgtttcaatacaaggaagtgacacgatcgagctgtttttcaggaaaagtaatatgatagctgtacttatggaattttaagaagaaaaggaaaaaggaggaaagaatagttaggagactagtcaagtccaggtggggcagaacaactctggagtatcccttcttgaatacagggggcccttcagcccaccagcaccaccatgaaaggtttacatgttgactggcaaagcttcaatccaagttggaattattcttccataaatatatcagtcaatgccaggcaagtgagcagcatcattgtaagaatcaaagtagagtttatgttagtgaacaaaactgtagccaccttaagggccaatgataccaaagtgcactgtgccattggtcacatactcaaccatggctcagtaaagagaaaggccagaatgacacatacacttataaatcagtcaaaacagaatccatgtaggaatggcctcaaagcttctcttacctctggtttggatcattttgatgacattgcccacatactcataaaggatgacaagattgcactgtgcaatgtcaatgccttcatcagcaactgaggtggcaatcagaatattgtgatctccactggctttgaatgcatccaatatacacttctgtgccgggagggtcattcctgtgtcagagtaagagggcattatacaactcaccaaagagggaacttcccccttgaaaaaacagctactaattatggaatgcttattatatgccaagtactgtgataagtactttatatccatgatctcacaacacacctaggcagtgggatctattcctatgcctgtttcagaaaggacatttagggtggcatctaacactcagactctgccacaagactgagttcaaatcccagctctgggggacttactagttgtatggctttagccatattatccaagaaatagacatttttgcagaaatatcaacacctaattgtaacacctttacatgtgtgtaagaatttatagctgacaaaacattttcacatcttctcactcaccagagcatcataaagccctataggtcaaagggtaagtgctctgattccccttaacaaacgagggtcgtgccaggcatggtggttcacgcctatagtcataacactttaggaggccaaggcaggtgaatcacttgagcctaggagtttgaaatcagcctggttaacacagggagaacccatctctacaaaaaatttaagaattagctgggcatggtggcacacacctgtagccccagctactcaggaggcttaggtaagagaatcacctgagctggggaagttgaggctgcagtgagccatgatggcactactacactccagcctgggcaagagaatgagactctatcttaaaaaaaaaaaagacacaaatgaggggcttgaggttccagaagtgaggtaaactgacaagctagctatcagcagtgttgggccttgaacttcagtttaagaccctaatagtgtgcactgttggggtgtctgcctccccatacacaaactaagaatcattttctgccacacccacccacaatacagttgtattatgtttctctatgaaagaggcaatgctatctgctcaccaatcttgtttctttctcctgctaggcacacacagctgaattatatttcgcaatctaaactgtcactaatggcatgtagacagaggtcatgtgtgtctcttccaaaccagacccctaaaaattgtccatgttcttgttatttctcatcaatggaccagataaggtcatagtggaggatttggagaccccctgtgatgacagagccataacaaggaaggagcctgggtccctacaataagtggaagaggatggagcagagcccccacccctacctatctacacttgggagcataagtgagcagagcccccacccctacctatccacatctgtgagtgtgagctataacttttattttgccctgcccctgagatcgtgagggttgtctgttagagcaattagattacactgatttatacacagcctgttcctggctgcagctactggactgaaataagcatttgaactatgttgggccaatccaattcttccctcttggaatctgaaattgggattggagacaggtagtaaatcaggaaggtgtggggcagtcatgaatggagaagcagagacagcaatctgtaaagggaaaactgtgaagcagatgtgcaggattcaggattgcaattgtccacaaagcccgagtgcacttccgaactgcgggttctatggtagacccaattatcccggtagcagccacacccccttctacttagactagcgtaagtgggtttctgttaatcggggaaaagaaaggatcttgactaagacaaccacatactgccttctaatatcctgcgatagtggaggctaaatttaaattgtctgaatacagtgtgaagtttggatgtgataatcacccagtttgtgtaatcatggcggacacccaaaatggtggctcaaacaatatgcgcacttcaaaccgtgtggatcctaaagacatctacgtttatctattagtagaatcacctgatctccactcactgctcacagggcggacccacctcaggcaggtagagcaaggtaatccatattactttccattacctagctggcagtggactcaagagtttgtggaaaaagatcccttgtggtttttgaattatttaccattcaaagtcatgaaaattcaaatgcaggcagctttattttcagaaagttgcttaaaaatcaatctctaaacattattttgattttacttttgagctttctttatccagaatactttttttaaagatacatactttctgttatttttgaatccatgtattctcagtaaaaccaaaatcaaacaaatgatgagcattgtggaccattacataaaagttctggatgtgaatagtaactaacatttaacatacattgagcactcaccacatgccaggcattgttctaaaccagaagtgggcaaactttttccataagggctagatgtatagtaaatactttaggctctgtgggtcatgctgtctcagctacccaacactgccattatagttggaaagcagccacagacaatacatacatgaatggtcatgactgtgttcccccaaaaagttattttatagacaatgaaatttgaattgcacaaacctttcacatgtcataaaatattcttttgattttttttcaaacaaaaatcattctcagctcaagagtcattcataagcaggcagtgagccagattttgctactgacattaaccctctcagctaggtactattattatttttccatttgacagatgaagaaagtaagtcatgaagaggttaggtaacctgcttcttcatgaaacaggaaattaagaaatggaaatgtggaaatatacaaatttagcaaactgaacttttgcttgtttacatgcagctttttgtaaaaaaaggtgttcacaattcttctagcttaactgtgcaaggaagaggatcagaccagaaacaaattcagctaaaattgtcttaatttactggtaaatcaagtttaacccattcgataaaagctatagagttcacactgataaactgagtgaagaaaatacttcagtggtctctacctcagggttaacagaatttatagaagctccaattggctaggcatggtgtttcacacctgtaatcccagcattttgggaggtcaaggtggcagattacttgaggccaggagttcaagaccagcctggccaacatggcaaaatcctgtccctactaaaaatacaaaaattagctgggcatggtggtgtgcacctgtaatcccagctacttgggaggctgaggcatgagaatcacttgaaactggaaggttgcagtgagctgagttcgtgccactgcactctagcctggaaaacagagcaagactctgtctcaaaaataaaataaaataaataaaagttccaattttttcctaatatatttccagcccaaatcttgagatatattttgctaaggccaaaacaatttcttttcaccatcatcatctactaaacaatgagcatctctggaacagacatcatacgtgattaatttcttagtttattcatctattcagtcaaacatttattcagcaattatggcttgtcagataaaaataatgattaaaaggtccatttttatccacaaggagctcacattttgtagaagaaaaatataaataagaagctataattgagtatgatgagcacagaaaggatgctatgcgaatgtggaagaaggagctctctaccagtttttggaggttggggaaggctacatggcagaagcacaatgcctggcacagcacaagttataaataaatgttgttgaatgaacggatgaataaatgaacaaaccaataagaaaatatttcctgagtgtctacttgtggaggaacaacaaagtttgaaaatcaaggaggactcatgttggagtcagatcgcagagaactttgaatcccaaccacaaaaatatggtgttagacttcatttggtgagccactttttaagatctgaatctacttttcatatttatgaagtttaaaaatgacatgaagggaaagtgcgagggtgataactagggactgacagggtgggtatgggagggtgcttattataaacaacactaaataggaagacttgtcagtgccagtcactgaggggtggggggcacagctgtgaggtggtcaggatgagggcgggccacctaggatcctcccagataataacacaggcagccttttatcctttgaccactctagctggatttcagaattgtctgcttggactttttaaaattgtaaaatacataatatacacaaaagctatgcatatctactgcttaaagaataacaataaaacagaaatagaacatttctatttctagacaatcttaatctattggttgaaaatttgagcaggatgataatgcgtgcaagcatgacttaaaaaacaaccctggctttgtctgcaggacatatgagaggaggcaatgtctacaaggaaagagcctggagtggtttttggcatttgagcattgtgatggctttttgatgcattaacttggctaggccaaacaacagttcccagtaattcatctaggtactgctctgaagagattttaccgatgggattcaagtccctaatcagttgactttaagtcagatcaaaagagagttcactccaggtgggcctggcctaatcaggtgagccttttaaaagacggcttaggccttctccaaagtcagagactccaaacagctcatgtctggggggttccagtctgttcctgatagtctcttcctgactacctgccctacacgcttcagacttgctttgccagcccaattgtgtaaaattccttgcaagaaatctctgtatatatgcatatgtggacacatatacaacacacacctctcatatatatgtataatcacctactgcttttgcttctgtggttaaaccttgactgatagaagcattaaaacagaacttgaaatatatattaaaacagaatttgaaatatatattatatatatacacacacacatatacatacacacacacacatattcttaaatgcataatccactaaatctaattcactatatataaatacctgtgttctgatttgttttgccacgtccagtcaatatgccaggttttagaaaactgagtttaggatttccttcaatccaattttttaaagcctgaaaatgaaaagcaattatcaattggacactccttataaatcatttgtattaattcaatattgaaatacatgcaaaaagaaaaaaatttaaagttagtacacgtacagttttcagactgacaaacctgagaaaaaaagcattttggaattgaactctatgtaataattaactaaaatggcatagatctctgtaacctgatatggtttaatctctaagactttttttttttttttttttgagatggagtcttggtctaccgcctaggctggagtgcagtggcacgatcttcgctcactgcaacctccgcctcccaggttcaagcaattctttgcctcagcctcccgagtagctgggattacaggcatcagcaaccatgcatggctaatttttgtatttttagtagagacaggatttcatcatgttggccaggctggtcttgaattcctgacctcgtgatccacccacctcatcctcccaaagtgctgggattacaggcatgagccaccgcacctggccatctctaagacatttttaaaagaaaaaacaaaagttcaaaaatagtgggtatgtagaataagtgagtttagcatgatcacaggacaggagatcaatatacataattcaactgaatttctacatactagcaacaaactattggaatttcaaaagtttttaagtactggacacagtggctcacacttataatcccagcattttgggaggccgaggcaggagagtcacttgagcccaggagttcaagaccaacctcggcaacatggcaaaagcctgtctctactaaaaatacaaaaattagctgggcatggtggcacacacctgtagtctcagctactcaggaagctgaggcaagagaatcgcttgaaccggggaggcataggttgcagtgagccgaggttgtgccactgcactccggcctgggtgacagaccgagactccgtctcaaaattaaataaataaaaataaaaattagctgggtgtggtggtttacacctgcagtcccagctactggggaggctgagatgggagaatcacctgagctagggaagttgaggctgcagtgagctgtgatcacactagtgtactccaacctgggcaatgagagtgagaccctgtctcaaaaaaaaaaaaaaaaaaaaaaggttttaaagtaccatttataatagcatcaaaaaattaatacctaggtataagtctaacaaaatatgtgcagaatctgctgaaaatgacaaaacactgataaaagaaaccaaagaacatctggttagtctacctctaaggtagccctcaatgatctccaccttctgtattcagatcctcatgtaatcccctcccctgagtgtgaaggggacttactgacttgcttctaatgaataaaatacaacagatgcaatgtggcatcatttccaagatgaagttatgactgtggcttccaaattagacaccctctatctcaatctctgggatcactctctctaggggaagccatctgctggtctgtgagatggacctgtggagaggcccacatgagtgaactcagaggctcttcagccaacagccatatgagaggagtttggaagttaaccttccccagtcaagccatggccagcaccttcactgcagcctcatgagagatcttcagccggaaacacccagttaaattgtttccagattcatggctcacagatattgtaagataatagatgtttgttgtttccagacactcagttttagggtaattgttcctcagcattatataactaatacggaagccatatataaataaagagatatactatggtcatggattagaacactcaatattgtcaagatgtcattcctccccaattttatctttatgtatttttaaaaatattttattttttcaagaccaagtctcactccatcactcggctggagagcagtggtgcaatctcagctcaccgcagccttcacctcccaggttcaagtgattctcctgcctcagtctcccaagtatctgtgattacaggtgcaagccaccacgctaggctaatttttgtatttttagtagagacagggtttcaccatgttggccaggctgatgtcaaactcctgacttcaagtgatccgcccgcctcagcctcccaaagtgctgggattacaggtgtgagccaccatgcccagcctcagttttgtgttcagattcaataaaatcccagcagattttttcatagatgtggaccagctgcctctaaaatgtatatagaaaggcaaaggaacatagctaaaaacaacctttaaaaaaaaaattggaggactcacatcaccccatgtcaagacttactatcaagctacagtgatcaagacagcatggaatgggtgaagaggtgtatgtatggatcaataaacaaaacagagaatccagaaacagatccatgcaaatatagtcaactgatgttttcagaagttacaaaggcaattcagtgaagaaaggatagtcttgtcaacatagagaactggaacaactgaatgtccatacacaaaaagaaaaaaaaaagaaagcatctcaaccaatacctcacgccttatacaaaattaatttaaaattgactgtagacctaaatgtaaaatgtaaagctgtaacgcttctagatgataacatagtgaaaatccttgtgaccttaggtaagcaaaggatttttagagataataccaccacaggcaaaaacccataaaagaaaaaactgatatactgaactttgtcaaaacttaaaactttccatctgcaaaagatactgtcaagagaataagcagacaagccacagaccagaagaaaatatctgcaaatcacatttctgacagaggacttttttgtcagactataaaaagaattctcaaaaactcaatcagatgatataccaatcttttcaaaagattggttttcaaagatctgaacagacacctcaccaaggcagttacagatcgctaacaagcagaagaaagatgttcagccatattactcattagtgaaatgaaaattaaaactctaatgaggtatcattacctactcacaaaatgactaaaatttaaaaagtaaaaaaaggaagaaatgcttgctctacaagtatcaatacttacaattagagtgactaacatagtgacagcatgaagccaggttccaaaactttgagagggcaaggtgggaggattatgtgaggccaggaattcaagaccagtctaggcaacataacaagaccccacctctacaaaaataaataaacaaattagctgggcatggtggcagatgactgtagtcccacgcatggtggcagagggtgatgaggtgggagaatcgcttgagtttgagaggttgagggtgcagagagccatgactgcaccactgcattccagcctaggtgacagagtgagaccccgtctctaagtgggggaaaaaaaaacaacacagtgaggcattagagtattagtataaggataaacatataatcagaacagaatagagaaactcagaacagactcacacatacacatatatggtttcttgaccgtagagagaaaacggctttttttttttttttagacacaggttctacctctgttgctcaggctggagtgcagagtacgctgtcatgatcactgcagcctcaatcaatcctctagccttagcctcccaagtaactggaactacaggtgcacagcaccagctaatttttcttttttaagagatgaggtctcactatgttgcccaggcaggtcttgaactcttggccccaagcaattctcctgccttgatttcccaaacttctgggattacaggcgtgagacaccatacccagcccaatcttttcaatgaatagtgctgggtccatttgttatctacaaggagaaaaaaagcttacgtccacaagtgctctggttttcacaaagagaattgttattgtctctgggtttaagtggtactcttcttgtaagatgaagcagaggtcttcaagtttaggattctcattgctgggatccctggaaacactttctagttcctgcagcttttctgcaaatgggaaacattttataaatggcttataaattctaaaaatttagaacacactgtgacctttagctatcgttcaaacagctgatctctaaatctttgaccagaattttatgagtagtaagtactgttttaaattggtacaaccttttaagaggtaatttggcaatatatatcaaaacataatacacacacatcttttgatccaataattctacatctaagaatttgagacacagttatatttagaaaattatggaagaggtctccaaggatttcactgtaccactgttcagggtgtaaaagaaaaacagaaaacctaagtacccaacaatagggaaacagttcaaaagatcatgggctatgcatctgatgttaatacaatgtggctgtgaaaattaataagggagctatgtacatgatatatatgataccaaaaatattttaaggttaaaaaaatcaaggtaaggacagtatgttcagtattatcccatctttaaaaatatagtcaggccgggtgtggtggctcacacctgtaatcccagcactttgggaggctgagatgggtggatcacctgaggtcaggggttcaagaccagactggtcaacatgctgaaaccccatctctacttaaaatacaaaaattagccaggcgtggtgatgggcgcctataatcccagctcctcaggaggatgaggcaggagaatcacttgaacctgggaagcaggggttacagtgagccaagatctcaccactgcactacagcctgggaaagagaatgatactctgtctcaaaaaaaaggaaaaagaaaaaaaatacatatagttataaaacaggggtgtgttacagccagatcataccggactatgggactatgggagtcaactgttgtggtttctgttttatcggtttttgtttttgttttttttcctgagatggagtctcctggcactcaggctggagtgcagtggtgcgctcttggctcactgcaacctctgctttctgagttcaagcgattcttctgcctcagcctctcaagtaactgggattacaggtgcgtgccaccatatctggctaatattttgtatctttagtagagatggggtttcaccatgttggccaggctggtcttgaactcctgacctcaggtggcccacccatctcagcctcccaaagtgctggcactacaggtgtgagccaccatgcctggccaattgttaaattttattactttttacaattatctacgcttttgaggttagttacacctattgttatctatatggtagaaatactatagaatgatgtgctgctgctcatctctttttaacactagttcaatgacatcatgttggtagcctggaattcactacagtgggagcagttataccatggaaatcaagaaaacacaaaaaatcagtgctttattgattgactgattgattgagataaggactcactctaccacccaagctggggtccagtggtgcaatctcggctcactgcaacgtctgccttccaggctcaggtgatcctcccacctcagcctcccaaggagctgggaccacaggagcataccactatgctcagctaatttttgtattttttgtagagatggggtttcgccatgctgcccagactgatctccagctcctgagctcaagtaatccacccacctcagcctcccaaagtgccatggtgacaagtgtgagccaccatgcccggcttaatttatgttgagagtttagacttatgaacatgatcaaaaaataataatacagattaaatttagctattacattgaatagcacaaaatattgagaaacattctcccagtttttgaaaaactattatacagttcagcaaaaaattgcttgcatcactggcaaacgagtgaagttccaacatacacctttgttgtttcatctttatcttctaacattaatgaaactatataccaacaaccatatcagaaagaaccacacttctttgtcattgcaacccttggttggccatggatacaaaaaatctgcaaaaaccaccaaaagcattctatgagaaccaattggctatgtggaatttacaataaagaatagtttatttttatttataaattgtggtttgtataactcctctatatcaataaaataataagcttatgtacatatatatgcatacattttttctctagtgggttgttaaatattaaccagcacagcactggttacacatatgtacagtaaatacttaggtagaggccaaaaaaaccccaaaattattagcactaattacctttgggaaagaattcaaaacagggagaaggaaaacttttttttgtttgtttaatatctattttttaatcatatgcaggcagtgagattatgtgccattttggtttcctctttatgtaaaaatatatataggccaggcacagtggctcatgcctgtaattccagcattttgggaggcagagacgggtggatcacttgaggtcaggagtttgagaccaatctggccaacatggcaaaactccatctctactaaaaatacaaaaattagccgggtgtggtggcgcacacctgcagtcctggctactcgggaggctgagacatgagaattgcctgaatccgggaggcagaggttgcagtgagccatgattgagccactgcacttgaccctgggcgacaaagcaagactccatctcaaaaaaaaaaaaaaagtatacataaattatggtttttttaatatcgttaaaacactttttcatatttttaaagctttataaaattactaaaaaagaacgttaaacaaaaagaatgctactgtctgtgaaccatatgggaaacaccctttgcaaatcttgtttttccttcttctaaatagggaatggtataagcaacagactcttcccataggtactagatttcattgaagctaaatagtcctaccatctccatcttcctacatccaggacaactccctaagcatccccaagtttatatatattaaatgcaatacatgtttgttttgccattccagtcaccaagaatgctactgtggcttcctcctctgaaaacaccactcaccttcaaatctctgagtaagatcttgctcaatctcatcgaatcctgctgctcggacattgctgaagaagtctttcaagtaatccagagcatctttcattcgtgcatgctcactgataatgagggcatcattatatttctgttgaaagtaaaaactgtctcaatatgcttccaatgtctaacacattcactgtatttaagttcaattcgttgtatttaacgaattgttttaagaaaacttttcttttcaaatctattccaacttagctttttaaagatgaatggcctctaacagttatgtaacaaaatctttgaaccaaatactgttaaaagaaaactcaattagctagtaacattaattatcatcactttggattattgaattttaccttagaaaagaaaaactgcacgaaaaacacatatcaaaatttaaaaataaggaaagtaaatcaacttccacatcaacctgcctcataattccaacatttcacttgatttctatatacatctgaagccatcactaaattgtcagtgtaccttccaaaatgatggccctgaccacatccatcaaatgtacaactaagctaactaaaattctacaaatgcatgctaattgaatgcattttaatatattttcaatggctggataagcagaggtgatagctgtcactatagttccttaacttcttggtgagccagagaacctggatttctgagcatggggcgtcaccaaaggtgaagaaatgtgtgcttcaggacatagcaacagaactttccacttgctgagctttcaagatgctgtcactggactggtcttgtatctggaataatgttctctcacaatcacccaattttttccaaccatgtcagttaatgctagaggcatggcatagaatctgagcctttatttcagtcctgttgcctgcagtatgaaatttcagaaaggaaatcgagatgatgttgaatgggacaacttttggagtttgcttcataagaactttctggaaaggttcctaagtgagctcttgaggacaggatgagaagttgatgttatcttggcttccacggtgccactcccagtaggtgctgtgaccagaatacgactcttaaaaagaggaacgtacccgcaaatgtgaagtgtataaaaacagggctttacaaatcctgctctcttcatctttgtctggcatctggaacaccatgcatgctttctgaactgtaacaatccattgttcatatttctgtgttccaaattccctattttgaatttgagataagttttctgttaaaaaaaaaaaaaaaagtttttcactgtctcatatggtcagtcatttagggttataaacaggcctcaccctctaattttctttttctttttttttttcctcgaggcagagtctcgctctgatgcccaggctgtagtacaatggcacgatcttggctcaccgcaacctccacctcccggattcaagcgattctcctgcctcagcctgctaagtagctgagactacaggcgtgtgccatcacgcctggctaatttttgtatttttagtagagacagggtttcaccatgttgtcaagctggtttcaaactcctgacctcaggtgatccgcctgcctcggtctcccaaagtgctgggattacaggcgtgagccactgcacctggcctaattttctttcttactctctgcaaacaggatattcctcctgaaatagtcttaagtcatctagttaaaactatttaactggattcagactggtgaaaaggtggaagcagggtacctgaggtgggaggagtaagaaaatagaaactcatgtgactccatcaccatctctccatccttctgctccttcccccattgagataacaccactgtgctgctggataatatgacaacctccaaactgttctccctacctcttgccttgttccctcccttgagttttaagcagtgcatctgtgtgtttgtttgtgtgtgtgtgtgtgtgtgtgtgtgtgtttgattgtttcttgagtactgtgtaccaagaatcaaagtaccttacattcataatttcatttaattttcacaacccatgagatacatattacatttcatatattgggaaactgaagttcagaaaagccaagtaataagtaatttacccatagtcacacagcaagtacgtggagaaagggcaggaattcaaacccacatgtgtcagatgcccaagctctactggctctatgagctgacaaccaaagcagcccagaaataaaacagtagacatgaaaaacccaactttgcctttaaaaatgaagaagtaaaaataacaggtctcaagagcttcatcagaggaggatatataaaagcaggagattggccggccgcagtggctcatgcctgtaatcccagcactttgggagccccaggcgggtggatcacgaggtcaagagattgagatcaccctggccaacagggtgaaaccccgtttctactaaaaatacaaaaattagctgggggtggtggcacgcacctgaagtcccagctacttaggagactgaggcaggagaatcgcttgaacccaggagacggaggttgcagtgaaccgagatcacgtcactgtactccagcctggcgacagagtgagactcttaaaaaaaaaaaaaatcaaggaggagatttaggactcagttcaccctatgttctgctttgctgtgaacttgggcctcctgttctccagagcagcattctcagggccaagcatagaatcggccctcaaaagacacttatcacacatgcatctgtctgtgtgcatctcctaggataagcctcagttgcttggttcaaagctggggcatctgctgtggtccaggctctgtgtagggtgctggggataagatgaggagactatggctgtgttctcaagcagctgagtctgtgagttactctggtatcagttcgccagggctcctcatgaagagcacagtacaacaaaagtcacaagcaagagctgtatttctgggttaaattcttcccctcactcattcattttcaataataggaacaaaggaggctacccaaacaagtagtattgacatgcttctttccaagttgcagctacagcgaggtggccagcagtaaagaagatgagccaacaggtactgattgaacctgggtaggtgtaaaaatagcctaagcagtttagagatgagcagctaactggattcggactggcaaaaaggtggaggcagggtacgggaggtgggaggagtaagaaaatagaaactcacgtgactccatcaccgtctctccatccttctgctacttccccaattcaaaccacatcagtgtgctgctggataatatgacaatctccaaactggtctcccttcctcttgccttgttccctctaacccatactctacccagtggttagagggagtttgcaaaattgcagatgagaaatcatcccaccccactgcttaaaagcctttagtggtcctgcagccaaaatcctgccccagctcacacactcctccccatgctctggcctctgcttgcttttgcttctcatttctggccactctcctttcagcattctacaggactaatggaagtccctatactctttctagtctcctggcctttgcatatgctattccctgtgcctgaaacacaccttatcacccccaccacaccagctgctttagtattagtattacttctctaattttggtcttaccatcagactagaaatgccctgaggccaggggctgtatcttagggttcatgctgtattcccatcacctagcccattccttagcactaaatgaatgaacatatgcatgaacacattcgggaaactgctaaatcaaaaggattcaggtagggaagtagtagaatataacattggaaagataagtagaacctgggtgttcaggcagggctcagactgcaggttagaggcgtgaagattatcctgtaggcaaagggtttttaagcaggacagggacatgataaaatgtattcatgaagactaactagttcatgagaggttgaatggaagagagagcagaggtaggcaaaatcagctagaaggctgttagaacaattataatagaaattaaactgtgaaagaaaaggggagagaaaagcaaaataagtgtgagaggagacactccatgaggtgtcttacagacgtcacatttaacatccctaaaactcaaaactcaaaaccttgtacctgccaaggctgcttctagtcctggtaccaggaccacccactggcattcatagaggtgcctaagccagatgcctggggggaaatcagcccctcctgcccctttctcatccccacccaaatccgtttagccattcaatcataacactcacagttggaagcatctcacatgtgtctccttccttctccaatccatctctactgcctctctttggtccttctcattcactggtatctttattacgtcactaatcagttttaatcttcacttttttccccattgtttttaggataaaattcaaatccaggcccttcactgtcttcccctggcccatctctagtcgcactcctttaatgctgggaaatgtgctgggtgattgtccctagatataaatctgagccagtagaggaatggtggtttcattcaggtgaacaggaaagtcaggagggaaagctgatttagaaggtagagaaagcaatgaactgacttaagtatggttatttttcaggtgcatgtgtctggatgaacttactttggatttaaaaggaaaaaaaggaagaaagaaagaatagaggaggacatataaggctcctaaataacctataatcaaggaagacaacctctggatatggtcttgacattgtctgaactaaggagaacacaaaaagacgatagtgaacaataaatggctattccccagtagagagaacacaaaatatgagatttatctcaccgaggtctttgcagattctctttgccagactctctgtgtccctcatcagctgagctatgatgtatttaaatttgtcgctaatccgtgattccactttcctgaaaactagagacgtcaaaaaaaaaagaaaaagaaaaaaagagtgagtatattttcaggaaggacagattgtagttcaaagtaggtatctctaaaacctttctctgcctttgatacttcctctgaaaaacctaaggttccaggctaactggcaggtggtccagatgatacaacaaatgctcaaaatgcaatggctccctgttgcttcttgtactgattctaacacctgtctttcatggtgtaggtctaactagcttctttttttttttttttttttttttgattgagaccaagtctcactgtgtcacccaggctggagtacagtggcgcgatctcggctcactgcaacctccgtctcccaggttcaagtgattcttctgcctcagcctcccaagtagctgggacaacaggcgcacaccaccatgcccagctaatttttgtatttttagtagagacggggcttcaccatattggccaggctggtctcgaactcctgagctggtgacccacccgccttggcctcccaaagtgctgggattacaagcgtgatccaccgcacccggcctaaccagcttcttactgtggctgtcctgttacctcctctctgatgaggcgggcatctctcatgtctctgcaagtgccacaatctaaccctgtctctgtgctttgatattctccctccccacacagctcccagcagtattcacactgatcctaccatttatcaatatattatttcagcctaattattaattgcctgcaatgtgccatgctttgattatagacagttgaaagaacacacttcatgctccatacagggctgtgatcttaagggagagaaatatacatggctaactaaccgtagcagttctctaacagaagtacatgtaaagtgtagccgggtgtggtggctcacacctgtaatcctaacactttgggaggccgaggagggtggatcacttgaggtcaggaattcaagaccagcctggccaacatggtgaaaccctgtctgtactaaaaatacaaaaaattagccaggcgtgatggcacacgcttgtaattccagctactcaggagactgaggcaggagaatcacttgaacccaggaggtggaggtttgcagtgagccgagatcgcaccactgcactccagcctgggcaacagcacgagactctgtctcaaaaaaaaaaaaaaaaaaaagaagtagtacacgcaaagtgtcacaaaacacagggaaagtaacacctaattcttccagggaagtcagagttgtagaataaatacaggaagaagaaagaagaaagcaagagtagtcatgtatattccatcacaacttggcaaagaaaaagaaaaaaaaaaaagagcagtgatgtacaaaggaagcacagacaaaaggtgggagagagaaagcacacggcatgattgaggagcccagaggaatgcaacatggttgggtttatgaatgtttggaggtgatgaagctcagagggcaggaggaaccggattgtaaagaaattcatatgtgacactgaaaagttgggatcaggtacatcaaaatccttacttacaagcagccttcaaaaaggaacttatctacaccactccctattacatgtctatttgttctacctcagaaatacagtcacatactactcagagagcaagggtgaagtcatatatattttctgtatccctctcttcctttcagggttagtgtaataataacatcaataaacaactgttagtcatattaaaaaatcatatctgatctttggaggagtgacatcatgaattcagatcattccatttcaactaaaatgatcaaatacatattcaaacagtgatgaccacacaggcacagagcatgggaaaaggctgagtgagcccagctcttggctatctgatgcctaaattctctcatcacctcttttgcattgctagtacatttataagaggtttttggaagcaaagaggaagaatgtttgctctctacaggccacttctgaggttcatccattgcttgggatgagagctcagttagagaggctaaaaaatgtgactgttactcaagttcaaggttaaatattttctactaaacagagagagggtcaaagttcagtattcgtctagatggctctgaactagaggtagtagagagtaacagaatctcaaaggcttgttattggatccaacttacacttctggggcttataaacaacttgctccagttcctccagattgtgtttgactgttgctatcactgacgcatcaagagaagcacacagcttgcagatataatccaaggcttcatctgtgtttttggcatccccaacaccaaccgaggcagtcagcccaatgacctgtaaggagcattcaaaatcattagatgtctgagaaatggtacaatgtttccacaacccctcatataactctttcctgctggggtagggcgtttttttgtttttactaacacacagtgtatggcacatggaggcacataatgcatatttactaagtgaacaaatgaataaaggaaacaaaattcataatgagttgtacaatatggacttgggacctgagaaggacatcttcagtgtggccataagagtaagaaaataggagttaggaagattatagctcttctgaagcattcgtctgactttggagatacctggggcagtgggcctgaagatcctccaagtttctgatctagataattaaacatgatcatattgtacgggtgttgtttactagtgttgtggcattcatcaaatatcatcaaagtaaagatggatagtgatggaatcgttccctttttaaggttgttcacaagaatctgtggagttaaaatgatgatgtcattgttctcaacaatctgttccactgggacattctcagctgttgctccagaaatgcctgtaactctatacctgggaaatgacagaaattccatattactaaccacgatgtggataaggaaccacaaagatgaaatgctagatcagaacatcaactgattaaattctccctgagtccaaaagaagaatagctgtaggcaagtccttagcacagagcctgacacatagtaagagatcaataaatccaagctagttgtaatttatagtactatatattattttaagtcactaagagagaaaagagtacgtaaaagaataatatcaaataaattataaaatcactaaagaagttaaatgtgccacgtaaacatcaaatttattcctgaagtcatttactccccatagaagggcaaaccaggggagtttaagttttctggtacatctaacaaaaaagacttgaatccatgaagggataacatctggattataaaaaagctgaatctaatataaatttttttaaatcatttgtcaaaaacaaaacagaaaacacatcaattacatgaagctggagaaaaagaagttgaagcaactattatacctacccatgtctttcaaagtattttgagaatacagatttctgctgttcatacactgggatctgattcgcaaaaaagacaactttccccttttgtccttgtgggaattttttaagatgatgttcacatataagcagtgaaacaaaggtttttccacaaccttttaacatgtaaggaaaaaagaaaacatgtaactcatatattagatatttctctggaaaggtgtttatttttggctcttctaataccactgagctgactaattaattgataatttaaatatgttaatgattacagaatttacactatgactaaaaaatatcaagctgctccctaagtagcatgccaacagccaggacccaaaagcaagctaaaagaggacacttttctttaccttctcatgaaaggtaaagaaaatacattaaatacattaatgtacataattaattaattacataatcccataaaaaacattaggattatattaggacagttttctcaaaagacacatggaacaaggaaaaaactgaaacttgcccattctgtcccagtattcaacaaaagaaaaaaaaggaagcaaacagaaaaactatgtaagtaatggcaataggcttacctgtaggagcacatattattgtgttttttcctttcatagcaggcaaagcaagctctaattggtaatttcttggtttaaatgggctgtacaagtttgtatcagacacttctggaatacaaaaggagcaaaattaccaaacagttcctgctctgaggaatcacggcaatagctacagtctaatgtccacaaattctgactccagcaagaagatcctcattggagaaagtttagaatcctttctcttggtaaccattctagcttttccactaatttgaagtacagaattctctcagtgacaaagtattgatggcaagaaagaaaaaaaaaaaaacatgaattattttttatacaatcatggaaggctaacagaaaccaaagaaagaatggccccattcagggtaagacaagctgtctactaaaggcaatgctgtatgtgaaaaaagcaacaaatcctcccacgatctttgaagaaaaccaaactgttaacattggattctcaaagcaatttcttattaaggagcaataatgctttgtcgttcttcaagttctcaaatgatattttctctcaacataaccagaagttttaaaaaataatcaaaggctttatctcaataacaggtaggcatataaatcattaagagctagcaaagactttggaaattatctactgagtctaacctacccattttagagaaagggagaatttctaaaaggttaagtgaattaaactcacacgaaagacatgtaaaggccaggtgcagtggctcatgcctgtaatcccagcacttgggaggctgaggtggatggatcacttgaggtcaggagttcaagaacagcctggccgacatgctgaaatccccacctctccaaaaaaaatacaaaaattaaccagatgtggtggcacatgcctgtggtcccagctacttgggagactgaggcaggagaatcacttgaacccaaggttgcagtgagctgagattgtgccactgcacgccagcctgagcaacagagcgagagactcagtctcaaaaaacaataacaacaacaacaacaaaaggcatgcaagaatcttcacgtgtcagaaaatttaaagcaactcatattcatgtatctgttttttttttccaaggggtaacagattttattctgaaatgaccaaaaaaacaaaacaaaacaaaaaaacttgtaacattcagttgcagacgtaatctgcacattttctctttatgatgttattctaatatcatttttcttctaccaccactattaatcccaatttccttcctgatactcttttatacataactttttattatggcatattatgcaacttgccggtctcataaaaccatcaagaaaatatgctttgagaagcataagggggcctcacagggccacagctaacttatacagtgcctttgtgtaaatgacaaaagggagctcctcttggaggacacagcccctcagtgcactgtgttgcaaacgacacaggctggatctcagcccctactcaacctctcagccaggcgcatttgggtagcacactaacttcatcaacttgcagggcagcccagggatcctaaaaggaaattgagcaagtgactcagaaatagaagtagtatttatttagaaagcaaggttgatttgggaattcatagacattgggttttggtgaagactctatttgcatttccaatatagacacgcccatactttcttagtggtagaagaagaaaaaaaagatagtaaaagaagaaaaaaagatagtggaagaactaggagagaatggcattctaaatatagaaaaagtatctattgtaacataaattctctttactttcttaattttccttacaaaacttttcacaaggctgtgactttgggtactgcaaaacaagcccccacaccaaataccagaagagcaccattatggaaaaggacaaacaataccaggtacctgaaggtggacatgaattctcactaagattctggcattctggatcttcttggtagaaaatctgtatgtcagaagtttccatcttatcctcaagatcttctgtttcaacatcttttatacctttttaagaccaaaaaagtcttagaatcttcacataatctgattatagttttgatggtgaaagctccacaaaatggtcataacactaagatttttaacttctattaaaatttctcacaaccactccccttcaccttttaaaacagttgaaagaatcattttgagtttaaaatctcaatttggcgttgacctccaatgtaatttagagctatattactcaaagtgtggaacgtattgccctactgaatcagaatccacattttaacaagacctcggagggattcgtatgcaccaaaaaaaaaaaaaaaaaaaaagagcatgatttagcagacattcatgtcttccttttctgactgactcttgacccattaaatcagatgtgtatttatacagtttctgaaacaacttatgatctaaagaagcctaggaaagctaagaccagatattcagatgtttaccaaactcagcctttgaaacaatgctgagtgtcagcttcaagaaaccaaatgatagttcagacacttaatgacaaccaattctttcacccgtcggattcagttccagatggcttccagtaagagaaccaggcaatgtctgtcaagaaatcaactctgaaaagggggtaagtcctggagtttgaacctttaactctagaattctcaagctatttctctgataatctaaacttagactgagagttcggattttgccttcctcaaatcctttgggccagatgggctaattctggatgagagtggttttccccagtccatttttaggggttatatgcaaccaaactaattttgtaggcaagtaactgcctccctcccagaatccagcttcctgctggtctcgcgttagagatgtagctctggctatctgaggggaaaaacgcctctgatgggatgtaaaagaccggttggaatgagcgagtcctaagtagagctgtgaggagggtacagtgtcttacctttctctacaatccacagttcactgaacttgttcctttctttctccaaagcaagtttcaaagttttgggccagttttccttgtctgatctgagaaggcattccaccaatttctctgcacctgccatcatccccttagtagagcaaatctaagcaaggtaactgtagtttattgatcaattatctcaaaagttttccctttatcaatttttactgaagaaatgtcagtcatgtactatctgatttaaagccattgtacattacagctcagtgggtcatatccatgacaatttttgccccatccaacacagtcttttaagatactttttccttcatctttgtcctttacacatgatgtcactatgtcaagccaagccttctcatcacctctaagttcttatacctatcctcatcagcaatattaagaaaataatcatttgacaaccattcccaatatgggtatattggcatatagcaatatttggaaacagataacaaaatattaacaaatttttcttcagggttgaggaatttgtatgacttttactaaccataataactaaagtttattgtacacatactctgtgcaagacatacatgagtactttacatatattatctcattacccttatgaaaataccatattataaggtaacattattatttccattttacacacaaggaaacagatagatattcagagaaactaagtaacttgcccaagatcataccgctagtggttgagctatgattctaacaaaattcatctgtgtccagagtctaaacacttaactgctagagtctgtagccctttctcatttgctcaactgttcaatttaaatttgcataaaatactattcacagactgtggtgattttaactgaaaatagggcaaacttcaaaaaaactttgtgacataaaaattactcagttcacattaaaagtactattctggctgagcacggtggctcacgcctgtaatcccagcactttgagaggccaaggcgggtggatcacgaggtcaggagttcgagaccagcctgaccaacatggtgaaaccccatctctactaaaaatacaaaaattagctgggcatggtagcacgcacctgtaatcccagctactcgagaggcgaggcaggagaattggttgaactcaggaggcggaggttgcaatgagccgagatcacaccattgcactccagcctgggcgacagagcgagactccgtctcaaaaaaaaaaaagtactattctatgagtacttttgtgggtttcaatgatctttctcaggtctaaaacagtatagaaaacagaagaccttcccatgttataattatttcccccaattttagtattttatattaacttacctgtagaatttcttcacattcctgattaattaaacattcagacagatcagaaatgatatcggttgggataattctggttttaaattctggttgtaaacgttttaaaagtaatctatactcctccaacttttcaatttttttgaaatcccaactttcaatggcttcataaagtccagaataacctgaaaaaaaagaaaaaaaatgtggacttttatgaaaccaactgaaaaatactttgagattagtatcatagaaatcatgtttgaatgtatggtggtagaattcaaaaaatatctgtaaattacccccaattgtcattgatttttcaaaaagaaaacagtattcattttagtcagccaacactttaggtcttctagcaatatttattatctattgggaaaaagtactaaggaaaactttgaagtcttacattttgatcttagtataaaatctttcttccaaagtgactcatagacttcacctacaatccctgatttgtctttaaaaagtcagagtcaacaggtttattaagtatcttctcagtggaaagcagtaaagaaggcaaaaagaaatataaaccttaattcctgcccacaaggaactttccttctaatttttctaagataatattaagtaaatgggaaatttacttaatattattctacatgcctttaaaagatatttatttaaaaatcatatttagaaagttcagagaaaaatactaatggccaagaaacatacataagatgttcaacctcattcttttttaaaattgtagtaaaaaacagataaaacatttaccatcttaactatttttaaatgtacagttcagtcgtgttaaattcattttgttataaaaaaaaaatccagacctttttcaccttgcaaatctaaaactctatgaaacaactattcctttttctctcctcacccctgctcctggtaaccaccactctttctgtttctatgaatctgactactttagataatctatataggtggcaaaatacaatatttgtctttttgtgactggcttatttcactcagcacagcaccctcaatgtatgtccattttgcaggatgtgccaggatttccttttttttttaaggctgaataatattccattgtatgtgtatatcacattttgttgatccattcatcactgatggacatttgagttgcttctaccttgtaagctatcacgaataatgctactatcaacatggatgtgcaaatatctcatcaataccttgctttcaattcttttggaaatacaccagaagcagaattgctggatcatatggtgatatatattttcaattttttgagggactgccatactgttttccatggctgttaacaccattttacaatcctaccaatcaggcacagggttgcagtttctccacatcctcacctatatgcattattttctgtttttattttattttattttttgaggcagagtcttgctctgtcacccaggctagagtgcagtggcacgatctcggctcactgcaaactctgcctcccgggttcaagcaattctcctgcctcagcctcctgagtagctgggattacaggcacccgccaccgcacccagctaatttttgtattttttagtagagatggggtttcaccatcttggccaggctggtcttgaactcctgacctcacgatccacccgcctcggccttccaaagtgctgggattacaggcatgagccactgtgcccagctttgtttttgtttttatagaagccattgtaatgggggtgaggtgatattgcattatggctttgaatttctctgatgattactgatgttgaatatctttccatatgctcattagccatttgtatatcatatttggataaatgtctattcaagtcctttgccttttttttttttttttttgagatggagtctcgctctgtcacccaggctggagtgcagtggcatgatctctgctcactgcaacatccacctcctgggttcaagcaattctcctgccacagcctcccgagtagctgggactacaggcgtgtgacaccacgcccagctatgtgtacttttagtagagacagggttttgccatgttggccaggctggtcttgaactcctgacctcaggtgatccacctgcctcagcctcccaaagtgctgggattgcctattttttaatttgattttttgtctttgagttgcaggagttcttgatatagtctacatattaaccccttatcaggtatatgatttgcaaacattttctctcattccatgggttgacttttcaccctattatgtcctttgaggcacataagtttcatatagtcccatttgtctattttttcacttttgttgcttatgcttctgatatcatgtccaagaaatcactgccaattccagtgtcatgaagtttttcccctatgctttcttctaggagttttaatagttttaggtcttatatttgctctttaatgcattttgatttgattttgtatatagtgtgtgatggttaattttctgtgtcaacttgactgggcttagggatgcccagatagctggtaaaacattacttttgggtgtgtctgtaagggtgttttcagaacagattatcatttgaatcagactgaataaagaaattcaccctcactgatgtgtgcagacatcatccaatccattaaagaccaaaacagaacaaaaagggagaagaagggcaaattctcttttcttgagctcatcatttcttttgcccttggacatcagaggtcctggttctcaggccttcagactctgaattacaccaactgctcttctgattctccagattgtggacagcagatcatgggacatctcagcctccacaatcatgtgagccaattccaaaaatatatatacacatacatgtaagtaacaatgtgtatacatatcccatcatatgtacacacacataaatatatcctattgcttttgtttctctggagaactctaatacatggtataagtgtcaaaattcattcttttgcatatggatatccagttttcccaacaacatttgctgaagagactgtcctttccccattgagtggtcttggtatctttgagcatatacttgagaatttatttctgggtgctcttttggcctatttgtctgtctttatggcagtgccacatcattttgattgctacagatgtgtaatgtgttttgaaattaggagaggtgaggcctcctggtttattcttcattatcaaaattttacctattcaagatgccttgagattctctataaattttggataattttttctatttctacaaaaaaaatgccattgcgattttgatagggattgcattgaatctgcagttcgcttttggtagtataggcaacttaagtctttaattcatgaatggggatgtctttccatttatttgtgttatctttcattctttcagcaatgttttgttgtttccagggtatgagtcttttatctccttggttaggtttcttcctaagtattttaatctttttaatgctattataaatggaattgttaccttaatttcttttttggattatttgttaatatatagacatgcgactaattttgaggtgttgattttgtgtcctgaaacttttctgaattagttctaatagttttttctaaaatctttagggttttctacatataagattctgccatcggctgggcgcagtggctcacgcctgtaatccaagcactttgggaggccgaggcaggcggatcacaaggtcaggagattgagaccatcctggttaacacggtgaaaccccgtctctactaaaaatacaaaaaattagccaggcatggcggcgagcacctgtagtcccagctactcgggaggctgaggcaggagaatggcatgaacccaggaggcggagcttgcagtgagccgagattgcgccactgcactccatccagcctgggcgacagagcgagactccgtctcaaaaaatgaatgaatgaataaataaataaataaataattctgccatctgcaaacagattattttccttcttcctttccaatttggataccttgtctttctttttcttgcctaactgctccagctaggacttccaatactaaaccttattcaatttttaaaatgaaaattaaaagtactgtttttacctgacaggttggtaaggattaaaataacttataatatccagattaatcatatccccaaagtggagaaacagtgctttctctgatgagaaacagaaaccagccctttggaaagacttgctccattgctgatttcaaccaacctcctgactgcccctccctttagcagtttcaacacaccaaccaaccagcacttcttcctgataagagaccaccaaccacagagtgggtctggccagtctatgaaggatgtgcagtgagagttttcatgtcctctgcttcaccttctgacatcagagggccaaaaactccacccttggatcttgctaacactgccagtttttgaacatgggtcccatagaaaggcatgaagctcacctgcccaggtgcatgcttctactttcatgactcctcctgtagcttactgaatatttggtcaccctattcagcataaatctctgttttactctccccaccctccaagtgcctgtttcctgcttctggcccgaggctacacttcccagcctgtcaaaatggccaccatgcagactgcaaccctttatgaaaaataaagctctcctttccaaatttatgaacttcatgattcttctgttgatagaaaacaccatagctctgaaaacagaaatgtaaaaattatgtaatatttgatgcatgtaccagaatatttgcaacatatataataaagagtataacaagaaaaggaacatatgtgaacctactatccaacttaagaaccaccatattccagctgggtgcagtggctcatgcctgtaatctcaacactttgggaggctgaggcaggtggatcacctgaggtcaggagttggaggccaacctgaccaatgtggcaaaaccccatctctactaaaaatacaataattagccagatgtggtggtggccacctgtaatcccagctactcaggaggctgagacatgaaaatagctcgaacccgggaggcggaggttgcagtgagccaagatcgtgccattgcactccagcctgggcaacagagcgagactctgtctcaaaaaaaaaaaaaaaaaaaaaaagatttccattaaatatcttctttaagccttagcactgttggacttcagttttgctattcagtagttataaaatgttatctcactgtgttcctaatttacaattcccaaattcctaattgggctgagaatcttttacatttattcacttttcattcttcgtattcattgaaatgtttgtccaaattttttgctctatgtatgttttctttctttttccagttgattttaagactttttttaatatattctagattctaatcctttggtgattatacattttgaaaatatcttctcccagagtttgtgatttgtttttttttttttttttttttgctttctttatagtgtttttgataaacatgatgtaaggaatacaaatgtatttatttattcgtacccacatgggcataaaagttagcgtttgttttttaaatacagggtttatttatttatttatttatttaaatttgagaaggagtttcactcattgcccaagctggagtgcaatggcgcaatctcagctcactgcaacctctgcctcctgggttcaagcaattctccttcctcagcctcccgggtagctgggattacaggtgcccaccaccacgcctggctaatttttgtatttttagtaaagacagggttttgccaagttgtccaggctgttctcaaactcctgacgtcaggtaatctgcctgcctcatcctcccaaagtgctgggattacaggtgtgagccaccacacccggcccagggtttgttttttaaatacaggggtctccctatgttgcccaggctggagtgcagcagcgccatcatagctcactgcagcctcaaactcctggactctagcagtcctcctgcctcagcctcctgagaggctgggactacaggcacacgccaccatgtccagcttgagtttgttcggcttttaatattattctgtttataaatgctattttttgaatagctcctcctttcccagtaatcctcttttctcagtgatgtctaatatatcaggtttccataaagatatggtcctaattagagggtctctattctgtttcaatggtcagtttgtcaatgccaaaaccaacatttcactgtctcaatgcctgtagctttctaataaatgctaacgtgtagaaagaaaagccccaatctactaaatttgtcttctttaggggtgtcttgactattgttgggtcgtaattcttccatatacattgtagaatcaacctgccacactcactgaaaaagtatgtaggatttttattagaattatattgaatatacagatcaatgtagggagaactgatatttttatgatctcaagcctccttctctatgtgcatgggtatgtttttccatttaggacttctttaatatcttttaataacattttatcattttctccattcagaccttatacatcttttgttagatttattcctaaatacattacaattgttattattaaaaatgatacttcattttggattacattttttgtttgcttccattgggcagaaatgcaactaatttttgtatactggtcttatatccaaataatcttgctaaactcttccattagtgacaataatctctctgcagattcttttgttggatgtttcaggtagacaattatatcatctgcctaaaaacagtctttacattgtctcagactaagaggcatgaactataagtggatacttcaaatttaatagcttttcacttttacagtattgtcaagcagcaaagtaatatcctctgatttgtgattaaaaagaatgaactaacctgcatggtctagggcatccaaaaagccacggaaccagccttcctcctggagctccaacaggaacttgagaaaaagtgtggcagcctccattgggcccttgttgtttttctcagcctgaatatactgcacctcttctacaaacagaagcaaaaatgactcatcaaactgcagaactattaatcattagaagaaaaaccagaaaaggatcaccagaccttcccaaatagggacaggaattgtaccaagtcacagcattggaagaatctttggagaagcagcaaaacctctgcccaggccgactgtgcccattcttcaccaagccactcttcccatcctctctggaaacctacagtttggtgtggaggtctgagcacacattctagaaaaggagtttcttgaagatgtgtaaaaaaatctccctgcaaaaagggagaagtcatggtggcctcaaactatcctcctccctcagcctctcaaagtactgggattacaggtgtgagccactgcacccagcctctacaaaaaaaaaaaaaaaaaaaaatttttttaattagttgggtgtggtggctcacacctgtagtctcagctactttggaggctgaggtgggaggatcacttgaaccaaggagttcaaggttcccgtaagctatggtggcatcactgcactccagcctggacaacagagtgaaaacttgtcttgaaataggacaaagaaaggagaaggaaggaagtaagggatacttccatggtccttttgggagaaaattatctaccaacctgctggtggtcattctaactttgtacactaatttcatgcccagggagtagtaataaaaatgctaccatggtatgacctgatacttgataattttctgggttttctttcccattgttgatggaatgcaaattccaagggagtaagcaagttgtcaggctggtgaaccactatattctcatagattagaagaagacctagcacgtaatagacaataaacaaaggtatgtttaatgaatgaaggaagagaagaaggaatgccttataatcttgctctacttaaaaggatctctgccaaggtctctgtcttgacaacaataaaatcaaccctttcaaaaaataaaattcaatggtttttggaactgtgaatccatgactactattttagtacattttcatcactataaaaagaaaacctatatccattagcagtcattccctactctccctctccttagccccaggcaaacactaatcaaattgagtctccatggatttgcctattttacacatttcatattaatggaatcatacaatacatagtctatgtctggcctcttactttgcataatgtttttaaggtttaaccatgttgtagcacgttattattcattcctttttattgccaaataatatcccactgtatggatacaccacattttgtttatccactcatcagtgggcatttgatttgtgtccacattttggttattacaaatagacatgctatgaacattcatgagcaattttatgtgacgatgtatatattcatttctcttgagtacacacataggtgtgagatttctagttcttatggtaactccatttttaacattatagggaattgtcaaaccattttcccaaggagctgcaccatcttacattcccaccagtaatctaagaggattccaatttccacacatccttgacagtacttcttaccatcgttttcattttagccttctgtattagtttcctgtggctgcaataacgaattaggacaaaccaggtggtttaaacaatagaggcttattctctctgttcttggaggccagaattgtgaatcatggtgttagcagagtcatgcttcctctgaaggctctggggagaatgcattccttgcccttccggtttctggtagctgctggcattccttggcttgtgacaacactccctccaactttgccttctgtttctctggcttgtggccacatcactccaatctctgcctatgttttcacacagcattctcgttgtctctatgtcttcacatggctgttttcttagagggacaccagtcatattgaactaggggcctgccctactctagtatgacctcatcgtaactaattacctctgtaaagaaacagtctcccaataaatcacattctgaagtactggggtttaggactttaacatatattttgggtagggggacacaattcaactcataacagcaacctatcttgtcacctatcccagcttccctggacccacaatcctaccgtattccattgagtcagttcattctgttcctaagcccattccttacagctgtacttttgttcccaggcctccctgctgcttgagcttcctttcaacatgctaacagccattacagatattccacgtggagatgcaaatttatcccagccacagctaccgccttcccagataaactgccttgcagtatgctgggcagttcacatttactttgcatgtggtcaggcccatccttctactacctggccccaatatctgctgctacagagtagtgacaatttcctcaaaagcaccaacaatgcagacaaaacttcatctttgacagtatttcccactgcctttgctgtcctggggcccattgtgatgtcaaacctcagcttctcaaggtagaatttcttgatcccttctctgctttctcagtctccttactgactaaagctctttattgactactgactaaagtacttacactgcatagtatatagtaaatgtgggcctgtcttccacctgaaactgtgacttggaacatttgtcttgtgatcatcagcacagtacctggctcacgcatgtgtccagaaagtgctaccaaaggaatggatactcagaatactgcccacctggtgcccctccagaatcatggttggcctttgactccaaaatactataaaaaatctgcagctgggcacagtggctcacacctctaatcccaccactttgggaggccaaggtgggtggatcacttgaggtcaggagttcaagaccagcctggccaacatggtgaaaccccgtctctactaaaaatacacaaattagccaggcgcggtggctggtgcctataatcccagctactcgggaggctgaggcaggagaatcacttgaaccagggagacagaagttgccatgagccgagatcatgccactccactccagcctgggtaatagagcaagactccaaacacacacacacacacacacacacacacacccaggtctgccttgaaacatcctggacaacctgtgagtgagaaaagtgctgcagcttccagggtaccatgcaagttctccaggagaaacatggcttcagtgctccttttccaagacgttactagcgtcaataatcacaatatctgattgcagagagggttagagtaaacgagatgctggatgtgggcacggggggaatgtggataagctccctttgctttccacggatggcaaaaaaatatgagtcaaaagttttatatccagccataacactcattagtgtctctggtccctgactgaatcctcactgataaagtatagttgtcacagcccggcacagtggctcacgcctgtaatcccagcactttgggaggccaaggtgggtggatcacttgagtccaggagttcgagactagcctggccaacatggtgaaaccctgtctctactaaaaatacaaaaattagccgggcatggtggccagtgcctataatcccagctactcgggaggctgaggcaggagaatcgcttgaaccccagagatggaggctgcagtgagctgagagctgagatcccaccactgcactccagcccaggcaacagagcaaggctgtctcaaaaacatatatatatatattatacatttaatatatataaaatatataaaatatatttaatacataaaatatataaaatatatttaatacataaaatatataaaatatatttaatacataaaatatataaaatatatttaatacataaaatatataaaatatatttaatacataaaatatataaaatatatttaatacataaaatatataatatataaaagtatatattatatctattatatatagatataatatatatttaaacatatatattatatatttattctatattatatatcatatatattttatatataatatatatgtttaaatatatatctattatatacaatagatatataatatataattttatacattatatattttatatattaaatatataatagatacaatatatatgtcacaattaaagttaaccaatgaatccagagcctccaaagcagcctagaaaaaaatagggaatagagaaaaactttatcaatctaatagaaaatagaaaaaggagttgaacccaaaaggtatgtggacagagatgcacattataaagtaaaaaggcataaataagaaaaatgtaaatcaacttcataacaatggttgcctctgcagagggaatcaaaagaagacctcaagggtatctttcacattaaaaattaagaagttcttcagggtgctttttcttttaacttactttccggtatttttattgtgattgtactctataaattagcatagggagaattgacatgtttacaaacctatagtccccaggcacaaacataggctgtctcttcctcactcaaatcagagacagatttctcttcagggacttcatagttttcttcatatcatttcagcattttttttgttaaatgtatgactatcttcaatcacacgtaatatcctctagaaaccatccttctacatatctaattatgtgtataaatatatagttttaaataagtaagatttaacaaatctgctcttttccactcagtggattacaggtgttgtttcctattaataaatatgtacctacatcaacttttagtggctgcatagttttatgtcacataaatgtagtataatttaatgtattcctttaacacgaaactaaaatgcgtttagtacacacccatctatgtctttacctgctttaccaacttttccctggaataagttctcagaagtataattcctcagtttaacagtatatgcttttaaatgtggaggccaggcgcggtggctcatgcctgtaatcccagcactttgggaggccaaggcaggcggatcacttgaggtcaggagttcaagaccatcctggccaacatggtgaaacccccatctcttctaaaaatagaaaaattagccaggcgtggtggcttgcacccgtaatcccagctactcaggaggctgaggtaggaaaatcacttaaacctgggaggtggagattgcagtgagctgagattgcgccactgcactccagcataggcaacagagtgagactctgtctcaatcaatcaatcaatcaatccataaatgaataaatgaatcaatgaaggaaggaatgaatgttaatacattttccccaactaccttccaaactgtactaaccctccatcgatagtgtatgaatgatatttccctccatagcactgaatttgctcaatcttcataacctttgcaaaactgagagacaaaaacagaccaaacaaacaaacttcactgtttttaatgatttcttgtgggatttcttccacctttggccagtgtcttttgttttggttatttcttaatacatttcctgttcatgtctcacagctagttttgagaggtcattcatatttttttctaaattggatttgtaagaatcttttatgcatttagggaaatgttatataatctggtttgtttttccagtatatgaaaatactgtttttccagtataatctcacttgttttccagtagataaaaatgcgtggcctccgtttttattttattttacgtatctattgcaacaagactgaatgaactctgttagttccagtaatttgggggaattttgtttttgttctttattttggccagtttgctttctttggagttaactggctgttctttttgcaattacttcagtcaaattaattaattcataagtgttcattcttttgaaataccaataaatccatttaggctataaattctgattaaaagcttattacatcttaaaatatataatatgttggctgattgccgtgcttacttttgaaagtagctatacttgtttagattttctcattctgctagaagttactcaaaaggatgctattttgaaattctgtgaaaatttttttaaacctatgattaatttctgggatatagaataatagctaacagtaatttaataccatgcagtttaatttccaaaacacccaaacatggtttttattctgattttacaaatgaggaaactgaggcatacgagagttaagacatttgcccagtatcacagagcctacaaatttgaaaataaaactcataaaagttatgctttgggaatttattaaatatttatctgtaactcatataggatcactttggcaaagctttttaagaattggaggagaaggatatatttgctatatgatacaaaatggaaaacatagacattaaatcaaccttattaaacagatcatttatgcttttattatcatttatctgacttagcagtactaataaagatatcttataattcccatatttcttgacgttttctaatatttaataaacaaagatttatgtgtaccaaatcttcactgatatctcaatacctttatcattttatcttaatactttccactagtgcaatttaagtataattcttgctttctttacgtatgcatttatttaatatatatttgtcccttctttatctcttttttatttatttattatttatgagacagggtcttgttccattgcccaagcagaagtacagtagcatgatcatagctcaccataggctcaattttcggggctcaagcaatcctcccacctcaggttcccaaagtgctggaattacaggcatgagctgccaagtctggcccccatttttattttttatgttattagactttacatgggtctctggcagatgaccaaaacctggattctgctttctgactcattcacacctatttaaaagatgtttgacctaattacatggccatagctgatataactagttttccttgtgttatcttgtttatatttccctttcctatattttctggttagcttaaattactagtttcttttctcctctcaagaacaacaaaacatataaaacctcatttaaatggtatcattatctgtaaccattcatatagctttttaaaactacagaagcaagtggaaaatggtaatattttaagtctcccccttttgaggcaagggatttaactcttatttatcataattttccctagctcctaacagactcaatctaaaattttaaaccaaagtatttacttaatttttttttttttttttttactatatgaaaatcctctcttaaaaaatgcttgactaggaaccagggcaagatggccaaaaaaggaacagctccggtctgcagctcacagagagatcaacacagaaggcgggtgatttctgcatttccaacagaggtacccggttcacctcactgggactggatagacagtgggtgcagcccacagacagcgagctgaagcagggtagggtgtcacctcacctgggaagcacaaggggtctgggaactccctcccctagccaagggaagccatgagggactgtgccatgaggaacagtgcaccctggcccagatactatgcttttccccccaagtcttcgcaaccagcagaccaggagattccctccggtgcctatgccaccagggatctgggtttcaagcacaaatctgggtggccatttgggcagacactgagctagctgcagttttttttttcatacctcagtgacacctggaatgccagcaagacagaaccattcactctcctggaaagggggctgaagccagggagccaagtggtctagcacagcaaatcccacccctacagagcccagcaagctaaaatccactagcttgaaattctcgctgccagcacaacaatctgaagttgacctgggatgctcaagcttggttgggggaggggcatccacaattactgaggcttgagtaggccctattcccctcacagtgtaaacaaagccaccaggaagttcaaactgggtagaccctactgcagcttggcaaagccactatagctagactgcctctctagattcctcactctaggcagggcatctctgaaaaaaagccagcagccccactcaggggcttacagataaaactcccatttccctgggagagggcacctggggaaaagggcagctgtgggcacagcttcagcagacttaaatgttgctgcctgctggctctgaagagagcaacagatctcccagcacagtgcttgagctctgctaacggacagactgcctccttaagtgggtccctgatacctgtgcctcctggtggggagacacctcctaccagggtcaacagacacctcatacaggagagctccagctggcatctggcaggtgcccctctgggaggaagcttccaaaggaaggaacaggcagcaatctttgctgttctgcagcctccactggtgatacccaggcaaacagggtctggagtggacatccagcaaactccagcagacctgcagctgaggggcctgttagaaggaaaactaacaaacaggaatatcatcaatatcaacgaaaaggacatccacacagataactcatctgaaggtcaccaacatgaaagaccaagggcagataaatccatgaagatgaggaaacgccagtgcaaaaaggcagaaaaaaaatgtgatcctcttctcctccaaaggatcacaactccttgccagcaacggaacaaaactggacggagaatgagtttgacaaattgacagaagtaggcttcagaaggtgggtaataagaaactcctctgagctaaaggagcatgttctaacccaatgcaaggaagctacaaaccttgaaaaaaggttagaggagtgacaactagaataaccagtttagagaaggacctgaatgacctgatgtagccaaaaaacacagcacgagaactttgtgaagcatacacaactatcaatagctgaatcaatcaagcagaagaaaggatatcagagattgaagatgaatttaatgaaataaagcatgaagacaagattagagaaaaaaagaatgaaaaggaatgaacaaagcttccaagaaatatgggactatgtgaaaagaccaaacctatgtttgattggtgtacccgaaagtgacggggagaatggaaccaagttggaaaactctcgtcaggatgttatccaggagaacgtccccaacctagcaatacaggccaacattcaaattcaggaaatacagagaacaccacaaagatactcctcgagaagaacaaccccaagacacataatcatcagattcaccaaggttgaaatggaggaaaaatgttaggtgcagccagagagaaaggttgagttactcacaaagggaagcccatcagactaacagcagatctctctgtagaaaccctacaagccagaagagagtgggggccaatattcaacattcttaaagacaagaattttcaacccagaatttcatatacagccaaactaagatttataagcaaagaagaaataaaatcctttacagacaagcaaatgctgagagattttgtcaccaccaggcctgccttacaagagctcctgaaggaagcactaaatatggaaaggaaaactggtaccagccactgcaaaaacataccaaattgtaaagaccatcgacactatgaagaaactgcatcaactaacaggcaaaataaccagctagcatcataatgacaggatcaaattcacacataacaatattaaccttaagtgtgaatgggctaaatgccccaattaaaagacacagactggcaaattggataaagagtcaagacccattggtgtgctgtattcaggagacccatctcacatgtaaagacacacataggctcaaaatacagggatggaggaagatttaccaagcaaatggaaagaaaaaaaaaaagcaggggttgcaatcccagtctctgataaaacagattttaaaccaacaaagatcaaaaaagagaaagaagggcattatataatagtaaagggatcaatgcaacaagaagagctaactatgctaaatacatatgcacccaatacaggaatacccagattcataaagcaagttcttacagacctacaaagagacttagactcccacacaataatagtgggagactttaacaccccactgtcaataatagatcaacaaaacagaaaattaacaagaatattcaggacttgaactcagctctggacaaagctgacctagtagacatctacagaactctccaccccagatgaatagaatatacattcttctcagcaccacatcatacttattctaaaattgaccacataataggaaataaaacactcctcagcaaatgcaaaagaacggaaatcataacagtctgtcagaacacagtgcaatcaaattagaactgaggattaagaaactcactcaaaactgcacaactacatggaaactgaacaacctgctcctgaatgactacagggtaaatatgaaatgaaggcagaaataaataagttctttgaaaccaatgagaacaaagacacaacgtaccagaatctctgggacacatttaaagcagtgtgtagatggaaatttatagcactaaatgcccacaggagaaagagggaaagatctaaaatcaacatcataatatcacaattaaaagaaccagagaagcaagagcaaacaaattcaaaagctagcaaaagacaagaaataactaagatcagagcagaactgaaggagatagagacacagaaaacccttcaaaaaaatcagtgaatccaggagctggttttttgaaaagattaacaaatatatagaccacaagccagtttaataaagaagaagagagagatgactcaaatagatacaataaaaataataaaggggatgtcaccagtgatcccacagaaatacaaactaccatcacagaatactataaacacctctacacaaatacactagaaaatctagaagaaatggataaattcctagacacatataccctccaagactaaaccaggaagaagtcaaatccctgaagagaccaataacaagttgtggcagtaatggcctaccaaccaaaaaaagcccaggaccagatggattcacagctgaattctaccagaggtacaaagaggagcttataccattccttctgaaactattcccaacaatagaaaaagagggactcctccctaactcattttatgaggccaacatcaccctgataccaaaacctggcagaggcaaaaccaaaaaagaaaatttcaggccaatattcctgatgaacattgatgcaaaaatcctcaataaaatactggcaaactgaatccagcagcatatcaaaaagcttattcaccataatcaggtctgcttcatccctgggatacaaggctggttcaacatatacaaatcaataaatgtaatccatcacataaacagaactaatgacaaaaaccacatgattatctcaatagatgcagaaaacgccgttgataaaattcaacagcccttcatgctaaaaactctcaataaactaggtattgatggaatgtatctcagaataataaagagctatttatgacaaacccacagccaatatcatactgaatgggcaaaagttggaagcatttcctttgaaaaccagcacaagacaaagatgccctctctccccactcctattcaacatactgttggaagttctggccagagcaattaggcaagagaaagaaataaagggtattcaattaggaaaacagaaagtccaattgtccctgttggcagatgacatgattgtatatctagaaaaccccatcatctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaattactacaaaaagaataaaatacctaggaatccaacttacaagggatgtgaaggacctcttcaaggagaactacaaaccactgctcaatgaaataaaagaggatacaaacaaatggaagaacattccatgctcacgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccacatagccaagacaatcctaagcaaaaaagaacaaagctgaaggcatcatgctacctgacttcaaactatactacaaggctacagtaatcaaaagagcatggtactgctaccaaaacagattatcagatatatagaccaatggaacagaacagtcatcagaaataatgccacacatctacaaccatatggtctttgacaaccctgacaaaaagaagcaatggggaaaggattccctatttaataaatgttgttgggaaaactgactagccatatacagaaaactgaaactggaccacttccttacaccttagacaaaaattaactcaagatggattaaagacttaaatgtaagacctaaaaccataaagtccctagaagaaaacctaggcaataccattcaggacataggcacgggcaaagacttcatgactaaaacaccaaaagcaatggcaacaaaaatcaaaattggcaaatagaatctaattaaactaaagagcttctgcacagctaaagaaactatcatcagaatgaacaggcaaactacagaatgagagaaaatttttgcaatctatccatctgacaaagggctaatatccagaatctacaaggaacttaaacaaatttaaaagaaagaaacaaccccatcaaaaagtgggtgcaggatatgagcagacatttctcaaatgaagacatttataccacgaacaaacatatgaaaaaatgctcatcatcactggtcattacagaaatgcaaatcaaaaccacaatgagataccatctcatgccagttataatggcaatcattaaaaagtcaggaaacaacagatgctggagaggatgtggagaaacaggaacgcttttacacttttggtgggagtgtaaattagttcaaccattgtggaagacagtgtgggtgattcctcaaggatctagaaccagagatatcctttgacccagcaatcccattactgggtatataccaaactattgtaaatcattctcctataaagacacatgcacatgtatgtgtcttgcggcattgttcacaacagcaaagacttggaaccaacccaaatgcccatcaatgataaactggataaagaaaatatggcacatatacaccatggaatactacgcagccataaaaaagaatgagttcatgtcctttgcagggtcatggatgaagctggaaaccatcattctcagcaaactaacacaggaacagaaaacctaacaccgtatgttctcactcataagtgggagttgaacagtaagaacacatggacacagggaggggaacatcacacactggggcctgttgggggctgggaggataggggagggatagcattagaagaaatacctaatggagatgatggtttgatgggtgcagcaaaccaccatggcacgtgtatacctatgtaacaaacctgcacgttctgcacatgtgtcccagaacttaaagtataatttaaaaaagaaatgcttgactattgcacttacctttgtggacaaatttataaaattatttaaaatcaactctacatgcctagtttcaacattcacgaccaatccttgcattacaagaactcctttttttaagctaatttttttcagttcccattgtttggaatcacatttccagtaatttctgtaagaaatatatatgagaccccacatatataataatgttttcttcttgcttacatacataaatacctggctaaatataaaataggggcaactttgttttaccttttaaatgctgcacagagttttactctttagttacattagagttgcagagaagtcagagaccaacttgatgttgattccgttagaggaaacctgagtaatcttatttgtggccaggcatggtggctcacgcctgtaatcctagcactttgagaggccaaggcgtgcggaccacaaggccaggagttcgagaccagcctgaccaacatggtgaaaccccatctcacttgaacccagaagtggatgttgcagtgagccgagatcagaccactgcactccagcctgggtgacagagcaggactctgtctcaaaaaaaaaaaaaaaaagccacacgtttgtttttcctgaatgtttacatgattatttcttcatctgagaaatatgaaaatcctactaatgtattcccttctcaataaactcacatgcaaagtgctgtttctttctcagacaagtaaaattttctattttttccatttatctttgcttctgtcttctctctcctttcttggaacccacagtgtaaccaaattgtatagactggatttgtgtgaagatactattaagcactacctcccttgtaatttttcatttgtgaatcatattttcaaaagaactgcctacatttatcttctccacttccttgccctctatttattcctgagtctactcttgcagttagtttcccaaccatcttatacctttaccttcatccctattccacagaaactagtcctgtgggtggccccaaaagtcaataatgccaaagtaagggaacgtttttttagttctgacagaccttgggttctcagcatcattcagccatgttatccaccacatcattctcccttggtttccgtgatgcctccttgcccacatatgtggcactctttcccagtctcttttcctcctctgctcatctcttaaatgagtgcttgcacaggattccgtcccaggctctttctactcacactccaaaaagcaatcttgaaactgaccacagtcccacagacatttattccagaaaaacagaaattgacccttctggtctttaaacttgaagcttacacttgttttatctgagatcctttctcaggcaaaagaccaccaggcctctcaaaaagtatcaaactgaaattcaccagattatcacatccagacaatgaggccaggcccctcattcatcatgattgcttcctgagttcctgttttcccacacagttacatttcttccctgctatataaacccctaattttagtgggtcagggagatggagttgagactaatctctcatcttcttggctacagctcccaattaaaggcttcttccctggcaatacttgttgtctccctgtttggctttctgtgtggctaccaggaggacctaggccaaacccctggtgcttcagtaacagatttttgtggctgggttgctgtggtctaggagtctcagaagccctcctaagcaactgcccacccaattttggctggaagtgagttttggtctctctggccctgctgctgccagccccagctgagttcctgattgctaggaagaacagcctttgaaatgtgacactggcatctggataagtgagtgtcctttcttggcccagacagcaagatctgctcaatttgaaaattttaaaaggagcttccatttgcaggttaaaccagcccaactgactaagaaagggaagcaccctgactctcagtatgatactctagagagcgtgtttgtaatttctgtgtttgtgtctggccaagttagtgtcttttttgggtaccagacagtgggatcggcttctctcaatttggaaaattcctaagaaatttctgtttgcaggttaataaagcccgattgagagagaaaagcacctcgactgtttcagtttggacactgttcgggcttgtctattgcttcagcagtcggattgtgttttgttgattgtatgtgtcaatatagtaatgggaaattagaattcaacaaacaaatattcttttgtactacgtttgccccaatattctttggaatctggagttggctgttgaatgggaaagccaggtggagtcccatgtattctggcttttatgccgctgttttaagcagggttgggcctggtgagtagtttccacatgacgttcttctgtagtgctgtttggccccaggtttctttggaatctagcttctaaaaatcaaactgccatggaaactgctttacccaaaattctggttcacagccttcattggattaccgattggagcaaacaaattttagccatgtggacttggttgtagattcgtgagtttgtattgctatctcatggctagagttccaaggtaaaagctgttggatctttgtgtgtgtatacatgtttagatgtgtttatctagatgtacattaactatgttatacactatacctaccaaattggcttataaataagagtgctcataaattaagtccaaagtgtttttcaagttcacatgacttcagtaaatctttaataaacaagctgtctttaaaattattggtaaaataaaaatagaaatgtcttcagaattgtcagcatacatttttgtctcggctttatatttgtctcagctagataatttgaggtatcagagtttggcagcaggttataaagctataaacccagtgaatatttgtgtgaattctttataagactaatttaatgctgttagtttaatgaaaacagctgaatcttctgagttattgatcaaaatgcccacgtattaattttaaggttatttaggtgaacacctgacattcacaggttataaaatggttaagaaggaaatgatgcagaaataatctagataaactgctaaaaataaataaaatgtaaatggtcaaatgctgtaaatgaacttttggcataatcggaaatataatcattggatgtttgagtcatttccaattaagaaaaggttatgatgtggggaacatgtttctaaaaattgtggaatggttctcatctataaaatactaatatctgctaggcagctcaagatttcttgcttcctaggtttttactgaaatttaaggttgttactaaggataagaattctagttcatatgtaattctatatataaaatgtgcaaaagacaatgtgtttttattcagaaaaaaattttatctaactcagaagttatctaaagtttattaataattatggacttgaaaggttacttatgaaacaaggtagaaaagaacaagtagacgagagagatgtggagaaagttatgagtataaagatgtatttttggtaaggaaggttataaagaaaataattttgtatgacaaagcatcttataatggtattttttttgtcctaaagtaaaatgactgtttaaaaaaaaaaaaagaagaagaaaaagaacgaaaatccaggacaaatcagaaagtctaagcatatcatagatggtgtgtgtaagtcatgtagtttctttcctatttctttgtgtgtctacctttatgtacagacagagaaaatacaaagtataaaaggcttaaataatattctcttaaaaccagatagaatattggagaaatctggctaattaacactgctcatagttaaagctcttagtcttgatgaaagtaaaataagaaatattgtaaagaaacacattggcagtttggcaatcctttcttaatatagttaaccatgaagccagataaaagccagatatagcaacaaccaaatttcacctacatgcttgcattgcttcacactgtatttgctcttctgcatagatatactatcattacagtataatacttactggtcggcctcctccagagtagctgggattatagttgtgtgccatcatgcctggccaatttttgtatttttagtagagatggggttttaccatgttggccaggctggtctcaaactcctggcctcaagtgattcacccatcttggcctcccaaagtgctgagattacaggcctgagccaccacgcccagcctaaagtgaatttcttaattgcacaaaatatatagtggtattggtgaacttaaagacattaaattgtgcatcaggaacaaaatattcatcatgtgtttttttggctctgggtaacactatagcctccaagttaaactgagtagaaaattttcaggttggtttcctgtttgttttttcttttaatttgcatttatttgctgtttcttcttctttaggttttacttatatatacatattaataaaaccattgatggcttttagtttctaatgtaaggaaggcttttatttggttccatgaataatcattttgtttcctatgcatttccagtatctcatcatttgctctacttatccaaagttcctaagctacctttttcaagcttccaaaaattgttggtggacaccagcctttaaaatttgtttggttttgcttacctctaatgaactagagagctataagaactttaagattcctggcaaaaaataataaaaggtttattcttctaagttctgaacagaaatagtacattattattggttatttggaaaagtaggtgagagaaatgtttaagtggtgtttatttccaaggtaattcaattcaataaacaatagcggtttcagatcttttcctttaatgaggcaaaactgctatatgggtacaaagtcttaatattcagaaaaaaattggctttgtctttaaggaaattatattgattgggctttctctcaaactaatttagttgtgtttactattattaagattaaataacatttacttggattaagtcataaaaaaaattataagactttctagtgttttttttatcctaagccatttatcactgatgggccttcacatgtatacttgaaaacaaaatatgtacatacaagtgttatgccagtttgaagattctagtggtgtaagtcacttaaatcagttgtcagtactttatctagaaaccaatcttggaaatgtatgatgaggctctttcaaaatagctgaaaagaaattactgtgtgcttattgtcactttgtccttgttttgttgtatactttttaaatgaaagatttatcttcatattgaatttccaaaactgatacttgcatttaccatttttttttttaatgatggaaagaaaagttaactatcttactttggtaagtttggcacaggacttaccacatttttgaggctctaggtcacagttttgtcactagaatgctagcagataaatgcaaggagtaacctaaccactttaatacaatggattgtataatgggttgaagtgtttcagacagtaactactaggcaccaaatcccagggttttattttgtgacatattagagagaatgatgaggtttcctgcagtataaatatgctattaaataattcttaggaaacaattatttagtaattcaaaggcctttgactcctggatccaaaaaagacaccaatacctgctaaatcttgagcactgacaccaaatgaagcctcgtcttcagactcaggagaaggtgacaatcaaaatgaactgctttcatgagacatagggctagaaattaaaaccattcaatccctctacgcccaggaactattgcacaaaaggtgagcacgtgagcttgtaagggctgattttgagttataaaattagttcagggtttttctataaattaaacattaacatcaaaagcacactgatgcaaggccaatgtctgggcccctgtgtcataacagggttttcttggagcattactctactctttaataggaaatcgtaaaacgttataaaaagatggctgggtgtggtggctcaggctgggcgtggtggctcaggccggggctggtgactcaggccgggtgtggtggctcacgcctgtaatcccagcactttgggaggccgaggcaggcggatcagctgaggccacgagttggagaccagcctggccaacatggtgaaaccccgtctctactaaaaatacaaaaattagccaagtgtggtggcatggcctgtaatcccagctactagggaggttgaggcaggagaattgcttgaacccaggaggcagaggttgcagtgagccaagatcgcaccactgtagcctgggcaacagagccagacaccatctcaaaaaaaaaaaaaaaaaaaaaaacttcacagaaatcctatcttatagtcaaactgattaaaattcggcttataaggttttattaaaattagctttaacattaaaaatataccatacaaaggtaaaatttgatgttctcttttgaataaaatgtttgtataatattgacataaaatatttgtttaccttttgagtgaactgtggggggaagaaaaggaagagggagagacatttagttggcctcatgctgtctttattaggccttattgttgggaaactgagtcgcctatcaaagggtaaatgtgtttgttttatctttttggctaaatgaataactattttgtagcgacctgtgatcctattttgtgatatcaagtgtcttaaatctttgatactgacagacttcccaacagcaaatatttcaagttctaaattcagggggttttttttaacctcaaactaacttttttgtgtattagcttccttgaattccaatacagacagacatgttaggcttctttggtatattagaattatacaggcagcattatcaaatgtgaggtggtatttaacttcctttgggttatatttgtatagatgtgctattaatatgtgttgcaggactatatgagattcctaaaattctgatatgtcttaatatatggtgtcagtaatgatgattattatgttaaattgttgtatgccaacagaaaaaaaaatttccttgtcaactgtgtctttatggctctcctaagacttttgtcattgcaattgttgttttgcattgattcttttcaaaaagtgacttataatcagatatagtccagagcttgtttatttaggggacttcatgaaaaggagtcttgaatgcagatttctgataactttggagactgtgccactggaatacagaaaacttctaggactcttaattagagtccctcttaattaaaaggctgacatgtttataaagattactaacccaatatgaaacacagcaggagttgattgcatggactgaactaatgtgggactgaaataattttttatggttttgtttgaaaaagtctggagaatttttgttttttggaatctggagaattttttcttttaagctcttcataacctttaagaatacagtatattaagtagagtatacccttttaaacagaatttgaggcattttctctctccctaatttctccagaatttataaactatttgtgaatattcttagttcatggcaatgtgttttcttgcatacatttaataaaaatctgttttcttttataaggggacacagttggaggaacaagttattttcccagggctttgactgaaatggccttgtgagaggttccagcaaagccaattaggagagcccatatggacaataatttttgctgcactttgtgtgggtaaataagccaagtatatgtaactgaggcttattttgcaggtaggcccatccagctgtgatatgtctttggtggaagcggggaacagtaatgatacagattgtgtctcagaagaaaactatagtattagattaacttttgattcctggatggccacgtggtcacccatagtatggaactgcccaccacgccattcctcagcatgaagctgccagaaagattgaggatcagattccccatgatccaggaattgataaatagaaagagggggactgaaaccaacacaatagtcccatatacaattctttcgaataaacatggaaattgaccctcctgatcttaaagctgaaacttatatttgttttatctgagttccttccccaggaaaaggacccccaggcctctcaaaaggtataaaagaactgaaactcatcagaccatcacatccagacaatgagacaccaggcccctcatttatcatgattgcttccttacccctccagagtccattttccaacacctagttatatttctttccttctatccatacccctaatttcaacgggtcagggagatggatttgagactgatctcctacctcctttgctgcagctcccaattaaagccttggcaaaacttgttgtctcagtgattggctttatgtgcagccagcaaaagaacctaggctgaatccctggtgtttcagtaacaattgcacccactctcattgtttcagcaaggatctccacattaatgtctccccaactgtggacccttttcctgaactccacacctgtgcagccaacaatctgatgaacatctcttcatggatgtatccaaggcatacaaacccagcatacctaaatccgaatttttctcctcctcctgcaaacctgtccctcttcccacatttcctatctcagaaactaccatttattcacccaaggaccaaagccagagacctggaagtcatttccaccctgtcctcacccttacctcctcaccacaactccccaagagacctattgattatactttccaaatgtgtcttgaatccatccatttctccccattcctccggattcctattttcctaactggtatccttgcttccagtttttccactctgctgtcctggcatcattgcatctgccattctctctctccctgtcttgtacctattcaagccattcctcaaactgaagtcaaagtcgtttttctacaatgcaaattctattttggtcccctctccttatcacatttcagtggataaagtccaaaactgttcatatcccacttctgcttgcctgtcaagtttcatctctctgaactcctgcctctctctccacaatgccaccatactaatattttctggatacctggaacactctagtttctctttcaccttggacctttgcacataaggagccctctaactgcaatttattgtctccttccagctaatttttcctctttctttagacctcagttcaaatgccaaatatctgggaagctttggctgtgccctttggactctagtagacatcccagcttttttccatcaaagcactgctgcactttattatttactattttgttacctgcattcacatagacacactaatcactattagggcagggacagtttctactgtgctcatcattgcttcctcaactttcaatgacactattaggtaataggtgctgagtaaattacctccaatgctaacataatactgacacgagttgcttattttattccatcaaagtgtatcaaatcaatatatgagtgcatgaaaaaatggaattcacaccagttgttagtgtttcttccaagtacttcttcaggtgccaagctacactggtcactagaatgccattccacaacctttcttttagttttgtagagcaattagcattcaagttagttgccggtcttaacgccatttccaaaaactgcaataacatcaggaaagactggcacttggagacttttaggattcccaggccccctctcatcgacttttttttgtttttcggttttttttttttttttttttttttttttggagacaagagtctcacgatgtcacccaggctgagtgcagtggtgcgatctcaccataacctctgcctccctggttcaagcgattttcattcctcagcctcctgagtagctgggactacaggagtgcaccactacgcctggctaattttgtatttttcggtagagacggggtttcaccatattggccaagctggtctcgaactcctgaccttgtgatccacccgcctaggcctcccaaagtgctggctgcagggagccgaaggcccttgggatgtgaccaactcagcattccgctggaggctatatgatcaaacagcaaactgtttatcatgaatgcagcacctgggcaaactcacactgccttgccaccaaatggtttgctgagcgcctcactccctggcgccaggctccttgaaattatttattgagaaatctagcacctattgttcaaagaatgcagtcttgcaagcctgctgtgaatcaagcagccagccaacaagcacctccccttctcgctatctcttttgcctaataagaagggctgtgtaaagctcagggcccttgtccactagaggcaaggtgccccctgaccccttcttccagatatactcttttgtctcttgtcttttattcccgcgttcgcccctctttgttcagtcccctaggtccgtgcgggttacatagtggcaccccgaacagcaacagcatcgggtgctctacagctgggattacagcgtgagggaccacgcccggcctcatcgatatcttttaagtaccacctcctttcacctctttcccagaagcctctgctcatctccagcacaaagtaattcgatacaaatttacaaaatggtcattacccaggatcacctgtctccgaagttagatggaaacacctgtattaaagcctaaagctattcggtctggaaaagtccggctcctctccagcttccacttctttaggcgtgcaaataagattcggcagagtaagcatcaacttcctttaagctcagaccgcactttgtgctcagtactgtaattatctgccctttgtgtcccatcccttggactgtaatgtatactaaggaagagcccttatcttatttctcaatctctgtcagtacccagccaagcacacagtagactttaatattagtgaaaataaatgaaacaaaatttcttccccagctttgaacctaaatagatgagcacccttaagcaagtcacttcacctcgctggaactcagtttccccacctaggcctccgagggctcctcaaactctggcaacctctagcctaaaatgctgcggagatcttaccacaaacctggggagtctggcaggctctctgcattgattaaaagaagggaacgaagcaagagaaaaacaagtcctcaattgttttccgccgagaaggcgccgctggagacactcaccctccctaaaccagggggccatgtagctcaggatgtaggtagggtccagggtcttccggatataatcctggaaggcttgcaggctgcgtcgctgctcggtggtcatgccggcctctgcttgcagctagctacgttccccgcaggctgtgcctcactagctttaaagccgggtaggaggagggcgtggcgagcggggaaagcagggattttccgaggaaatgaggccggacgcgaggcggagctgcataggaactttaataacta

SEQ ID NO: 1677 - DNA, 11328 bp, Homo sapiens
  source 1..11328: mol_type = genomic DNA
ttctatcccattttttcatttatttttatgaggagcctcaaaaaatagaagtggccttggtagggaaggaatgtcgtgattctgagtacagtatggcaaattcttttgcctcagtttccctaactccatccagtgcatatgaaaatgtctatgtgcgtacaaggtaggtctggactaagctctggccctccggttgttttcccattgcgggagcctaagccagggtgcccaggactcctgtgtggctggtgggcctgatgcccacagctgatgattcaggaaggaggggcctggagtctgctgcagactctcccgccccctacagcccaaaccgggcactgcagcaatgaggtggtcagtccagggagaggtccgacaagttctcggcacaatgctgcaggaagtcaaagtcaggcacggagaagggcacgcgggaccactttttggcctggatccgcccctgaggggtctccagcagcatgctgcggactttgagcactggcagcttcactgacttgtagatcatctgcagaccccagacctggaggtgagacagagagggtagggtctgggtctctggcctcagactgggcttctctcctcaagttggaattccctgaatacagggccttttcctcccacctgagatgtcacagactgtgggctcccttagggaggggctggacctccctcttcagactggaggccatggggtgggactgtctcccgtgtcctagtgagggctccctgagggcctctgaagactggggctgaggactctggggcctgggacgtggcctaagctcttacctccccacagttcctgcagctgatgacacccccaggcttccagtccttgaagactttgttgatgaccacaggatccctggagacattatagtagttcctggagaggaaggggggtggccacagccctcattgaccctcctcagccccggatctcatgccctcctgccggccaagtctctgcctggaccttgggccttcctgctggttaagaggcacagacttcccaggccaggaaatccaatctttggtgagttctacctgtgtggcctccatcgcacgttcccttgtgcccaggttcaagcctcagcatcggttacctggtcttcacagtctccttatgggtctctctgcctccatttttactcccaatcccaagccatccttccaccaactgctagagggatctaaaaatataaatctgccctgacattctgttccttaaaatctatccaagattcctaagaggaacctcctggataaaggctacactttcacacctgacctttcaaatcttccacgggctagtctgtctttttctaaatctcattattcacagtcccttccactcaggtcaactggtgtcgcttttttttttttaaaggcagagtctcactctattgcccaggctggagtgcagtggtgcgatcttggcttgcctcccgggttcaagtgattctcatgcctcagccacccaagtagctgggattacaagcatgggccaccacgcccagctaatttttgtatttttttttagtagagaaggggtttcaatatgttggccagactggtcttgaactcctaacctcaagtgatctacccacctccgcctcccaaagtgttggaattacaggcgtgagccactgcacctggccctccatggttaccttctcattcgctcacattcaaaccagacccattgagacctagctgaaatgcaacctcctcaattgagaaaatctgtgtgaagatccttggcacagtggcccggaacacagagggtaacataatgaatggatggaggatgggggaaggttactctctaggagatagtggatggaggatggcccagggatggccaagctctcttgatatcttcggaataggtaggaccagagggtcaatgtgtggtcttttgacacttagtatcctgaattccagttcttgctcaaccagatagtggctgtgggaacttgggcaagtcacatagcctctctgagcctctatttccttgcctgtaaaatggagacagggataaaacctgtctaaccagattattgtgaaaatgcaaagtacttgctacaatgctctttagcttcccaaagcttcaaagcactgtctggatgggaaggattcccaggcccccatcccagtagccccttccacaggtctcacgagaagttggggttcacattgacatggtgggtgccctccaccttccgcaggtcgctgccatggcccacagccaccatgcagttgatgcagagtagctgcacgtgctccactgggaactgctgccgctggttctcccgctgggctgcctgggccgcccgcttggtcaaggctgcctgctgcagatcccggatctggggtgggaggagacaccaggcatggctggggcctaagagaacgttccttgggggacaaaaggttcccaaagaactaagatcatttgtacctggaagagactttccttaaccctccctggagcttaaaagaagctctattgctgtgatgatgcagtaactcatgcctgtaatcccagcattttgggaggccaaggcgggtggatcacgaggtcaggagttcgagaccagcctgggcaacatggtgaaaccccatctctactgaaaatacaaaattagccgggcatggtggcgcatgcctgtaatcccagctactcgggaggctgaggcaagagaattgcttgagcccaggaggtggagattgtgccatgcactccagcctgggtgacagagtgagactccgtctcggggaaaaaaaaaaaaacagctatggagaaaaacagtatgagtagtcgggggcaacagtgggaggggtaagctttcctgctcaatcttgaaggactttaggcaaagctgcttctgtgaatctgtcatggggcatcattaacaattatgctgggacaacagggagcaccctggacaaggcaggatggtggtggccctgcctcaggggaactgatgatataagtcctagttctgggcttatcttctgcacgtggacttatcttgtcccctctgcctggttccagaaaggctgtaatgcagctcttccagatacataaagtatctcatggcaaagataaataaagagccttggacaaggcctgttcccaaggccttctggagtccaggtactgccttccctggcagccccaccccggcccttatttaaaccttccctaggtggccaaagttagccccgagatgtagaggggacagggggacgtatgtgtgcagtcagaaacctgccagggaggggctccctcctccccatccctcccacagggcatgcaggctgcctgcagaccttggcctggtactcggcctggtccattttctgcacagcagccactgcctgctccatcagcgtctccagcgcctcgttgatcagctcccgcttcagctcccggctaccttcagttgctacaaacgcgtatacactctgatcggcccgggcacggcccctggcctgggaagagagacaaggggtgtcctgagttgggctggggccccacacaggatcctataagggcggctgagtggaggaggatgtgagtacctggaccatggagatttcattggtcaagagcccataacgcaccaccacattgcaatgtgggatgtccagcccctcctccgccacactcgtggccaccagaaggttcagggttccatcttggaacttctggatcacttcttgctggtccctctgcaggcggagggcagggaggagaaagaggctggtacatgaggaggctcagactgactccacctgccagagtagcctcttctggttcagccctcactcccaatcttggtccatctccctagagtacttgaatcccatctttatccccaggtacccccaggatcttgcccatcttcccaggtaactgtccaacccctatcttccctagggactcctaagggtccctgcccctctagtctaggaaaaactctcaagccatagtcttctgcaagggaccccagacctgatcctgtgccctgaggaactgcatcacccacctctttccctacggacccccatgcccaaccttctgcccccaaggacctccagactgggagaggctccagcactggggaggtcagtgtccgcccctctcccctagctccttgcccctctgcctggggatagtcaactttctctttccccagggtctccctgcccccacctctctgtgctgaagaccctgttccccgcacttctctcctatggaatccctcccagcgccagcatctttccccgaagcccacacctgggtcatgtgggtgctctggctgctgttcccagccccaatcagtagctgggcccggatgtccacagtctgcaggccctgctgctgctggagccagagcaggagggagtgtgcgctttggcgggtgcgggtgaagatgataccccgagggctgttagagctactgaactgcctttgcaggatcttttccagcatctccagttttggattctctgggccatgagttgccaagtgggccagctcattcttgcggtctgtcaaaaaccccaaaatttagctgggtgtagtggcacatgtctgtagtcccagatacttgggaggctgagggcagaaggatcgcttaagcctaggaggtcaaggctgaagagagctatgattgcaccactgcactccaggctgtgtaacagagtgagactctgtctgggaaaaaaaaaaagaaagcaagaaagcaagagaaagagagagagagaaagagagaaggaaagaaagggagggagggaaagaaagaaaaaaaggaaaagaaagagagagagaaagagagaaggaaagaagggaaggagggaaggaagggagggagggagggaaagaaagaaagagaaagaagaaaagccccagaggcagaggattcagatcttggagtggggagggcactggcggaggaggttctcacagcaataggactgtaggcgtgcagaaggtggggggtggggggtgggggaaggatggaactcctgctcaactcccccacagcagcaccaagaacatatttaaggatgccctggccgggtgcattggctcacgcctgtaatcccagcactttgggagggtgaggtgagcggatcacctgaggtcaggagttcgagaccagcctgacaaatatggtgaaaccccgtctctactaaaaatacaaaaaaattagctgggcgtggtgatgcacacttgtagtcccagctactcgggaggctgaggcaggagaatcacttgaacccaggagggggaggttgtagtgagctgggatggtgccattgcactccagcctgggcgacagagcgagactccctctcaaaaaaacaaaaacaaaaacaaaaaaggatgcctcctaccgagcccactctcaaggccagcctcacaccggggtcatacagtacagaacctcagaccagaaccctcttctccccagtgaccaggatgacccttgagcttttaactctgacctctgctacccagatctcttgagccccagcctgtgctgcgatttgcaaccttaaatttcaccctctgactttcagcttcactctctcagtctaaaggaaccactcctagctaatccttttaaaaaatctgggccgggcacagtggctcacacctgtaatcccagcactttgggaggcagaggcaggaggatcacttgagcccaggagttagagatcagcctgggcaacaaagcaagactccgcctcttcaaaaaaaattttttttaattagctgggagtggtggtgcccacctgtacgcctagctacttgggaagctgaagggtgagaattacttgagcccattaggtcgaggttgcagtgagctatgattgcacaactgtcctccagcctgggtgacagagcaagaccccgactattaaaaaaaaaaaaaaagtcaacaatgttaattaattttaacaactaagcaaaaaccttcacaaatgaggaaataaatcagtcctacccatggccttggattttggttagaaaaataggatctccaccagtatcctcacgggcaccttcccatccgaccttggcgcctgtgccctggcctctgacctcgcatccaggtcccatcatccccggccccgaagccccctcccgcccctcaccatcgaacagggccagcagccggcgctcggcacacaggatctgggttttagtgacgtgctccctgtgatagaaatcctgcagcgcagccaaggcatccacggcgcggacggtgtcatggatgagcagcgcgtcattgtagcgcctcaggtgaagcgcatacacccgttgctcctgaagcccagccaaagccgctgcgggaagagggcgcagggtctgagcagcccacagccccgccccctgccctgccccatagggccgtcccactcgactccacccctggggtggataggccccgccccaaaggcctccgccccggcaggccccgcccctgaccactcccacatcctcgcctccgccagaagggctgcccctctcaccagcctcactcagcttcaccacctgctgctcatacatttgcgtcccaaatttccggctcaactcaggcatctccaggtggtcatggatttggtccatgagcttcttcagcaagtccccaaacggatcctgagcaagaggagagttggaggggattcccatacacgttggaggatgggcacccagtgggggtgctgaccccggcgtgtagcacaccgcgactgcctcacccatctgtcttagctgtggtgtgagctccagagggaggccggctagggtgtgggggagtcctgccctgtctcacccgcgatgtgctcttaccctttggcctgggcacggtgatgcctagtgtaaggcacatggacgtgctttggtcaaggaataggccgaggcggacatccgggccagagtgactcagcgagtttggggggcaggcacgtactccacttgctatataacctgtttgtgtaagttcatactggactctactgtcagtagaaggtaaaactgccctgctgacgctgttcacggagcttggttcagctcggcacggcagggcacgcttgctcgcccagagagagaataatgctactaacccctgcaagggacagccggtcgccttgaaggtgggcagtggggagccaggaacccgcttgtgcccagagggaaagagttaagctgctgaccctgacagagctggccttgccggccagggagagcagctgcaggcgtgggggcagcaggagccacagggccggagcagacagcccagataaaggtggacagtgtgagagagccgctgctgaataaaactacatttcacctgcctatggccccccaagggttctttcagctatctgctcactcactccctccctccagaccacagcatgggctcaaacctgaccccaagtgtaacatttggtatagttatggacctgacacctagtccttgtccagtccagtcatggcagacacgaggccgtgtccacactagagagggctcagtagagcctcagcacaaagtatccctgctctctggtttgtagtgcactccccagcatgacagtgatgtgacagacaccagtggtgccttctgagtcaatccaaagagcgggctgtgggcatgggctgtatctgccccatttcacagaaaggagaaattgaggcttggatacatagcaagtgacctgaagtcacagagctagtgagggcagagtcagggcccaagcctaggtgtcctaacttcacaccggctcccgctctcgccgtgtccctgcccccgcgtacctggctgcgcctgtggcagaggttgtactgtttgcaaggctgttggctgtgctcctgcagctgggggcagcagttctggggtgacatgatgcaccacgtgtccaagttggcacagagctgggggcaacagaggactttactggaaagggagggtctgtggggacaatggtcaaagatttggggcaggatggatcccagctgaggacaggagaatgtgggcattcgtctactcaaatattgctcgccctctctgtgcccgtcttgttctaggcactggggatacaaaggaactcagattggagttggagaggcagataataaaccagtaaaagaataatagaaccggccaggcatggtggctcacacctgtaatcccagcactttgggaggccaaggcgggcgggtcacctgaggtcaggagtttgagacagcctggccaacgtggtgaaaccccacctctactaaaaatacaaaaattagccaggcatggtggcacgcgcctgtagtctcagctactcgggaggctgagacagaagaatcacttgaacccgggaggtggaggttgcagtgagccaagatcgtgccactgcactccagcctgggtaacagagactccgtctcaaaaaaaaaaaaagaggctgggcacagtggctcacgcctgtaatcccagcactatgggaggccaaggcaggtgaatcacgaggtcaggagttcgagaccagcatggccaacacggtgaaaccccgtctctactaaaaatacaaaaaattagctgggcatagtggtgggtgcctgtaatcccagctactcgggaggctgaggcaggagaatcgcttgaacctgggaggcggaggttgcagggagccgaaatcatgccactgccctccagcctgggcgacagagtgagactccatctcaaaaaaaaaaaaaaaaaagaaaacaataaaaccttgcagagcgcattaacaagctctgaagaggatagcactggatgatatgacagagagcagagatcagggaggactttcaagaggtggcattaagctgttcaatgaatgacaaggaggaggcagcaggaaaagttcaaagggaagcgcattctaggcaaaagaaatggtaaatgcaaaggtccccgagatggaacaagccctacatgttcaacatgcagaaggcaggccagtgtaactgtaggatgagctacaacagggagggcgcaggaaatgaggtggagaggtagatcacgtggaactttgtaaaccacagtagagtcgggagttaattctttgtaccataagaaaccattggaggctgggtcttaggtgaggaaggggccagaccctgccatggagagcctggtagggctggtggggacggggtagtggcagggcaggcagggagggagggaagtccctggtgggtctggcagtgggaggcccacaggggccaggctgacctgcaggacgtggttgatggccccatcgagtttggaggccccgccagtgcctggggaggctgtgagacccagcacctggggtagcggctgtgccctctggagtttaagttctaggtactggctcatgatgacgttgtagacggtgtccttgtgcgtgtggtggcactcatccaccacgatcagggagaagactgagggcacaggggggaaggctgtgacctatgtttgcaaagcccttcctcccatcagctttcaagtagtccccacaatgatgtaagaattccttcttcccttcacaacctgcagctggtcccaggatgaggagccaggcagggaagacttctttccatttcacagattagtaaaccgaggctcagctggggaagggactggcctaagatcctacacgatagcccggcctgtttctactagagtgcctgcaggggttttgtgaacaggcaacccctcactcccactaaaactcccaacaccttgactccaggaggtgccctggggttggcgaaaggaggtaccccagatgcgtatctttttcctcccggccatggccctcaccagtgagctccacgtgctcctcctcctcggggctggtcagtgccatctgcagaagctctgctgtgcagatgagcaggtcatggcaccgggccaggtggccaaagccagcacgtggtcccatgtccccactcagggttgtcacggtccagcgtccatccagcatgcgcctgaactcttcaccatgctgggtcaccaggtgcacctgggggtggagaatgagctgggaaaagagagctgaatctggggccaggggtagggaggcggtaaggtgacccgcaggacatggctgggtactgagccagggtggaaagacaggtgagcttagcgatggccacagcagctttggagttctggtggggactgggagatgcctgaagagctaagaccctgcttggtggtgggagagcggggtagggacagaccactcaccctgttgaccaatacaaccaccttggctccatccacagtctctaggtgccgcttggccacataagcagccgcccgggtcttcccggcacccgtgggcagccagatgatgatattcttgccctccagggcaggcatgatcacctcccattggtaggaccgaagctccattctgggaatggcaggggactcagacccaccgactcctccacccctcccaactcctggccagaccagtcagtacagagacctccctttgcccaggactccaccccacttgagggaggtggggcaggactccctcagaacccatcaggaccctgctctgcccaaaagggggaggcgggagtaacacaggctacacctgccccctgcccagcccaggactcacctgctctagtaggtaggtctgcccagggcagtcccacttaactcagcctggtgccactctgctcagctcagagacccaagatggaaactgaaactgagggaaggagccagctgagccgacttaggaatctcccatccccgccccaggaaaaagaaccaagagaaaagaaccgtttgtgctaacagtcatcgccaactgccgtgagtacaaactccggttaagtactgctgctgcgccagcgccctggcaggcatgatcacctcccattggtagggccacagctccattctgggaatggcaggggactcagacccactgggccctccactcatcccaactcctggccagagcagtcggtacagagacctccctttgcccaggactccaccccacttgagggaggtggggggggggacaccctcaaaactcatcagaagcctgctgtggccaaaaggtgggggtgggggggggtgggagtaacacaggctacacctgcgccttgcccagcctgggtctcgcctgcaccaccacgtaggcctgcccaaggcggccctgcttagctcagcctggtgccgctgtgctcagcgcagagagcagaaatcagaaatggaaactgaaact

SEQ ID NO: 1678 - DNA, 14934 bp, Homo sapiens
  source 1..14934: mol_type = genomic DNA
agcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaaggtaagggctgcaggcttccgggccgtgctaactccgggcgactcggggaacgggggtggggggatggtatcggggcccgcgcacgcctccctctggttcccgccggcgtgtcggcctcttcaccgcccggccttaagccggccttgtctctcggccctggctccgtggcaagggcgcgagagtgggagcccctcgcggtgacttggcatgatggggctcggccctctcacctccctggggtccgggtcgccgtcgaaagacatctgccgtgctgcccaccccgcggtggcgtgggacgtggcagtgtctgtgctgctgccagcccggacgccgccgttacagctccatgcgactaggggagcaagggtagtggaaacgggccgagaagaaaaggagcggagggaccccggagcagggatagagctccgagttgcaagaaagttctagaggccacaagcccgcggggacagtcgagtggtcgcttatggaactttccggccccctgcgtgagcgcttctgtgggatgtttaagctctgccatagccacgtggtgaaccggaagggaagccgacacgtgcagtagcctacagtcagttacccagccatgggacccatacatttggccttacacaccttgttttctcgcttacctacggatatacgttctaagaaatgggtcgttaggcgatttcatcattgtgtgaacatcagagggctcttacacaaacctaggtggcataggctactacacacctaggctgtatatggtgtagcgtatggctcctaggcttcaaacctggacagcatggtattgtgcggaatgctgtaggcagttgggacacagcgtcgagagtttgtgtacttaaacatgtctaagcagaaaaaggacagtaaaaatatagcacagggccgggcgcggtggctcaggcctgtgatcccagcccaggctggcggatcacctgcggtcaggagttcaagaccagcctggccaacatggtgaaaccccgtctctactaaaaatacaaaaaatttaggtgggcgtggtggtatacgcctgtaatcccagctactcgggaggctgaggcaggagaattgcttgaacctggagaaggaggttgcagtgagccgagtttctgccactgcactccagcctggggaaagagtgtgaccgtctcaaaaaaaaaaaattatatatatatataaatatgtgtgtgtatatatgtatattatatatgtatgtattatatgtatgtatattatatatatatagtacacaaggttataagtggtgcacccgtagaggagggcacttaccatgaatggagcttgctgagctggaagttgccctggttgagtcggtgactgaatgtgaaggcctcagacattacactactggagactttataatctgtacacctaggctacactaaatttataaaaatatatttttcttcagaataaatcaaccttagcttactgtaactttataaactttttacttcgactgttgtaataatacttagcttaaaacaaacacattatttagctgtacgtaaatattttctctgcttatctccttatttataagttttctattttaaaattttttaatttttttcttaaaaaatttttttttgttaactaagacacaaacacagcacacacagtagccttgacctacacagggtcaggatcatcaagacatcactaggagataggaatttttcagctctgttataatcttatgggggccaccatcacatacgcagtctgtacttgcaaaacattatgtggcatgtgactgtaattgtagacctaaaatccatttcctacctgccctaatttcggtctttattttaaacccttgtttcatttattcttggggaaaattcccaaatcctgtgtttgtttttttagtaattattttgccaaagaaacataagaagaaaaaggagcggaagtcattgccagaagaagatgtagccgtgagtagtaatgtgtttgacttcactttgactaaaaagaaagtttacttaaataacaaactaaaggaaagaagtgtttttaaaggtttccaaggaatgggccagcattggtagtcattgtgtagattcgaaaaagcactgaaatgacacagccccagacagtccaagtgtccttcaggcatagcttactaaatggtgctggccttaccaactgctgtctctgaatttgtcttccttatgccacccacagacccgccatccccctttctctttaaatgtttggacccatcttagtgacatttcacttcccctctgtactcctggttcatttcttctctctctttcccttggaggtcccagtgaaaaggcataggaagccttgttttctgtttaaaaggcatacatttccatggcagtaatggaattgttcaaaatcgggtgggaagtttaataggttatatttctgtcctgtcgaaggaaatacaacacgctgaagaatttcttatcaaacctgaatccaaagttgctaagttggacacgtctcagtggccccttttgctaaaggtatgtggttaaaatcgtgcatcagatgaatgcctgcttttacgttatttccaagtgttaaacaattgattgagaatgcttactgctggcatccttgactttgggaagtgcccactgatacagtttaaagcaggattccttaaggtatctgaaatgagaaccaagtttttaaaaaattggcagtgcactcaacactgttgtagaacacatgtccccacaatgttaaattgctgagtttgtcaacagttctcagtttttgtacttagtccatcttgcagacctatgccagtttgtgggccacatagtggtactgactctttttttacatgtgctcacgacatggtattttgttttgtgttgtgtcgttgctttgtagaattttgataagctgaatgtaaggacaacacactatacacctcttgcatgtggttcaaatcctctgaagagagagattggggactatatcaggtaagtgttgggaggaggcactgtgcaaacttactttcttttgaaaatgctttcacatcagctattcaggaaggcagtggcatgccagaatagctttgtcttgaatatataacctgtacccgcagtgaattatttttctttttaacttttcagatttgttgtttcactggagcattaagagtgggtgatacattaattttttttttttccattccaggacaggtttcattaatcttgacaagccctctaacccctcttcccatgaggtggtagcctggattcgacggatacttcgggtggagaagacagggcacagtggtacgctggatcccaaggtgactggttgtttaatcgtgtgcatagaacgagccactcgcttggtgaagtcacaacagagtgcaggtatgtgggagagggagggaaggactggctagagtgaaaagctttctgtatttcccttctatgttttgtctgctggaaactatttcttcattaagaaaaaaaaaaatcctaaagcaaggatattgttttggtttctgtgtacgttctgtcccctgccagatcttggtggtccgcgctttttggaattccacatactaagcatgtattcatcaagctgactggatccatttgtccgggttcagctctcagcttgtcactccaggcttctcactctgtgctaccgcttctgcctaaagtatccttcgttcatttttatctgagaaaagcctgcttatcttgcaaggctttttccacgcagcttctacactgagtactcccaactgtccctgttagtacattgaattcccagtgagaaagtgtcttcattctttcccacatcatcaccatgaaatctctcttaatgcaaattttatagaaacacaaggtcaaactgccgcttttcctgctgtgcaaaatgggagtgactgagcatataagaaatatggaaaacagaaaactcagtggccacacctgactactcttttgtcatttttcaggcaaagagtatgtggggattgtccggctgcacaatgctattgaaggggggacccagctttctagggtaagtctgcaattgtagggaggacaccctttgttgacttggatctctgagcccctaaacatctggagatgggttagctgtcctgactgactccttttgtccccttttcagtcggctgctgcagccagcctggaccagtgactgcacatgtacattctgatgaggtgtttgttttcatttgtgtttgttcttaggccctagaaactctgacaggtgccttattccagcgacccccacttattgctgcagtaaagaggcagctccgagtgaggaccatctacgagagcaaaatgattgaatacgatcctgaaagaagattaggtgagtcattaggcctgtgagtgggtatgaacacattcttcaggattctgttctcttattaaaagtagatgcccttgaagttgaagactttctaaaacctgccctacagctgggatattgtctgtgggcgatagtttttgttatcttttgttgaaaaagtgaacagtgcctagtaaagtgagatggcttttacaccttttatgatgactgcttctgctggagttgaaatgttttcattctgcatttgtgtagttcggtgctttgttcaaaggtaagtgttttcaccaaagtatgttttgcatgtgttttttatttgttgcaattttgactgcttagaagtttctgttgtcagaagtaaatttaagacaatgccaattttcctcccatccatgaaacataccatgctgaatatacctgcaacttaagtgttaaaaattctgctaatatcagaattacagatctttttttttttttttttttttttttgagacggagtctcgctctgtcgcccaggctggagtgcggtggcatgatctcggctcactgcaaactctgtctcccgggttcacaccattttcctgcctcagcctcccaagtagctgggactataggcgcccgccatcatgcccggctaattttttgtacatttagtagagacggggtttcaccatgttagccaggatggtcttgatctcctgacgtcgtgatccacccgcctctgcctcccaaagtgctggaattacaggcgtgagccaccgtgcctggccagaattacagatctttacagcaaatgcttatattttaagaagtgtgtctgtcacctctagtcttggtggctcagatgaaggataactgcatttctcaaccagtgatgtatttacagtaggtgctgcttttcttttgtgtgtgtgtatcttaggaatcttttgggtgagttgtgaggctggcacctacattcggacattatgtgtgcaccttggtttgttattgggagttggtggtcagatgcaggagcttcggagggttcgttctggagtcatgagtgaaaaggtatgtgttacggggctagaagttttagagctggttcttaccatctgccagcctttgatggcactccacttgcttcatgtcgtgggaaagatgctttccaaagtgttgagttcagtccagggcagcttccctgttctgttaattaaactttgggacattaaaatgggctaagggagatgattgggtagaaagtattattctattcatttgcctcccagcctacaaaaatgcctgcttggggtctaatacttcaacggttaaagatgcctggaagagggcgcggtggctcacgcctgtaatcccagcactttgggaggccgaggcgggtggatcatgaggtcaggagatcgagaccatcctggctaacaaggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccacctgggcgacagagcgagactccgtctcaaaaaaaaaaaaaaaaaaaaaaaaaagatgcctggaagagccaggactgaagaggctgaagacataatgagcttggactagtaaacaagtgacattcagttttaggaagtttggggtctgatgggctgagatacaaataaactgaattattttcatacatggctgcttttcaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaagttccgggttaggagtttatatttggaaagaacgtactccaaagatgaggcttgctctttttattgttttccttgggttttattttatttttttcaagtccaaaccaagtatattaatttaaagtaaaagtttaatggtaggcatacttaaaaataaggcacattaggccaggcacagtggctgatgcctataatcctagcactttggcaggctgaggcaagaggatcacttgagtccaggaaggagtttgagaccagcttgagcccaggagatcaaggctgtgagctgtgtttttatgatgatcagagagttggccttttataaattaaaacattgtctttttctctaacttgagggataaaaatttctggatatttaaaatgtttgtagttggtaattatttatattcaaatcttgtatagatgttcacattttttgtatgtgtataggctgtaataaatactgaaagatggcaccataatagttgaaaaaactcagtcacaaaacagtggacaacataaatgtgatgtcctctccttatcaaaccattggcttctgggtgaatgtaaagggaggggagaatgtgatcaaaagaggtctaggtgagtggagatggtatgaggcagatgggtgcattgggtaccattgaacctctggagaggtagccttaacttgtacccactgacctataaattctgcaccaagacttttgtgtgattggttcaacagggctcagtaatcttgttttcaagttctttaagagcctgttattgcctggatctccagtaaatctgttctttctcctcataaggaggagagaggagtaattaaggaatgccaaggctatttttatgtttcaaatgaaaatatggaccacgtgcggtggctcacacccataatcccagcactttgggaggccgggccaggcaaattgcttgagctcaggagtttgagaccagcctgggcaatatggtgaaaccctgtctctattaaaaatacaaaaattagctgggcgtggtggcacgtgcctgtaatcccagctccttgggaggctgagaatcacttgaacttgggagatggaggttgcagtgagccgagaatgtgccactgcactccaccctggacaacagagggaggttctgcctgaaaattaaaaaaaaaaaaaaaaaaaaaagaaaatacttgtgagtctctagaacctgaaaacctgaaagtcttctttactacttttgagtcgtgtgtaatgtgcggagagtggtacctatagcacagtgaggtggctcttctgagtaccactcatgccccttgcagctagtgggctataagtgtcatccctgtttcctggtgtcaggccccactcccttgttgtcctcctttactctggtgtgggagtggggtggagggcagcagctgggccccttacacttggtgccatctctgcaggtaaatgccatctgctatggggccaagattatgcttccaggtgttcttcgatatgaggacggcattgaggtcaatcaggagattgtggttatcaccaccaaaggagaagcaatctgcatgggtaagaggggatgtttattttttaaattctaaatgtttgtggttacatactaggtgtatatatttatggggttcatgagatgttttgatacaggcatgcaatacataataatcacatcatggagaatggggcatccatcttaagcatttatcctttgtgttacaaacaatcctattttactgttagttatttatcaccttagttattttaaaatatacacttaagttattattgattatagtcaccccgttgtgctattaaatagtctcactcttcttgttcattcttttggttttttggtggtggtgttttttttttttttttttttttgagacagtcttgctcttttcacccagactgcagtgcagagacgtgacctcggctcactgcaacttctgcttcccaggttcaagcgattctcgtgcctcagccttccgagtagctaggattacaggtgcacaccatgacacctggctaattttttgtatttttagtagagacagggttttgtcatgttggtcaggctggtctcgaacttctgacctcaggtgatctgccctcccaaagtgctgggattacaggtgtgagccaccatgccgggcctgattttttttttttttgtacccattaaccatccctacctccctgccagccccccactaccctcccagtctctggtaaccattcttttactcttctctgtccatgagttcaattgtttcgattcttagctcccacaaataagtgagaacatgcaatgtttgtctttctgtgactggccgattacacttaatataacgatcttcagttccatccatgttgttggaaatgacaggatctcattcttttttaaggctgaatagtaatccatcgtgtatatgtaccacattttctttatccatttatctgtcgatgggcacttcggttgcttccaaatcttggctactgtgatctctttgataacactgatttcctttatttggggtatatacccagcagtgggattgctggatcctatggtagctcaatttagtttttcgaggaacctccaaactgttcttcatagtggttatactaatttacattcccatcaacagtgtacaaaggttcccttttctccacatccttgccagcacttgtcattgcctgtcttttggatataaaccattttaactggagtgaaatgatatttcattgtagttttgatttgcatttctctcgtgatcagcattgagcactttttcatatgcctgtttgccatttatttgtcttcttttgagaagtgtctgttcaaatcttttgcctgttttttgatcagattattagattttttttcctatagtgctgagttccttatatattctggttattaatcccttgtcagatgggtagtttgcggatattttctcccattcttatgcatatggatatctagttttcccagcaccatttattgaagagactggtttttacccagtgtatgttcttggcacctttgtcaaaaatgagttaaatgtaggtgtgtgcatttgtttctgggttccttattctgttccattggtttatgtgcctgtttttatgccagtaccatactgttttggttactgtagctctatactataatttgaagtcaggtaatgtgattcctccaggtttgttctttttgcttaggatagctttggctattttgagtcttttgtggttccatgtaaagtaccagtgttttttaacttgtgaaagcttagctactgttggattgtctcttaagactttaaatgctctgcgcaccctcttagtgaatgaaccttagagctattcatttaatgggtctaatttgtaccagaagtaagcatgtcatcaggattccttagctctgtgagcaggcaaggcagccacggcttatggacagcagcagaaaaggaatccttaaaacttcaaaggttctgtggccccaaagggagtgtgcatgccgttcttatagacgtcttgagctgcaagcctgttatgtgtatcgttaggtgctttggttaggtgttttttaacttcagaagtttaacgtcatttcaaaggcctccttctcataatggagtatttcctccatatgcacatcctgagcaaaggtaaccccaattaaagtagtagctcagagttttaaaagttttaaagtggcatacaacagtagaattggggctcatcaattatcaattctttcacccttcaaataattcttttctttattcaatgcctgtagctattgcattaatgaccacagcggtcatctctacctgcgaccatggtatagtagccaagatcaagagagtgatcatggagagagacacttaccctcggaagtggggtttaggtccaaaggtaagtggtactgggttgcgtgccctgccaggttcttttttttttttttttttttttaaatttatttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtctgtgtccctgattacttgagattagggagtggtgatgactcttaaggagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagagtttttcttagtgcagaacaaaatgaaaagtctcccatgtctacttctctccacacagacacggcaaccatccgatttctcaatcttttccccacctttcccgcctttctattccacaaaaccgccattgccatcctggcccgttctcaatgagctgttgggcacacctcccagacggggtggcggccgggcagaggggctcctcacttcccagtaggggcggccgggcagaggcgcccctcacctcccggacggggcggctggccgggcgggggggctgacccccccccacctccctcccggatggggcggctcctgccaggttcttttgtttggcattgttgaatacttgggcagctcttggtgtgtttcaccaccacagccttgtattgtgctgggctctgggttgtcgatgagtggaaacaggccctgtcttgggccttagagatttcagtctaatgaggggaaacagttgggcattactcacgtaatcacacagtggaatggcgaatttcatgcacgttagtggctaccaaggagtgcagagaggtgtctgtcacctggagtgtccacagtggtcaaggagtctggtcaagggattgtctgttaagccacaccggtgtgaagagtgggttaggtgttggtgaagtgaagaggggaggggagagttcagggcattgggagcaagcagcatgtgcaaaggcaaaaaagtagagtggctgcggtggggacgttatgtctgcagaggctctcactaataagctttgtgatcttcaacaagtcctgtgtgtgttggagttagtgggcaaattctgaatgctctggagaggagtttgaggccctgctgagaatacaccagggaggaaccttgttctattctttgtagtcaccatgcccgcttccagcattgacaccattctaatgttgacaccttgatgttccaccaggcaagtcagaagaagctgatgatcaagcagggccttctggacaagcatgggaagcccacagacagcacacctgccacctggaagcaggagtatgttgactacaggtgagggcaggatgtttcagagccggggtgggtagagacggcacacttgctgccttgatgcaggagtatgtcaacaacaggtgaggatgggaaggtagagcccacttgccatctggacgcaggagtacatggacaacaggtgaggaacaggtgagcatggaggttgtagagcccaggggagggggagtcacttggtttggggcaaacttgctaaatgcaggaccacaggaaccagctcttcagctcccgtgagattttggctgcccaggccagttaggggtgtgggcctgcacggcagacagttatccctttctagtctggctcgtgggactctagagggagtcagtctgcaacagtaagtggtgagttcttctgtccagcgtcagtattttgatggtggctttagacttgccagataacactacataacatcagtactgccctggaaagccattcagtgaatttgacctattgctacctctttttcagtgagtctgccaaaaaagaggtggttgctgaagtggtaaaagccccgcaggtagttgccgaagcagcaaaaactgcgaaggtgagtggcatgctgtcctcagtttggaatgtgcttagggagataatcctaagaggcactggcattcgtcttactttgtgactgtccgcagtccagccatatacgctagcatcagaggtgcagcgcatacacaggtaatgctgcctcataccctggggtgcttgtttgggctctgcaggctcctctgatttgtattctctgtcctatctgctgggaggaggaatgtgggctcaggaatcagatgggcctcgactcctacctcagctatggcagcaacacagtgatggaatgggtggtggtgtgtgtgtcaattctggcccccgccctgggtcaaatggtaggacagatgtgttgaaatcagaggccatggctgttggacattcgaggccatacaaaattcagcagagagcagaattgcatcttaacctggcaccacccagtgttgaaagagtcagtcaagcatgggttggcaactccaccccatggagctgctggcattagagcacagaatgacaggtctgcactcagaaaccgggggcggtactgagtatcctgcacaggctgtgtgggaggagcttctgacttgtcagatgtgaattcctgctttgcctgctttctgtgagaggtccttgcagtcatgagagaaacagctcctccgggcctttccaccccaagccccgtgctgctgctgtgctccttctcttgtgcctgcctcaaggcttcttggatttgggggatgagactgtcttcaaatcctcagtaaactaaggccctgtccgggtttgtagtcagaaaacgtcctgttagattcagttgggatctttcttggtgccttgctaccttttgactcactgaacctttcttgtccattattgcccaagatctaacacttaaccaattgctttcatctcagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggtgtgtggaaacacgttcaggttccttgggctggcttagtccctgcgtggggaaagaattacccaggtggtaccagctttgttactcttcttggaggagctgtggcctgggggtgggatgccaccgagtgcctttagtgcttccccatgttcctggagtgcttttgccctccctgtggaatggacagatagaggcacccgacctctaccacttatacttagagctctattgatggtgggtggagaggatgtgtaggatggtgatctgaatgtttccacttccaaaagtagaccactagggtgtcactgaaaggtttacagaactttgtgtcacatgcagcatttaacccaaaatatccttacaggtcctgaaaaaggcttgcttgactgtggacctttaccagatttccttctgggagagtcatagctttgttagtggatggtatctgtgagctttcattctctttctttctaggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaatgtga

SEQ ID NO: 1679 - DNA, 14934 bp, Homo sapiens; identical to SEQ ID NO: 1678
  source 1..14934: mol_type = genomic DNA

SEQ ID NO: 1680 - DNA, 46972 bp, Homo sapiens
  source 1..46972: mol_type = genomic DNA
acccactcccgctgccccgtccggcccgcgccgcttcctcgcagcagctgctcccggctccgcggccgcagcccgcgtggacgctccgagcgccccccgacggacgggaccggctccctggcggtcgggcgagcgggcggcaacgctgcccggccggcagcgctggggttaagtggcccaagtaaacctagctcggcgatcggcgccggagattcgcgagcccagcgccctgcacggccgccagccggcctcccgccagccagccccgacccgcggctccgccgcccagccgcgccccagccagccctgcggcaggtgagcgccccggggccccggggaggctcggccgccagctgcttcgagggctgctaggggaggggacggcgggggctcccgaagctgccggggagagaccctctccagggacctcccgaggaggggctctcgccgggttggagacccggctgggtttgcggggtgaggaaacgtccacggaccctgcttggggtggaacggggacagcgggtgggacgcgggggacatacgtctgacggggaccggagatactagaggaagggacgcgtctgctgcctccaggagcccgaagaggagagaagcttgctcgcagggagggggacgcgctggcttcccggggtccagactcgaggaggaggaggtgcccgtcgagagcatgaacaggggctttgctcatgggcagggggtgtaattacctggcctctgccttgggaaaagttaaggggcagaggaggtgaggaggggtttctgccatgcaggtgggcgtccgccccttgcaactgggatgtggggtcttcaggcgaggcgctgtcccttcccccaatcccagctttaggaaagagctcgtgagtgtgggcttagactcgcgcgggctggggtgtgcgccgtggagggcgtgaggcagagggcgacctcccggggtgctcctgagctgagccatcaagcgcggggagcagcggggctgccctctgcctgtgcacacctggcccgggaggagccggccggaggggcggcgcctccctgtcccggccacgccgcctaccctggggtcttaccttccattcttagcctaactcccgtgtgcggctggccccacttcccagactcgcacactaaggcctcaaaacctctagcaccagctcctggaagataagcttcccggctcgtggttgcatggggagggtgtattgagctccactttatcggggagaaagtggaagcggagaaagacctaacaagttgtaagactgcgctgcccttgggcccaggcttcccgctggaggatctcacctgtggatggagttccgagcccaggtcttgcccgcgcctccagctttccctgctcccttttcctcccctggtctaggagagaggctcgctgggcctccgtgtttccaccctcccccgaagctgggaagtgtttgaattaaagggaattaagggcagagtatgaactttgagttgcctcctgagttctggatgcggtgggttgtggcagacgggtggcagtttttgggaaacagctgttatctcctctaccaggcctgctggggcttcttgttcacccaccttggaaacgccaggtgcggacttgatttttccagagttgagatgatggtacttagtttatagggttggtatacagtaagcactcaatacatgtttgccattgttggaatcactagctagcacacgggctaagcaagcttccttccttaaggaagcatagttcttagttcatcatgtgtttaaaccctgtctcgccaagttcattgctctccgtgccttaattattacatctgtgaattagcaatagtcctactaatagggttgtgtaaggatgaaaccagtcttatgcgtgaattaacctcttcagcccttgatcttcctcagatgtttaggcataatagcctctaccacattgggcctgggtaaagaggcagtgggatagtgcctgtgtagggtcagcacatggtgagtgttgatgtctgtacttaataacgaatagcccctcattttagggtggccattcctgagatttggggatggagggaggcacccctgccagcctctccttttcctgccttcatgaaggcagctctgaaagcttttctcaatcattgtccacgattagggagttggcaggaagaaccgcctttgttccctttcgaacggagtcttggttttgttttataagggttggggccgtttttaaagccctcccggccacgcatgggggcctactgcaaaggtgtaattgcagaactaagtgagatcctttaccttttcccattggggtggagagtgctgagacaaagggacaaggactggggccagtggcatcctgctcttaaagtcatagacataacccccaccccttgcaaaggatggggggaggggaagacggtagctgggagctgcaggggtctaagggaggagcaagggaggtggggttgagaggctgcttccttcccttcctccagccacgtggggcctgtgatccagaggcgcctgtcgcccctcattattgcagccccatggacctgctgccagtgggggcttgggcaagttcttcaaggaaaacttaccttgggattccttttcctagaccagctcttatgccggctgcctcacctccaggctcagacgccttttccagtttcagctaaatgtgaaacttttcagaggtatgaggttgtgtgctcttcctcacacaccagtccttagcccaggcacatactactaattgagtggagttttttcttttaaatcatgaattttcaggatgatttccagtttcacggaggaccagggctggtgaagtatggaattcatttcatgtgcaggccactcttgtaaaaagagactgagcagatatgtctcccctttgttggggggctcatgttctcactgggacccttttacaggtgatagaactgaggctctggaagatacaggtactattacgtcttggtggtgagcattttctttctctttttttctttcttttttttttttttgagacagttttgctttgtcacccaggctggagtgcagtggtgtgatctcagctcactgcaacctctgcctcccgggttcaagcaattctcctgcctcaaccttccgagtagctgggattacatgcgcacaccaccacgcctggctaatttttgtatttttaattgagacggggtttcatcatgttggcaaggccggtctcaaactcctgacctcaagtgattcacccgcctcggcttcccaaagtgttgggattgtaggcgtggctgttacacccggctgctttttatttatttatttatttattttttctttttttctttttttttttttttgagacggagtctggctctgtctcccaggctggagtgcagtggcgcgatctccgctcactgcaagctccgcccctcgggttcatgccattctcctgcctcagcctcccaagtagctgggactacaggcgccggccaccatgcctggctaattttttttgtatttttagtagagacggggtttcaccgtgttcgccaggatggtctcaatctcctgacctcctgatccacccgccttggcctcccaaagtgctgagattacaggcgtgagccactgtgcctggctatgcttttatatgggtgctgcctcacacccataatcccagcacatgggagactgaggctggaggatcacttaaggccaggagttcaagaccagcctggccaacgtgataaaaccgtgactctacaaaaaatacaaaaagtagccaggcgtgtttgtgcatgcctgtaatccgtgctactgggaggctgaggcacgagaattgcttgaacctaggaggtggaggttgcagtgagctgagatcctgccactgttctccagcctgggcgacagaccgagaccctgtctctatgtgtatatatctacgtagatatagatagcttaagtttttttttttataaggacaaggtcttgctgtgttgccaaggctaaccttgaaagcctgggtccaacgatccttctgcctcagccttccaaaggcttgggattacaggtgtgagctaccacacatggcctctaggtcacttttcactcagattttttcattcattcaaacaaaatagcataggtatgacctctgctctagtttattttttatttacttatttatttatattttgagacagtctcgctctgttgcccaggttggagcgcagtggcggttgctcactgcaacctctgcctcccaggttcaagcaattctcatgcctcaacttcccgagtagctgagactacaggcatgcaccaccatgcctggccaatttttgttttgtaaagatggggtttcacctcattgcccaagctagtctcctgggctcaagcaatctatcctcctcatcctctcaaagtgctgggattatagacatgagccaacacacccaaattcaatttttttttaattatttttattttttgagatggagtttcgctcttgtcgcccaggttggagtgcaatggcgtggtctcggctcactgcaacctttgcttcccgagttcaagtgattctcctgcgtcagcctcctgagtacctgggactacgggcgtggtggtgcatgcccggctaattctgtatttttttagtagagatggggtttctccatgttggtcaggctggtctcgaactcccaacctcaggtgatctgcccacctcagcctccctcccaaagtgctgggattataggcgtgagccaccgtgcctggcccaaattcaatttttaatggggtccttgtcttgttttatgggtacaacatcatttatctgcctgagaatattgtagggtttagtgttccctcgtgttcccgccaatattaagggatactcaattttccagtaccttgccctgtaggtctggctacagggccaggagactggtgaggtctcagtctggtatctgttcctccacttgtcccagtctgtaagctcttgtgtgtgttttttttttaattatttcttttgagacaagtctcgcattgtcacccaggctggagtgcagtggtgcgatcatagctcactgcagccttgaactcctgggctcattccagtatcctcccacttcagtctccaaagtagctgggaccttagtcacgtgccaccacgcccatctaatttttaaaattgtttgtagaaacattaaagtctcactatgttgccccagctggtctcaaactcctcggctcaagcaatcctgcctcagtctccgaaagtgctgggactacaggtgtgagcctgtgcgcccagctgtctcatgttcttgtccagagcctcagcctgcatgtctgaagaagagtggttgtctccagagcagcaggctgagggaggggacttgggagtcaagggtctaactcttcctttggaagaaggcctctctcttagtaggcttttctggattccagcagcatttatgtcctgttgtatgtgtgtgttctggggccagagctggggctggaacccaggctgccactgggccccagctcctgcagaagtgctgatgcctttgtagggcgtttgctgcagccagaacagtgatgggccctggcagcatggcaacatggctcactctgttgcttaggctggagtgcagtggtgcgatcacagcttactgcagccttgaactcctgggtcaagtgatcctctcacctcagtcacctcctgagtagctaggactacaggtgagagccaccaggcttggctaattttaatttttttttttttttttttggagatggagtttcactcttgtcgcccaggctggagtgcaatggcgggatctcggctcaccacaacccccgcttcccgggttcaagcaattctgactcagcctcccgagtagctgggattacaggcatgcaccaccattcccgactaattttgtatttttagtagagatggtgtttctccatgttggtcaggctggtctcgaattccccacctcaggtgatccacccgcctcggcctaccaaagtgctaggattacaggcatgagcctctgtgcctggctaattttaaaattttttatagagataggctctcggtatgttgcccaggctggtctcaaattcctaggctcaagtgtaatcccaaagtgctgggattacaggtgtgagccaccatgcctggtcccttgcctgcctttgattcctaattactatcatggttcctgaagcctagtagaactcatctgaatggatacaggaggctctggagatgggaatggggaggcactaactagggtcccactgagccagctacaggcccccgctcttttgtgaaaagatggttgtgatgaagacttaagtgttcattatattccaggcaagccattttctctgactctgggagttgtttggcaccatgggtaaggaagccctaccccgacaatggcactggaggaagagcctcaagcttaggcactggctttcccaagtccttgggtgaatttgcaaacctcacctgtgtcctcatgttgccctaggatgttacatgctgagctgtaagcaggatgctgaattaggggaattgctcagtactaaatatgattgttactacaaccacaaaactagcaaggagtagaactgcattaaaacactgttgcaaatttttttattttttgagacggagtcttgctctgtcgcccaggctggagtgcagtggcgagatctcggctcactgcaagctctgccttccgggttcacgccattctcctgcctcagcctccctagtagtagctgggactacaggcgcccgccaccttgcccggctaattttttgtatttttagtagagacggggtttcaccatgttcgccaggatggtcttgatctcctgacctcgtgatctgcccgcctcggcctcccaaagtactgggattacaggcgtgagccaccatgccgggcccactgttgcaaatttctttccaaaacctctgccagcacatggctgaacccacagaactggcaggacacacaagatgcgctgggttaagatgctttggtgctctctgtgggttcagctgactgttttacaggcctgcttcttgaccgttggggtgggcagatctgagcccccactaggtaattgtggacagtttttgaaaagtggtttttatgtgagatcatgggcttcttttaaagccatttgtatatatgcagttcccttatctgcaggccttaattttgacatttctgttttccttctcgagatttgttttctgtccctgcagtactgctttttccagaatgtcatataaatggaatcatacattattattatttttgagacagcatctcactctgttgcccaggctggagtgcagtggcacgatttggcacattgcaacttccgcctcctgaattcaagcaggaaccatacattatatagcccttcgagtctgggttcttttacttattgtgagatatttgagatttatttgtgttatgacacgtactagcagttatttcttactttttaaaaaattttttaagacaggtctctggagttcagtactacaatcacagctcactgtagcctcaactccaatgctccagcagtcctcccactgcagcccccactgcccagtagcttcgactacaggcacttgtgcaccactatgctcagttaatttaaaaaaaaattatttttgagacagggtcttgctctgtcactcaggctagagtgcaatggcatgatctcagctcactgcaacctccacctcctgggttcaaacgattcttctgcatcagcctcctgagtagctggaattacaggtgcccgccacctcatcaggctagtttttgtaatttttttttttttctgaggcagagtttttcactcttgttgcctaggctggaatgcaatggtgtgatctcagctcaccgcaacctctgcctcccaggttcaagcgattctcctgcctcagcctcccaagtagctgggattacaggcatgtgccaccaccaccagctaatttttgttggtttgtttgttgttgttgttttagtagagatggggtttctccatgttgatcaggctggtctcgaactcccgacctcaggtgagccgcccaccttggcctcccaaagtgctggaattataggcttgagccaccatgctccgccttactttttttttttttttccttttgagacagagtttcgctctttgcccaggctggagtgcaatggcatgatcttggttcaccacaacctccgcctcccgggttcaagtgattctcttgcctcagcctcctgagtagctgggattacaggcatgtgccaccatgcccggctaattttgtatttttagtggaaacggggtttctccgtgttggtcaggctggtcttgaacccctgacctcgggtgatctgcctgcctcagcctcccaaagtgctgggattacaggcatgagccaccatgcccggcctaaattttttttttgtaatgttggggtctcactttgttgcccaggctgatcttgaactcctgggctcaagcaatcctcctgcctaggcctcccacattgctggggttacaggcatgagccactgtccctggcatctttttttttgctgtgaatataacatttctagcttttctttgtgttgtgatttttaccttttcaatacatagtgtgcaaggacatattttctggttacgatagaaataatttatttgaaagtctatccatgttgaaacaactaaaaatgctgtgcctttatctgttggtagaagaactaagctcccttaaagaaatctagagagcagaagagaacaggaaatgagagaccacaaactaaagggagaaaatgaacttttcaataaggcttgcaggcttgctctagcagttgtagtgattaaaagtagtggcaatggctgggtgcagtggctcacacctgtaatcccagcactttgggaggctgaggtgggcggatcgcctgaggtcaggagttcgagaccagcctggccagcatactgaaaccctatctctactaaaaatacaaaaattagccgggcgtggtggcatgtgcctgtaatcccaaggaagctgaggcaggagaatcacttgaacccaggaggtggaggggttacagtgacccgagatcatgccattgcactccagcctgggcaacagagcaagaccgcatctcaaaaaaaaaaaaaaaaaaggagtggtaaaggataaataccaaacaaaagtgagcctcaaaacatattacatatatatgggaagttcaaataagagatagagttgggatgtattcataggtgtctggctttacttacggggaaaaatattaggtccctatctcataccatatacaaataatcaaataattatgttgattaaacctgagtggcctaattcaaataaatgtttctcagacaggcgagttatgttttccgattgtaaaagttacatgggcttaaggtagttaccccccaaaccttccttctgagtatgaatttttatagttagagaagaaatgctgcagagaaatggcttaaacatcaataattgatgttgcattatgcaggtttcttgttttcactttacataactttgtctaacaataagtactgcactctttgccccctattgtggaagcaggtaatttagtcaaccagtcctcttgaccgtgatttgattgcagtgtttgctatgacaaatgggactgcagcaacccccttgcacagaggccttggcgagagctttgaactgggtggtttctgagcagtagaatcctgtgtaacaggatatagacattaggcattttagatgacacagtgaagattactatcccaaagactgaaccagtatccctgctgtgtaggtatttaggcttaagatgactaaatactgtgtagataggtagacttgagatttaaggcgttcttagttgaagccacaggtgcagcctgctgtgagggaggggccaaggttgagggggtctctttccagaatattgacctcctttgcccccttgggaggggacagggctgttggctctgattttgccaaggggtaggtggccacaggaattgggcatagcagtgcctaggattctgctccaatgctgcccctcattctctgagttaccattgaccactccttggggctgccacacccttcaaggggttctcaaagtggatataggggaaggggctgggtgtttgtgatttctgtataaagggcaaaaagtttagactctaaagttactgtcatatcttttcagatctttatggtcctagttttttttttcctgttacttatctaaaaggtaatgacattattttattccagtgcgttgacaaacatctgagtatattttggtgtcatgcacagtctgcagatagccacttgtctggtttttccctgtttggacacattttttttttttttttttgagatggagtttcgctcttgttgcccaggctagagtgcaatggcacgatcccgagtagctgggattacaggcatgtgccaccaccccggctaattttgtatttttagtagagagcggggtttctccatgttggtcaggctggtcttgaactcccgacctcatgtaatccgccctcctcggcctcccaaagtgctgggatcacagacgtgagccactgtgcctggctttttttttttttgagagggagcctgagcctgtactgttgcccaggctggagtgcagtggctcactgcgacgtccacctcccgggttcaagcgattctcctgcctcagcctcctgagtagctgggactataggtgtgtgccaccacgcctagtttattttttgtatggacacactcttctgataattctgcttactatgccaagggcccagcttctactgtaggatgacagtggtacatgtactcatgacctagaggcactgagcaattccccaaacgcattctgaattgtggagggtgatggggtggatacttcttgattggccctgtggtgtggtgctgtggtgggtagccagatggcacatgagaataagtgacttcaggtatcatgactgtgtcatctatgtaggggtccttggtaccaacttcccagtgaattgggtgggttactttatttcacagattataaaactggggtttgagagaaatattgggctttttttttttttttttataacagggtcttgtgctgtcactgggcctagagtgcagtggcatgacgatagctttactgcagcctcaacttccgaggcttaggtgatcattccccatcagcctccgaggaggtgggactacaggcgagtagctaggactacaggggcaggccgacacattcagctaattttaagaaatattttaatagagaagaggttttgctgtgttgcccaggctggcgttgaactcctgagcccaagctcaagccttggcctcctaaagtggtggtattaacaggcatgagccactgcgcccggcagtggttttttttttttttttttttttttttacgctttcctgtaaatctgatgttttctggaatttagggtaagttccttatcagacagagcaaaagcacagtactgggaccttgtgttctgtcatgtgttctgctgccgccgccagtgtggacagcctgagtctggccccctttcctttggatgtgctgtccctgctgcctggatccttcccgctctctacttcacctaggtgtggtgtccctccctgggcttacttactgcattgttttatggtgtcttttttttcttttttttttgagacggagtctcgctctgtcacctaggctggagtgcagtggtgctatctccgctcactgcaagctctgcctcccaggttcacaccattctcctgcctcagcctccggagtagctgggactacaggtgctcaccaccatgcccggctaattttttgtgtttttagtagagacggggtttcatcatgttagccaggatggtctcgagctcctgacctcgtgatctgcccacgtcggcctcccaaagtgctgggattacagacctgagccaccgcgcctggccttttttttttttttttttttttagattcaagaagtacatgtgcttgtttgttgcatgggtttattacttactggtggggattgggcttctggtgtatccattaccgaaagagtgaacgttgtacctgataggtgatttttcaacccttgctccttcccatcctcccgtctttttggggtctcccatgtcttgtcttgtcttgtcttgtcttttttcttttctattttgagatggagtctcccccttgtcgcccaggctggagtacagtggcacgatctcaacctcactgcaacccccgcctcccgggttcaagtgattatcctgcccagcctcctgagtagctgggattacatgcgcccaccaccacgaccggctaatttttttttgtatttttagtagagactggttacaccatgttggtcaggctggtctcgaactcctggcctcaagtgatcaacccgcttcagcctcccaaagtgctgggattacaagcgtgagccaccgcgcctggcctaatttttttatttttagtagagatggggtttcaccatgttggccaggctggtcttgaactcctgacctcgggtggtccacctgcctcagcctcccgaagtgctgggattacaggcttgagccactgcacctggccctagatttctctaacataggctgtggaggtggaatttttatttattttttctttaaatcaatactctccactgaatgtaggattttagtttttaattttttactgcaccccaggggttggggcagataccaaagtgaccccccttcctgcattgtgaggtttaattaatgcaattaacatttacgaagtgctctgaaacagctctgctgctggtatcagcctggaggaagtgagtgacatcagttctcagcattactgctgggttggggcgagtccctgagcctcctctgagtctaattgggggttgccacctacccctctgtctgccacattgcatttgagtacatctgacctggttcagtcggggcacaggcaccctgctgcactaatgaggaaggcccctcggggagaagcttgtgggtgggcccacccagcactgctgcccactctgaatcacacgctggaccccagcctctgggaaagggtcagagttcacctctcatcacaaggttaggcagccacctcctgtgaagggaaacgctcagctggtatatcatgtcccagccacgaagctcccttcatccctgggatgggtgatgcattcattgttcataacttctgtaattcttgtctgtcttgtctcagttacggcaattccaggcacgtgccctggattgcctgggcatgagatttggcactgccacttctctgggtgacttaactcatctgagtctgttgaaggcagggggataataagacctgccccaggatggggtgggggttaaaggaggtggcagacaggctgggtgcagtggctcacgcctgtaatcccaggccaaggcgagtagatcacctgaggtcaggagtttgagaccagcctggccaacatggtgaaaccacgtctcttctaaaaatacaaaaattagccaggcatggtggtgcaagtctgtaatcccagctactcgggaggctgaggcaggagaatcgcttgaacccgggaggtggaggttgcagtgagccgagatcgcgccactgcactccagcccaggtgacagagacttgatcttaaaaaaagaaaaaaaaaaaaaaatccatggtggtagacagtgttcagcctacagtaagtagggccctgggaactgttagctacttaatgttacagtggcagtgtgggatgatgcagttctaaatccagcatgtctgccactctggataggtcatattagataaagcagttggcttgtgatgggggccatgttatctggaaatgccagccttgaatcatgaagtcagtgagatacatagaaaagaggtgggggagatttgtatccactggtacacacctgatgctaatttaatttctcttgtcctgattctaagaacatgtagttaaatttgtatgttatttactttccctatatattgatcaaggaggtagtatgtcagtctctgtcttggtttctccatctgcaaaacaggaataacagtacttaccacatttaaaggttaaatgagttaagataagtaaagccaaaacagtgcctgacacatagtaacactgaaaaaaagatgaccttattggggggatttttatatatttatatatgtgggaagaaaggcctaggagagaagcttttattcctggattttgagctgtgggttttgaggtctgagaaaggaagcaggaggtgtagggagttggggagggcttccaggctgagagaacacagcagcacatgcctcgaggctagattgtcttggcctgcgtgtagactgaagcggggtgggggaggaactgagctgggcatctttagtcatgggtgcaggttctgaagttggtgtgcgctgtctacacagctgtggctataaggcaatgagggtagttaatttcactacaaacgtagggtcgtgataaaaacagaaggaattttaaatgaaatcacattgaattatgcaacgagaagaaagcatatataagtgctcagcttgctcctgggggacacccaggtagctagtgccatttattgtgggttttcttcctggactgtctctccagtacccacaggtcttgttctaggggcttgaggcttttcctgaatgttgagatatgggttttggaaggtgtgctgcccacacgttgggtaggctggtggccagttggcactgctgaggccctgggggaaggcccagggtggttaatcattgtcagcctgggtctgtctaggaggtgagactcctgtctggcttcttgttgacccagttagggcctgtctgaggaatggggttcaatgttgcctgcgaaacccagcacacattagaaccccaggccctggatgaaggcgaaggaggtcacatccttcactccaggcctctggtctgctaccagctcctggccacaaacaaaccctgtgtgtcctccccccagagcactttggggaggtggaccctcctggagacaccaggtacaccaggtagccccacctcccactctatgccaggcccactaggttacttagttcactgatttggcctgaggtgaaacgcttgaaattaatgattattctgaaccgacaccgcagcagctttcctgggattctgactgctttgtctcataggaactggccataggtcagccagcctgttcttccgggtcagggcttgggagaaaaagggctgagaagcagctgattggtctgattcaggcacgtcccttgtccttggtaggggaaattccttaacaggtgctgatacacactctggatcatgtgaagcacagaaagcctatgtgttatgtatcagcgcacatgtttataatctgaacaatgctgctttaacatgcatattaatcacctaggcatgacttgtgtgtgttaaaatgtcttgtgaaaatcccgcttcaggccgggtgtggtggctcacgcctgtaatcccagcactttggtaggctgaggtgggcagatcacgaggacaagacatcgagaccatcctggccaacatggtgaaacctgtctctactaaaaatacaaaaatcagctgggcgtggtggcgcatgcctgtaatcccagctactcaggaggctgaggcaggagaatcgcttgaacctgggaggcagaggttgcggtgagctgagatcgtgccattgcattccagcctggcggaggtcgcaccactgcactgcagcctggcgacagagggagactctgtctcaaaaaaaaaaaaaatgaaaaccctgcttcaggacatctagcttagtggtggagatttctccagccagctcccacttccaacagttcttccaagcagctctcagttcatggtactgtagcctgcgtggctcctgggccacacagggagtagcagcagaggtccagttgccccatgccatgggcaggtgcagggtctggaattgggagctctcaccacagattgcacctctgcctgggggcgccactgggctcatcagactgagctcacggtgccccctggtgggcgatgccagtggcgccagtgcagcttggagcccgcaatacaaggtgtggcttctagaaggtaccctggtttgagatgctgaggtgggaggatcccttgaggccaggagtttgaggccagcctgggcaacatagccagactctgtttctacaaaaaattagccacacctggtggcacacacctgtgggcccagctggaggatcactgaagccctgggagttgaagcctacagggagccgtgatcacgccactgcactccagcctgggtgaccaagtgagaccctgtctctaagatagatggatggatggatggatggatggatggatggatggacagatagaagataaactgcgaggctagcacgggttgtctggcaggggctggtatgtctccacgatggagcccgaggcagggaggcccggtgcatatggcagcagcttattggggaagcttttcccaggcacggttccaggacacaagggtgtggtgtgagtgacctggagctgtttgtggttcagggatgggggcctggaggtctcattatgcctaggcttttataatatttttgccaaccaaaggtggaacaaaaagcaaaggcaagtgacttggaaaactcggtttcagcggggatttatgccctgaagttttttactcgttctctatctaatcctggccctacctcttagatgggctatatgaccttggagaataacctagtctggatgtcagttttctttttctagaaggtgagctccccagtctccctagggggagatacaggttgttgcatccaacaaaatctgtgtgcccataatgttgcaggcaatgggccagcccagaggttatagcctgccaacccatccgtatggccctggccctgtgtgttagctgatttacctgaccaggaggggcagcagtggggaggccaagtcccagaggtgagggtgaggctacaatggatctggggagtccccctcctggtaactgcccccaggctttctgcctgtgcctccatccttccctccttgggaacttgggactctgagccccagctggtgagggaggaggggagtgagcgacaggccagcagaccaatgggccctggaggatggggtgaggcggggcttgtgctgccatggagaggagagaagcggttctgtgggggaggagggggtgggtgggaagaggacctggagattgaggggaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggtgagggggaggctatggggggcagcctgggtggggtacttgggcaagagcatcaccctaagaatgcatcctggggccttggcctgagaacacagagcccatggcgggggaacactgtccctctcatgtccctgcttccctttcaccccacccattctggcttctcccacaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggtggctgggcagtggggactggggtggtgtcaggcgctgacatagtgagcggtcactgcagacaactggaggctttggggagagtctctgacaacctccaccacaattccccgggagggaagagagctctagcaaggagggatgcagggtcgagcccttcacacctgcccgcagcccttggcctcccctttgggactctcatctcagctgggactctgagcgtgacacaagggtgatggttccctgtcctctgccagtcatgacaggggtggtctcagcatgggcccttggagagcccttctgcagtgggaccctctccccactcagagctgggctggggttgggagggggaggtctggagtgtgcttcctttccaccctgccctgagcagctccagccagctcacttgggatcccgccccagctgggttggaaagccctgcattgtcctctcagctgtgccatcccatggaacttcctgcgagcgtgaaagggttctatttctgcattgttccccacaatagccacactctacatgggagcacttgagaagcggctgacacagcaggcagtgaattgttcctggaaatgtagttagtggtccctggatgggcagcaccctgctggaaggaatcggagggctccccttggtaacttcagtgttggtttgggtcctgtcacgtgcctggcccagggctctgttgtcttaggaataaaatcagtggagaagatgaacgatactgacggactgagagcaaatccctgtggctgacaatagtgtaggggagatcccaggccacgccacggagaaaagcccctattagcaaggccgttccccagactggtgcctgcccccacaaaacagactcctggctgtttcctctacaggccgaagatcaagctcgcgactctccaagagggaggtgtccagtctgctaagctacacacaggtatggtctctgctctccctttttcagggctcagggactttgtctttggctttcatcacgtgggctgcctgaggcccataaaaactggcatctgcaaatgtatggagggttgccgagctagatgctttctgcatatatttggcattattttttcaatctggacgatcagttacattgctaaatctctaatatggtagtcccctcttatctgtcattttgctttccacgatttcagttgcttgcagtcaactgccgtctgaaagtattaaatggaaaatattaaatggtaaatcccagaaataaacaatttatacattttaaattgagtgccattctggtagcatgatggaatcttgcactgtcctgctccgtcctgcccaggatcagtcctgtctttgtccaacatctctatgcttaggtgctacctgcctgttagtcacttgtagccgtctccgtgatcagatcagttgcagtatcacagtggttgtgttcaagtagtgcttgttttacttaataacggctccaaagtgcaggagtgatgacgctggcaattcagttatgccaaagagaagccatgaagtgtttcctttaagtgaaaaagtgaaagttctcaaaaaggaaagaagaaatcatatgctgaagttgttagatctgtggtaagaacaaatcttccagccgtgaaatcatgaagaaggaaaaataaatgcatgctagttttactgttgcacctcaaactgcaaaagttatggccatgttgtgtgataagtgtgtagttaagatgggaaaggcattaaatttgtaggtggaagacatgaacagaaatatgttctgattgacagcagtgctttgtgccagggagcattgagcctatagcaagggatcccctgacaccaaaccatttacttcaagtaagggatggttacatagattcaagaataggtttctactgaaaactataaaaatgactggagaggctgcatttgccaatgaaaaacctgctgctacattttcagaagagttgaagttgattgagaaaggaaacaatccaaaactaagactgcagtgaaaccagactcctccagaagatgatgtctaatagaacctaccttcataaaagtgcaaaggaggaagacactaggtcataaaccatggaaggacagattaaccctgaatagagtacaagaagatattttgagagagaaaccacattcatatggcttttattaacagtatattgtaattgctctattttattattagttgttaatctgtgcctaatttataaattaaactttatcataggtatgtagatatagacaaaaacagagcacatatagggttccatcttccaaggtgtcaggcagccatggggggtcttgcatgtatcccccctggataaggggagactactgtatagcaaactgtctttttattcctggaatgagtccaacttggttatggtgcattttgaagttgattttattcatgtattcatgaatgaaatgggtatttttttttattcatttatttttgagatgaagtctgttgcccaggctggagtgcaatggcatgatctctgctcactgcaacttactgcctcccaggcccaagcgattcccctgcctcaggctcccgagtagctgggactacaggcaatggaccaccatacccagccaatttttttgtatttttagtagagatggggtttcaccatgttggccaggctggtctcgaactcctggcctcaagtgagccacctgtcccggcctcccaaagtgctgggattacaagtgtgagccaccatacctggcccattttatttctttaaatatatctatggttttgatgttaggattaggtgggctcaaggaattttttttacaagctggaagaaacttgtctaagcttattttaatgaatttcaaacaattatatcttctaagacttgctacattatcaagctttctacttcatttacttttccaaggttggatctttcccatcttgttttgtgttccttcctttactgacaccgtctgtttcctaattattcttagtagagtttgtcaattgggttggttttgctcagagccagtatcagtcataaaagtcctgggcaatgaaaactcaccctcagcttccattctcttggtggtggccaacctacttaggggactcagaaggtggggaacctaagccctgggaggaattagggcagctgcaggatcagaggctcagcactgctgttttgtttctggtagctagttaccagaaacagtaatgaaatctcttgcccacacgtttctttttgtttgtttgttttgttttgagacagagtctccagtctgtcgcccaggctggagtgcaatggcacgatctcggctcactgcaacctccgcctcccaggttcaagtaattttcctgcctcagcctcccaagtagctgggcttacaggcgtgcaccaccatgcccagctaacttttgtatttgtatttgtatttttttttttttttgagatggagtcttactcttgttccccaagctagagtgcggtggcgcgatctcggctcgctgtaacctccacctcccaggtttaagcggtactcctgcctcagcctcctgagtatgagtagctggaattacaggcacatgccaccatgccctgctaatttttgtatttttagtagagacagggtttcgccatattggccaggctggtcttgaactcctgacctcaggtgatccacccgcgtcggcctcccaaagtgttgggattacacgcctggcctaatttttgtattcttagtagagatggggtttcaccatcttggccaggctggtctggtgacctcaggtgacctcagtctgccccagactcccaaagtgttgggattacaggtatgagccaccacaccctgcatattatttgattcttgatgtaaccctgttgtgctatgagggaagtactgttattccaattttaaaatgagggaaatggactcaaagccacacagttggtgagtgaaggcaagtgcttaacactccagccagacctagctgctcgctgcttcagcttttgtgtttggcttatgctgggttttggtgtgaggtgtgaggcctgcacgaggaagccctgatgacatggtgcaggtttcatgccattgcttccggggcatctgtcgtggttggtctgtgtctgcacccatatgcagtgtgttgtgatgagtgacccggtctccctgccaggcacaggcgatcagtctttcatattgcaggtgccttgtttctttgacttgctgataccctggggtcttcatcatgttcatcatgtttccttataaaggacttgacaggcgatggcgacggggaagatggggatggctctgacaccccagtcatgccaaagctcttccgggaaaccaggactcgttcagaaagcccagctgtaagtagccacacctcgagccaaagcacttgtggccaacactctacatagcatacatagcatgctacatacatagcatagctccttaggggagcttttaagagaaagtgatgaaaaaatgttttgaaactagaaaatataagcaaggctcttggactattgttggagggttttcttttttctttttttttttctgagacggagtctcactgtgttgcccaggctggcgtgcaatggcgtgatcttagctcactgcaacaacctctgcctccttggtccaagtgattctcctgccacagcctcccaagtagctgggactacacgcacctaccaccacacccggccagtttttgtattttcagtagagatgaagttttaccatgttggccaggctggtctcgaactcttgacctcaggtgatccacccaccttggcctcctaaagtgctgggatttcaggtgtgagccactgcgcccggctggaaggttttctctatgtgccatttctttcaggtggtttttaagttctttcttgtaacactcttggaggtgcctaggggtgatagagtttgcagggtggatggctcagctgctaatgacctagggagtccaccatttctgtgggtggattttgtgcctcagagttttgaggtatggcaatgggaaggcagttattgcttatggtcacccagccctttagagaccagactgacagttactatcccaggtgtgggttacagtcttcccttcccaggatatggtctgtatcatcccctttgtggagatgagagaagattccagcaacttaactgaggttaaacatcaactcttctatgcataatttggacacaggttctgcaacaaccaaattcatgccatttttgacaatgaacatggagcctaaggaattctattccatcttgatgatctggtgccttcctgaacccagtaattggccttatgcttctttgacataaaagtttattttagagtgaacacgaatttttctttctttctttctttctttttttttctttttttttgagatgcagtctcactgtgttgcccaggctggagtgcagtgacgtgatctcagcacactgcaacctctgcctccctggtccaagtgattctcctgcctcagcctcctgagtagctgtgactacaggcacccaccaccatgcctggctaatttttgcatttttagtagagatggggtttcaccattttatccaggatgatcctgaatttctgattgcaagtgatctgcccgccttggcctcccaaagtgctgggatcacaggcatgagcgagccactgcgcttggccagatttttatttttcaatcccaattggcaggtgccatttcagctggccatgtctgtctgctgtgacaggcagagcaggacctgctgggaattgtcgggcatcctagctggccaccctaccacctctattccaagaactggggaattctggctggactcagtccagagtcccacctcatcacctgttcacttccagttgtcctgaagctggctaccaggtctccttggccacctgaaggcctaatccttctggccccgccagaccccaggcctccagtcacctaaggcccagtgagtgtcctctcttgcttctaggtccgaactcgaaataacaacagtgtctccagccgggagaggcacaggccttccccacgttccacccgaggccggcagggccgcaaccatgtggacgagtcccccgtggagttcccggctaccagggttggttccccagatgcccagacccctgcccgcagtctctaactgggagatatgcctcactcactgcactactggttgtggctggtagataatctgtgtccttttttcacactgcttttcaggttcttgctttttcttttctctcctgggtaagcttcccgtaagcctgttggcttctctcctggtctgatctcagatgacactctgttgggaatggaagctttccctgttgacttggttcttgctctaacttggaaacaaggtagaaaacactgacatccagaactgtcttctccctcatgtcttcttcacctgtcttgaggcaaccctagcgggtatggcaacatttcactctctgagagtccctcgtcattacccatcatttgtgcctttgtcatctttctgtctctgggacagttacaatgactttctccccccttaagggatacgtgttcctggaaaagtttcttcagcggtctctgttctctttaacttcagtctttcctctttctttttgcctaggagccatatgggggtgccgttggtctctggtcaccgacatcctttgctctggcccaaactatgtgtccttctgtccacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggtatggccgagaggggctcctgcccagggtgactgaggaccctgaacacggggaaaaaccagttacctgctactgttggtaacagagcgacaacagttgttagaagtttcgtaattgtaataattgacatgtttgaattctaagtatcttccatatgcaccacggacctttctttaccttaatcctctcccagacataagtcaaatgccagtatttaccacgtgaatactgtggtttttcccaacatgacatttatgtaaggactgcaactgcgtacgttatacatttcatgtacgcccgtgtgaagagaccaccaaacaggctttgtgtgagcaataaagctgtttatttcacctgagtgcaggtgggctgagtccaaaagagagtcagcgaagggagataggggtggggccattttctaagatttgggtaggtaaaggaaaattacagtcaaagggggtttgttctctggcgggcaggagtgggggtctcaaggtgctcagtgggggagttttttgagccacgaggagccaggaaaagggatttcacaaggtaatgtcatcacttaaggcaaggaccggccatttatacttcttttatggtggaatgtcatcagttaaggtggggcagggcatattcacttcttttgtgattcttcagttacttcaggccatctgggcttaaacgtgcaagtcacaggggatgcgtgcaagtcacaggggatgcgatggcttggcttgggctcagaggcctgacaatacatattgtgattctgttcatcagagtgcacatactgtatatattgtacgtatgatacctttgtagacttgcttttttcttctattaagaactagagttgcctgaggttcatgtctggataataaatccagtggtctgggtcatagcttaattaaccgattcaggttgtttatgcttattcaagcattgctgcacgaagactccttacacatgtatgtatttatgtgttgttaggatcccttttttctatgtccattattacattttactttgtatagaagggatctcactatggtgcccaggctagtctcaaactcctggcctcaagcgatcctcctatctcagcctcctgagtagctaggactacaggcgtgcaccaccaagcccagctactttataaattcttttgtggaaatggagtcttgctgtgttgcccgggctggtatccaactcctggcctcaagcgatccccctgcctcggtctcccaaagtactgagaattacaggcatgaaccacggtgtctggctacatcttgcattttatggcaagctttttgttgccctcagggacagtggagtggacaggacttggcccaggatggcctctcctcactgggatttcttcatgtgggttttcttccaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtgagtccggggaagggcaaggggttctgcaggcctgaggctgtgcctgcctgcctccctttgaagacaaaggcctgggattgtattctgcagatgtgtgagcctatgccttcacactgtctgggaggaaggacaaaacttcctgtgttaaccagctacagcagattccactcacacgggggacaaaagtgctagaaagttctggatccatgggcagttggattttatgttatttcttagatttatcttttgggggcagaatcatcagtgtggactctgaggggccaggagtggccacgtgagcaagtacccaaaagtgttcagtggagaagcctggaagagaccggaagcatggccgcggcctcttgtcatttagccctggggagagaaaggcatggagttgggtttagggtcacctggtatcagttgtgaaaagggtttttagtagaattgggtatttcagagtctcttgatgattgattctagccttttaaaatctttcttggtaatgacatttagctggggaagagctgtgttgggcataactaggctgttttgattcttacactctttcaacaaagatttttttgggggcggtgagaatggagtctcactctgttgcccagactggagtgcagtggtgcgatcttggctcactgcaacctccgcctcccaggttcaaacaattctcctgcctcagcctcctgagtggctggggttacaggcacctgccaccgcaccctgctaatatttgcatttttagtacagactgggtttcaccatgttggccaggctggtctccaactcctgacctcagatgatccacccgcctcggcctcccagtgctgggattacaggcgggagccaccacgcctggcctcaacaaagattttaatcagacagacctatcctgtgatggtctcttagaagtaaatgttagtcctaccctcagagccctgagagaggctaagttaggtgcctaaggtcattgggcaagttgcagcagaagcaagccaggcaggattgaaggaaggactgtacattcctgggattcagctcaagcagagattctgtttttcccaggaattgagctaccatggggccatttgccatgagctaattgaagtttcccaagggctacaataatatattgggtgtggagtctcctttgtaggagagcccctgcatgcagttgcctgctgtgaccagcagagggaggacaagtcctgggcccatgctggcagtgaggcagctgcttccagggatgggagagcagtaactcaagtgaaggaagatggattgtttgcaattgctttgccccatcgagacataaaatgcactttgcaagatagagtctgaggctaatacaatgcagtgtggggctgtcagcattaggggatgagatgacaatatgggacctgggtctggcctgggcaagtgcctgctcagcatgtgtacgctgtttgggttgtattggagctattgggcgctggaaccagcacttgtgttggagcggtttccccccaccagagccacagtgttttctccccagtggtggtcacacccccatataggaaatcaggcattccgtgataaaatggaggtttgcatgagtgtgagcactctttacggagactagaacattccctgtgtctttcagttcctttttttttttaagagatgaggtcctcactgtcacccaggctggagtgcagtggcactgtcttggctcactgcagcctcaatcacctgggctcaagcaatccttctgccttaacagagcagctgagactgcaggtgcacaccactgtgtttggctcttaaaagtttttgtagagatggggtcttgctgtgttgtccaggctagtcgaactcctgggctcaagcgatcctctcaactcccactcccaaagtgctgggaatataggcctgagccactacgtctggcctttcagttctgattagcatccctgaatggccattttctctctcactggcaactcagtcagttcatgcttggtccagggacttggtacatcaggagacttgtggaatatggattaaatcacaagaactaaagttaaataatcacaacaagtgaaaggtgctgtgtcgagcactgttttctaaacacattcattaggtgaactcattttaataaaagggtaaagagtaaacaattatcatgcttaggaaagaaggaatatgtgcaaaccctcaatgctggagcagccacagagaatattaggactgagcctcaggggtccacaccagggacacctgcttggaaaatgtatacaaacacagggttcgcctaattgccttcattcagagtatcctccttttccacagtggaagtgtcgtacctaacaaggttctggatatctgtgtgttgagactctgccatttctatttttctgcttttttctttccttcctttcaaatagatgtctgtggactttatccccaggaatggtctcttggttaaagtgtgtgaaaatcttctgcatctgatggacaacattgtgatagacatggcacctgggacacacctgtaggtggatgttgatgatgtctttctcttttaggtctctgcagacaaactggtggcactggggctgttcagccagcactttaatttggccaccttcaataagctcgtctcctatcgaaaagccatgtaccatgctctggaggtaacatgggatgagggaatgagggctaagccctgagagcagggatgaagcaagagacccacagaaacctagctcagtgttgccaagggtggtttggaggggacagggtggccagggaggaggtaaatgacaacataacatgatggccaccggattgggcctcccaacaaagggatttgagacatcccagctgccacttattgggaccactaactgaatcagaaggaaagagcacgggcagttaggggtgcaatattcgtatcagtgaatgtgcttttccagagacctcagagccttcttatgagggttggagttcacagcaagacagcagtggaggccagctgtcttctatctgtgggccgtcttatcccctatgaaccattataccctgtttctcccttcaccttgattttttccccccacctttgttcagcatttaagagccaacctcttctcattgctaaaggcttcattagacactgaaatccttggtccttcatgtaggacacaagttaatgtccccatctttagggagataaaacaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttctagaaatccaggacttgtcttacaatccatagatttaaaggccaggcctagtggctcatgcctgtaatcgcagcactctgggaggctgaggcgagtggatcacttgaggcgatcacctggacaacatggtgaaaaatagaaaaattagcctggtgtgcttggcatgtgcctgtggtcccagctacccgggaggctgaggtgggagaattggcttgagcccaggaggcagaggttgcagtgcgccgagatcgcaccactgcattcaagcctgggtgacagagcaagaccttgtctcaaaaaagaaaacagtccatacatttaatgtaatgttttttctgttttgttttgttttcccctcaaaagtggttaataagtcgaaggtgcgtcgtgcaggcagtaggaaattagaatcaaggaaatacggtatttccttcctgtcttttgactgtgccctgttttctatgcactttcttctgatttctttgcatataaaatggtcactggaaaagaatcaaatttcttgaaaagtcaatctgaactccctccccactctcccctcacatcccaccctcacaaataccctccaggttaacgttgggttgcacatccttccagatttttctgaacactagttggattcctgctttcccctttattaatattaatactgtaagcactgtctgatgtcattttgtcactaaagggtccttaagatttttaatggctgtacaattttctttcctagggtcagagtcaaatttaaccatgtccattaagattttctgtgtagatggaatagaaatacaaatgggttttacaaaatcccatttatagaatgggagccatattatgtaaaattaaaaagtgctgggctcagtggctcacgcttataatcccagcattttgggatgcaaataaccatctcttggatttcccagcattttgggacgctgaggtgggcagattgcttgagctcaggagttccaagaccagcctgggcaacaggatgtaaccctgtttctaagagaaatacaaaattagctgggtgaggtggtgtgtgcctgtggaggctgaggtgggaggatcacctgagcccaggaagtcaggctgcagtttgctaagatcatgccactgcactccagcctgggtgacacactgagaacctgtctcaaaaaaaaaaaaaaaaaaaaaaaccaaaacagaaacaaaaaagaaagaaaaaaacgaggccaggtgcagtggctcatgcctgtaatcccagcactttgggaggctgaggcaggcagatcccttgtggtcgggagttcaccagcctggccagcatgatgaaaccccgtctctactaaaatacaaaaattagccaggtgtggtgctgcatgcctgtaacaggctgaggcaggagaatttcttgaatccaggaggcggaggttgcagtgagccaagatccacgtcattgccctccagcctgggcaacaagaaaggaacaggtgaaattaatacaaatcatgatttttttagcgctaaatttccaagatgttagcattttaatatccagctattataaaaactgagatagtctacatttatagtgctggtttcaaaatttcacttattttatatattttacatattacatattttacagatctcaattttgatgctaaatttgcaatgaaaatacttgatctgtattaactatatacagattcttgactaaatacagatgtagatggttaaacacaaattaactaaattcataaaacgtgcatttgagaaagcagactcatatgtctaggctagtcttaatgagccagttagttgacttacttgtcagtgttttaattaaccttaaatgcagaattcatttcctcaacagtttcaagttctcagtagccaccccctatgcctactgcccagcatgtcagatatcacagacatgggtatgccaggcttttagctttgaatcgagctttgctctctgagctgagtcatttttacatcctagttgtagccatttaaaaccttgtaaacatgtgttaaggatcctgggtgcaaggggttttgaatgagctcctgttgtgagttgcccatcaaggggccatatacattcagtgtggaccccctgtcatgccccaattgcagctggtacccaggcatagcatggtcttgtcctgggcccgcattctctctggaccctcctaccaagccacggctgcagtctaattacctttcacagagaacaagactcgaagacgcacagctgacgactcagccacctctgactactgccccgcacccaagcgcctcaagacaaattgctataacaacggcaaagaccgaggggatgaagatcagagccgaggtgattgttgggtacctgggatcatgggacagatgggaggaggacgctgcagatcaggaattgatctgtacccggctccctgacctcatctcatgccttcttcttttctcaatagaacaaatggcttcagatgttgccaacaacaagagcagcctggaaggtaacgttctctccctcccagtcatccccctcacaccctggctagggctctaggcctgccttgtcctggctcatccaccctgtcagggtttaacccagagctctgttccttaacctcaggccaaggcctatttctggaccctgcatcttagttgctagtttatggaatgagttgccaattgtgccccttaagagaaaggtacaggaagggtatggtgaggaacaagggaagctgggccattttggccgggagagccataacctaaaaccaagattactggtatcatgaaccttcccaaagaagaactgcaactaacaagcttttagtcacttgcctactgtcaggctaaatactctgcttgccctggctggggattgccactggattggatactctgatcagaatatacctcatggaatacagaatgtgtgaggatgaagtctcccttgcttccttaacccctagttactcaatgttgaataggaaaacaccacatccctgacccagagaacccggggaagagcttcggtttagaaatcctattccccaagactcactcccccatctggctaggtagggatgcttgtttgtgggttttataaaggtcctatctacccagccagggatgcaactccatgctgacctggtgatatgaagggaaggcagggttgcctactggttaaaggacctggattctgaaattacagccatttgctgtttacagggtgtgggcatgggcaagtcctatcatgagacaacaagccaattggagtcaccacaaaatccttagtgtcccagtatttaaagcttctcaaggattgtcacaccagggaggtccccctgctcagcgttctgcctgacatcatcctactggggcagccccttgcccatcttgatgttccccatctgtgaagtagggatgccacctggaagcattgttgagtggtagaagctgtgaggcatggcctgaggtgcaaagagtccttggcaagctgctggcctggagggaaatcttaggaactgagagaccccaggctttagcagctggtgtcagggcctcaactgccaaaagccacaaccctgtttttcttacagatggctgtttgtcttgtggcaggaaaaaccccgtgtccttccaccctctctttgagggggggctctgtcagacatgccgggtaagtcctcctactactgccctggaccttcctccccttgcctcctctaactcccctctccttcccaacagcacctgtgtggagactcagtgaagcccactcatcccagctgccttgcactctgcctctggggcaggatgggggacagctgtcacagaggccaatggcacgcaggtcacagccagttgtccttttaaaggacaccaagccaccagcagtgtgttctgcagctgtatcctagggcctccaccagcaagccggcagggcctgcccttctctggtctccgatttcactggtgtttctctctggctgccaggatcgcttccttgagctgttttacatgtatgatgacgatggctatcagtcttactgcactgtgtgctgcgagggccgagagctgctgctttgcagcaacacgagctgctgccggtgagcactgggccctgtggggtggatgtgggtgggcccccaaggctcctacgttcctgcagtctgcagacagctgtctgttgaatggaatcctaggcatgggaatagggagctaatttgccctggaagcagcacacagggtttatattttgtggtggctgtggttgtagcataattggagtagaactcatgtatagggaacggctcttttttttgagacagggtctccctgtgttgcccagggtgtacagtgacatgatcataggtcactgcagcctccaattcctgtgctcaagcaatcctcccacctcagcctcctgaacagcttgattataggcacatgccatcacacccagctagttattcttttttttttttgaggtggagtcttgctctgtcacccaggctggaatgcagtggcacaatcttggctcactgcaacctctgcctccagggtacaagcaattctcgtgcctcagcctcccaagtagctggaattataagtgcggagcaccacgcccagataatttttgtgtttttagtacagacagggtttcaccatgttgaccaggcttgtctcgaactcctgacctcaggtgatccacctgccccagcctctcaaatcccagcactcccaaagttctgggattacagtcatgatccaccgtgcctggcctattttttgtaataaataaaaagtgtaataaacgctgcctcggctggtctcaaatccctggggtcaagccattctcctacctcagcctcccaaagccccagagttgtaggtgtgagccaccacacccagctagaagtgctcttaataggccaagagcatgagggaaggggatgagtagggtgtcagggaaggctaattccctggtttgccagttggcctgtaatccaaagtgtccatggaatgaagtaggttgtcgggagagcatttctgatcagagagcctgtgggattaagggggttggggcatccaaggaagacgtcagggaagcccgtactgcacagggccccgcaggctatgctgttaagcagccgatcctaggtaagctttcaggagggggttggcatttccctgtggaagtggtaagggggtggcacaggagaccagctctgacaaaggcatcccttctccctgccactgggtccaggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgtaagccacaggctcccgcctctaccaccacagatcccaggggcacagggtgttggaaagctctggaattctcagaaagagtaatagaagtaaagacacgttgtacctcttggagcctcaatggctgagagacctggcgaattgccagctcctctgcacggttttcagccgtgccagggttcattcactccctccttgccggcttctcagcgtatggattttcaggggcctgatgaagaaatggttgtatgtagccttctgagttagcagagctgagagggaaggaaacagtagaaatgaattttctagttcttagagggaagccctaggtcattcctgtctggggtgataccttttcatgtgtgcctctgtgcatacatatctggctcatgtccaaggataaattgaccattccttgccaaatgcaggctcgtgtggtacacacttgtctccccaatccccatcaagccttcagtgggctttttgcagtggctacggcaaggtttgaagccctctgagcagggtcagcctgcccctccctcagagcttgagtctttgccctgtgccttcaccaccatgacctccttccttacctggcaggaagcccccaagctgtaccctgccattcccgcagcccgaaggcggcccattcgagtcctgtcattgtttgatggcatcgcgacaggtgagttcggggaacacctggagacactgctatcgtgtcacaacagggtagccagggagtcagaaggcatggttaaggtgtctgacatcagtggcaagaaaggtccctggggattaccagccctgaaaaaaaccctgtctccttgtttctctccaccttctcaaccaccttgcagtcttggtcattgagttttatttatttattttttcgagatggagtctccctttgtcacccaggttagagtgcaatggcgtgatctgtgctcactgcagcccccatctccgaggttcaagtgattctctcctcagcctcccaagtagctgggattacaggtgctcaccaccacgcccagctaatttttatatttttcgtagagacggggtttctccacgttggtcaggttggtctcgaattcctgacctcaagtgatctgcccaccttggcatcccaaaccgctgggattagagacatgaaccaccgtgcctgggcagtcttggtcattttaaaaggacatacatcttagctgttacactttattttttatgtgcagttatcttgaacttgattttcattccacatgcataagtataattggagataaactagttaacaactactgctacctctggttttggttcccttcttttcctcctatatggagtttacacagccaatatgtgtggtgcgtgtacagcctttgctggattgaacgcatgtgatacagtcatgaggaactgttcattttaccatagcagggagtggaggaaatgagctgctgtgtgctcagcatcatttatgcttctgtgtctctctggcccccacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatgtgagggcagtctgtaccttgcgggcctcatctcttcctgtctttttccccagtcctccacaccctgaaacccacatgtaggccccatccctgagaccccagaaaaaaggattgaaatcctgtgggaatcttaagcattaggttagggtcagaagtggagttggtgaccaagcaagattctatttttttctggagacagtctccctctggagtgcagtggcatgatctcagctcactgtaacctctgcctcccgggtttaagcgattctcttgcctcagcctcccaaagtgctgggattacaggcacctgccaccatgctgggctaatttttatatttctagtagagttggggtttctccatgttggccaagctggtctcgaactcctgacctcaggtaatccacccccgccgtcagccttcctgggattacaggtgtgagccacctcgtccagccccacgcaagattctagaagtgggtccagctctctttccctctgtccacaccctcatcctgactctgtctctctctttcagattgaagaatggggcccatttgacttggtgattggcggaagcccatgcaacgatctctcaaatgtgaatccagccaggaaaggcctgtatggtgagcatccttctctctggcagtccctggagagcctatgtcacctgaccactggcccaggtgcagcagcctgagaaggagccacttgcttctggccaagttactggcagcatcaggggcctgttggtgctgcctacgctccatagtaaatcctcagcccacaagggaaataccctagtaaatagtgccctgctgctgcctgtgtccctgctgtcattcaggtggacatagactggtaggcatcaccctgaactgtcaggaggccattgggaacctgctggtctcagggaataaggtgggttgggctggaggtttcaaatgaaccctgcgctgtcatcttttctgagcacagagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggaggtgagggaatctggggacctgattgtcacagacagccagggcagggaaagcgctgctggcagtgatgattggtgggtgttgccaacattgggaatgactttcccgttcttggtctggctagatccaatagtgagggattcagtgggttctcttagtacatggaaaatattttttttgagacagggtcttgctctgtcacccaggctgaagtacagtggcattattacagctcactggagcctcaaacagctgggctcaggcaatcctcctacctcagcctcccaaatggctgggactacaggggcacaccaccgtgcccagccaatttttgtatttttggtagagacagggtcttggtatgttgcacaccctagtcttgaactcctgggctcaagcaatccgcccacctcccaacgtgttgggattggagatagagatgtgagccaccatcccctgccagtacaaggaaaataattgatctctaatctcagcccaactctttgaagtcagaaatgatgaaacaaaccatcatctgctgttaaggactcatgagatttgactcaattttttactctagagagttttctcatttttgatatgaaaactgctttagaccaggcacagtggctcatgtctgcagtcctagcattttgggaggctgaggttggaggatcacttgagcccacggtgtatcatattttgtaataatctggcgtatcccaggggataccgtctcagaatctgcaggtttgaccttatctctttagctaccattagcatagtatgagggcatttaccatgtcctctagccagcctcctgatggcagtaggtctttcctgttttggaggatccgtgcctcatccatagtcagggaatagccctgtcacctgcaaaggtctggttgacactgaaactctaataataggctcctaacagtaaccttctttctccccacagtgtaatccagtgatgattgatgccatcaaagtttctgctgctcacagggcccgatacttctggggcaacctacccgggatgaacaggtaacaaagggctcttagtgggtcaggtaacagccaagttaaatatgtgataacaagctctgacattcaagccttcctagaaagacctggctctgctgagaaatagttatacttggatttcagaccacctgtggtcgtgcgggttgatctctgttaagatgttcagcaagtacctgggaatctctgtaggagtcccactcttacctgttgtaagctgctgatggacctgatcctaaaagtcccacgtggctgggtgtggtggctcacgcctgtaatcccagcactttgggaggccgaggctggaggatcgcttgagcccaggagttctagactagcctgggcaacaaagtgagaccccgtctctacaaaaaaataaagaaaaatacaagtctcatgagctgtggccagactgtgtacctccttcctgccagggatctctcaagacttgagcttgttgatgctcctgcccttcacctctcctccccgttgatgtagtgacagccgtctggaaatggaagtagattgttgttaccggtgcctttcctcctgccctggagatgaagcgatcttggccaggctcatggtgaccaaccaggtggcagagctgctatgacaaacaatagcccaaagactatgtccctcagattctcatcaccaggagcatttcatattttgttatcgtatactaaaaacagtcttcttcagacactctgaaagccacaaagcagctttgctgaggattaattatttcttctatatgtggtttcaaggagaagaacttgctaattaagatgtaaaatgttatggtaatgtgacatcccagacttgcaaatgagttgagcttaaaacattctcctgtagaaggaggcatggaaacataataaccttctgccacttagtgaagtgtggacagaggtgagggtcctggggtagcttggaggatttttgttggtcaccttgcccgtgtacttggctaagcagccagtcttagggtgccatgtctgtgtctggaattaaatgggttaatgctttcaacatttgaactcccagtaggccaggcactgttacgctgttgccattttcatggttaaacacatcatgtcgatagtgacatgccgaagggggagggagagaagacaatgatttggggtttattgctggcggatggacattggaagggttgatggggaaggcttctcattctagcgaaggtcctaagtgaagggatggacccatgcagttattagagtactccaggtgggaagagggtctgggatgatgggaaacatccccagaccagctcagagcaccctaggtggggtggctgggagagaaggaccaagtaacttgggccttaatgtggtaccgctgaaatcactttggcatgggaagttacagatgagatgaattgtgctttggttcatggtagtttctgggtggattatagacaataacaggatggaggcgggaatggggagacaagtgaagggactagactgctcaaagaaggagagatgactgattatgatgttatgccccaggaggtgccatccatagagaacacagtgtgagtggtggcccctggggtttgcagcacagcaatcctgtgacttagcaaggacggatcagattcaacatatgtggagggtaggacatttgctgatgcattggatgtgtaggctatgaggtggaaagagcagtgagacctgatgcagatctgatgctgtgactaagctctgcaggcttataggatgggtgtgtcaggcatcatttaggggacagacccaagtcatctggcttgtttagagcttaatcttatagtcagcacaaggcggggctgtgcagtgtccttttcttctgggccctcagctcccctgggtccatgtcggaggtaggaatggggatagaggtagcatttgaagcctggcaggtgaggtcaaggaaatctatcagtctaggggaaatatgtgttgtgatttcctcagcccctcttgtaggcacggttcccgttctcatgtctgagttgtttggccttgacgttcctaacacaggttactatggccgtccctgcgtccagtcctcttgcaccagtttctgttctggagctgctcaactactttcagttctagcccttgcccttcttagtcatctgtttgcctctctctgcatttgcaaaataattttcaagggtgaaagttaaaagggtgcttagtctttttttttttttttttttttggaaccttaagagacagggtctgtctcccaggctggagtgcagtgttgtaatcataactcactgtagcctccaactcctaggcttaagcgatcctcctgctttgaactcccaaattgctgggattaagggtaggaaccactgcaggcggttgccattcacttttaaagcctcctgaggctgtatccccagcagtgagccaccaaaccgtgggtgtgatatgataattgtatcaggtagacccacaaaaatctattccaagctcctcactttaaaatagacaggaagcccaaaggggtagtgtgactcgctcaagctcagtcagtgagcagtgtggagctgggacctgaggtttctcctgccctaccccatgcagtgttcctgctcaatgggaacctgactttgaagtccaggcaggggagcattacctcctggatgctgggctgtcccctctagcccatccttggctttggcacacaggcttgtgctcatgccaggatcattttcatcatttatttgtagccaagttcactgccagggcacatctctgcaacatagaccctcactcccaccttgtgcctagcagaggaccctctatagctagtaagaagtaatgggttttggctgttcccaggcccgtgatagcatcaaagaatgataaactcgagctgcaggactgcttggaatacaataggatagccaaggtaagacgagctgtggccctctggaaaaatgcacttggtgacctccaagtggggacttgggagatgaccttggtgtttgattggttcctactcctccccccacgtgacttcctggtgttgggcttccctctcccacatgattgttctgtcccatcctcaaatacagagactaggagacattcgtgataagtaatcacgacgagaaaaggcaactagtctttttaattttagtactggatacataaagacaaagagtttcagctggccctctcagggagaaaggaatcattaatccttttgccaaaaaattaatttgctgtcaagtcatagaatatgaagacctccataaacctaaatctcaatgtttgcatcaagctaagatccattttctaaactccaattgagcattctctgtatctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggtgagcaaggctgcacttggagagggaaactgtgtagatcaaaacacaaatgggcagacatgggcaggtgcttaccttcattcttgatggcctcactgccctttggtgttactggggcgaggagtaataataccttttcatagttcgcccttatttcctgacaaaaatggcggagggggtgtggtggtggtgaggaatctgagacatgaggtcattaggccacaccatctgtctgttggctgcactgccgtgacatctgcctgtcccaacatgctgggacactacgatgtgtgagaagccagtgaaagaaaaccccacagacatgccattcttgaagacttcagtttgctcattctataaatgattccttcttagccacagtttatcctctccttccctttctttgggctaagtttgtctgttttgatgcaaataaccatctcttggatttcagttctgttctgttctgttttctttcactcctctattgtttgttcattttgcttatactattttttaaaaatcattatttgctatagtgattatggctttgaacattcctctttacatgtattctgtattctgaaggctttgatatagagtattttcattccagatatttcacttctataactcatttaatttcttctttgacttaccaacagttttctgagtataaaagtaacttctgattagtatttatgctgtagattattctgtatggacctaaacctaaaatggttggtgcagatggctgacattgtgtagacgctaagaccaagcaagacacaggcctgaggtatcacatctttggcatgtttctgaataacccacgcagccattggcctgttgggatgacttttagtattggattgtatacctgagtaacactgaggctcagcctctgtagcctctttccaggcctggtagaatcctatagaggaagcttttggtatatttgatgccatctgcctggagtcatctagcatggtccttcatccggcagctgggtttgaagagggaaggaaaactctggttgcctgagcctgtgatgactgaaaatctaggctgtttttgagtgaccttgttccttattaaggaaattgcttaacttctcccatcatagtgttttgaaaatggatacattgctggctggctgatttagtatgcatgcatttattctaggaaggtcctctgagcaccaactctatgccaagagtatggtgctaggcctgcacaaaacgggggactttcatttgtgagcaatttgtaagcaagtgttctgaattaagggctctgaatttaggtccttggggaccttactgatgggactgagggatggcgagggcagaaagagtgggacctggctggttgaggctgtcaacatcctggaggcacttctgacttgctgtcttttcactccggtacccccaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 1681 - DNA, 46972 bp, Homo sapiens; identical to SEQ ID NO: 1680
  source 1..46972: mol_type = genomic DNA

SEQ ID NO: 1682 - DNA, 46972 bp, Homo sapiens; identical to SEQ ID NO: 1680
  source 1..46972: mol_type = genomic DNA

SEQ ID NO: 1683 - DNA, 46972 bp, Homo sapiens; identical to SEQ ID NO: 1680
  source 1..46972: mol_type = genomic DNA

SEQ ID NO: 1684 - DNA, 46972 bp, Homo sapiens; identical to SEQ ID NO: 1680
  source 1..46972: mol_type = genomic DNA

SEQ ID NO: 1685 - DNA, 29505 bp, Homo sapiens
  source 1..29505: mol_type = genomic DNA
gaagggagagagcaaacaaaggggtcaggagggaaaataatgcactggcttcctgagcccctgcagaggctgagcagggagagggggccagggccagaggggacagaggctggcggcagacgggccgggacaggcaggtcctaaatggcattgtttgaaggggccggctaattgcacagagcagtctgagcctgagaccccagccctggcctccccactctgtcctgggtgctggcgtctgagccttcgggacagcctgtccacatggaaccaagtcctgagcctccaagcttggtgagggggaggctatggggggcagcctgggtggggtacttgggcaagagcatcaccctaagaatgcatcctggggccttggcctgagaacacagagcccatggcgggggaacactgtccctctcatgtccctgcttccctttcaccccacccattctggcttctcccacaggaaagcatgaagggagacaccaggcatctcaatggagaggaggacgccggcgggagggaagactcgatcctcgtcaacggggcctgcagcgaccagtcctccgactcgcccccaatcctggaggctatccgcaccccggagatcagaggtggctgggcagtggggactggggtggtgtcaggcgctgacatagtgagcggtcactgcagacaactggaggctttggggagagtctctgacaacctccaccacaattccccgggagggaagagagctctagcaaggagggatgcagggtcgagcccttcacacctgcccgcagcccttggcctcccctttgggactctcatctcagctgggactctgagcgtgacacaagggtgatggttccctgtcctctgccagtcatgacaggggtggtctcagcatgggcccttggagagcccttctgcagtgggaccctctccccactcagagctgggctggggttgggagggggaggtctggagtgtgcttcctttccaccctgccctgagcagctccagccagctcacttgggatcccgccccagctgggttggaaagccctgcattgtcctctcagctgtgccatcccatggaacttcctgcgagcgtgaaagggttctatttctgcattgttccccacaatagccacactctacatgggagcacttgagaagcggctgacacagcaggcagtgaattgttcctggaaatgtagttagtggtccctggatgggcagcaccctgctggaaggaatcggagggctccccttggtaacttcagtgttggtttgggtcctgtcacgtgcctggcccagggctctgttgtcttaggaataaaatcagtggagaagatgaacgatactgacggactgagagcaaatccctgtggctgacaatagtgtaggggagatcccaggccacgccacggagaaaagcccctattagcaaggccgttccccagactggtgcctgcccccacaaaacagactcctggctgtttcctctacaggccgaagatcaagctcgcgactctccaagagggaggtgtccagtctgctaagctacacacaggtatggtctctgctctccctttttcagggctcagggactttgtctttggctttcatcacgtgggctgcctgaggcccataaaaactggcatctgcaaatgtatggagggttgccgagctagatgctttctgcatatatttggcattattttttcaatctggacgatcagttacattgctaaatctctaatatggtagtcccctcttatctgtcattttgctttccacgatttcagttgcttgcagtcaactgccgtctgaaagtattaaatggaaaatattaaatggtaaatcccagaaataaacaatttatacattttaaattgagtgccattctggtagcatgatggaatcttgcactgtcctgctccgtcctgcccaggatcagtcctgtctttgtccaacatctctatgcttaggtgctacctgcctgttagtcacttgtagccgtctccgtgatcagatcagttgcagtatcacagtggttgtgttcaagtagtgcttgttttacttaataacggctccaaagtgcaggagtgatgacgctggcaattcagttatgccaaagagaagccatgaagtgtttcctttaagtgaaaaagtgaaagttctcaaaaaggaaagaagaaatcatatgctgaagttgttagatctgtggtaagaacaaatcttccagccgtgaaatcatgaagaaggaaaaataaatgcatgctagttttactgttgcacctcaaactgcaaaagttatggccatgttgtgtgataagtgtgtagttaagatgggaaaggcattaaatttgtaggtggaagacatgaacagaaatatgttctgattgacagcagtgctttgtgccagggagcattgagcctatagcaagggatcccctgacaccaaaccatttacttcaagtaagggatggttacatagattcaagaataggtttctactgaaaactataaaaatgactggagaggctgcatttgccaatgaaaaacctgctgctacattttcagaagagttgaagttgattgagaaaggaaacaatccaaaactaagactgcagtgaaaccagactcctccagaagatgatgtctaatagaacctaccttcataaaagtgcaaaggaggaagacactaggtcataaaccatggaaggacagattaaccctgaatagagtacaagaagatattttgagagagaaaccacattcatatggcttttattaacagtatattgtaattgctctattttattattagttgttaatctgtgcctaatttataaattaaactttatcataggtatgtagatatagacaaaaacagagcacatatagggttccatcttccaaggtgtcaggcagccatggggggtcttgcatgtatcccccctggataaggggagactactgtatagcaaactgtctttttattcctggaatgagtccaacttggttatggtgcattttgaagttgattttattcatgtattcatgaatgaaatgggtatttttttttattcatttatttttgagatgaagtctgttgcccaggctggagtgcaatggcatgatctctgctcactgcaacttactgcctcccaggcccaagcgattcccctgcctcaggctcccgagtagctgggactacaggcaatggaccaccatacccagccaatttttttgtatttttagtagagatggggtttcaccatgttggccaggctggtctcgaactcctggcctcaagtgagccacctgtcccggcctcccaaagtgctgggattacaagtgtgagccaccatacctggcccattttatttctttaaatatatctatggttttgatgttaggattaggtgggctcaaggaattttttttacaagctggaagaaacttgtctaagcttattttaatgaatttcaaacaattatatcttctaagacttgctacattatcaagctttctacttcatttacttttccaaggttggatctttcccatcttgttttgtgttccttcctttactgacaccgtctgtttcctaattattcttagtagagtttgtcaattgggttggttttgctcagagccagtatcagtcataaaagtcctgggcaatgaaaactcaccctcagcttccattctcttggtggtggccaacctacttaggggactcagaaggtggggaacctaagccctgggaggaattagggcagctgcaggatcagaggctcagcactgctgttttgtttctggtagctagttaccagaaacagtaatgaaatctcttgcccacacgtttctttttgtttgtttgttttgttttgagacagagtctccagtctgtcgcccaggctggagtgcaatggcacgatctcggctcactgcaacctccgcctcccaggttcaagtaattttcctgcctcagcctcccaagtagctgggcttacaggcgtgcaccaccatgcccagctaacttttgtatttgtatttgtatttttttttttttttgagatggagtcttactcttgttccccaagctagagtgcggtggcgcgatctcggctcgctgtaacctccacctcccaggtttaagcggtactcctgcctcagcctcctgagtatgagtagctggaattacaggcacatgccaccatgccctgctaatttttgtatttttagtagagacagggtttcgccatattggccaggctggtcttgaactcctgacctcaggtgatccacccgcgtcggcctcccaaagtgttgggattacacgcctggcctaatttttgtattcttagtagagatggggtttcaccatcttggccaggctggtctggtgacctcaggtgacctcagtctgccccagactcccaaagtgttgggattacaggtatgagccaccacaccctgcatattatttgattcttgatgtaaccctgttgtgctatgagggaagtactgttattccaattttaaaatgagggaaatggactcaaagccacacagttggtgagtgaaggcaagtgcttaacactccagccagacctagctgctcgctgcttcagcttttgtgtttggcttatgctgggttttggtgtgaggtgtgaggcctgcacgaggaagccctgatgacatggtgcaggtttcatgccattgcttccggggcatctgtcgtggttggtctgtgtctgcacccatatgcagtgtgttgtgatgagtgacccggtctccctgccaggcacaggcgatcagtctttcatattgcaggtgccttgtttctttgacttgctgataccctggggtcttcatcatgttcatcatgtttccttataaaggacttgacaggcgatggcgacggggaagatggggatggctctgacaccccagtcatgccaaagctcttccgggaaaccaggactcgttcagaaagcccagctgtaagtagccacacctcgagccaaagcacttgtggccaacactctacatagcatacatagcatgctacatacatagcatagctccttaggggagcttttaagagaaagtgatgaaaaaatgttttgaaactagaaaatataagcaaggctcttggactattgttggagggttttcttttttctttttttttttctgagacggagtctcactgtgttgcccaggctggcgtgcaatggcgtgatcttagctcactgcaacaacctctgcctccttggtccaagtgattctcctgccacagcctcccaagtagctgggactacacgcacctaccaccacacccggccagtttttgtattttcagtagagatgaagttttaccatgttggccaggctggtctcgaactcttgacctcaggtgatccacccaccttggcctcctaaagtgctgggatttcaggtgtgagccactgcgcccggctggaaggttttctctatgtgccatttctttcaggtggtttttaagttctttcttgtaacactcttggaggtgcctaggggtgatagagtttgcagggtggatggctcagctgctaatgacctagggagtccaccatttctgtgggtggattttgtgcctcagagttttgaggtatggcaatgggaaggcagttattgcttatggtcacccagccctttagagaccagactgacagttactatcccaggtgtgggttacagtcttcccttcccaggatatggtctgtatcatcccctttgtggagatgagagaagattccagcaacttaactgaggttaaacatcaactcttctatgcataatttggacacaggttctgcaacaaccaaattcatgccatttttgacaatgaacatggagcctaaggaattctattccatcttgatgatctggtgccttcctgaacccagtaattggccttatgcttctttgacataaaagtttattttagagtgaacacgaatttttctttctttctttctttctttttttttctttttttttgagatgcagtctcactgtgttgcccaggctggagtgcagtgacgtgatctcagcacactgcaacctctgcctccctggtccaagtgattctcctgcctcagcctcctgagtagctgtgactacaggcacccaccaccatgcctggctaatttttgcatttttagtagagatggggtttcaccattttatccaggatgatcctgaatttctgattgcaagtgatctgcccgccttggcctcccaaagtgctgggatcacaggcatgagcgagccactgcgcttggccagatttttatttttcaatcccaattggcaggtgccatttcagctggccatgtctgtctgctgtgacaggcagagcaggacctgctgggaattgtcgggcatcctagctggccaccctaccacctctattccaagaactggggaattctggctggactcagtccagagtcccacctcatcacctgttcacttccagttgtcctgaagctggctaccaggtctccttggccacctgaaggcctaatccttctggccccgccagaccccaggcctccagtcacctaaggcccagtgagtgtcctctcttgcttctaggtccgaactcgaaataacaacagtgtctccagccgggagaggcacaggccttccccacgttccacccgaggccggcagggccgcaaccatgtggacgagtcccccgtggagttcccggctaccagggttggttccccagatgcccagacccctgcccgcagtctctaactgggagatatgcctcactcactgcactactggttgtggctggtagataatctgtgtccttttttcacactgcttttcaggttcttgctttttcttttctctcctgggtaagcttcccgtaagcctgttggcttctctcctggtctgatctcagatgacactctgttgggaatggaagctttccctgttgacttggttcttgctctaacttggaaacaaggtagaaaacactgacatccagaactgtcttctccctcatgtcttcttcacctgtcttgaggcaaccctagcgggtatggcaacatttcactctctgagagtccctcgtcattacccatcatttgtgcctttgtcatctttctgtctctgggacagttacaatgactttctccccccttaagggatacgtgttcctggaaaagtttcttcagcggtctctgttctctttaacttcagtctttcctctttctttttgcctaggagccatatgggggtgccgttggtctctggtcaccgacatcctttgctctggcccaaactatgtgtccttctgtccacagtccctgagacggcgggcaacagcatcggcaggaacgccatggccgtcccctcccagctcttaccttaccatcgacctcacagacgacacagaggacacacatgggacgccccagagcagcagtaccccctacgcccgcctagcccaggacagccagcaggggggcatggagtccccgcaggtggaggcagacagtggagatggagacagttcagagtatcaggtatggccgagaggggctcctgcccagggtgactgaggaccctgaacacggggaaaaaccagttacctgctactgttggtaacagagcgacaacagttgttagaagtttcgtaattgtaataattgacatgtttgaattctaagtatcttccatatgcaccacggacctttctttaccttaatcctctcccagacataagtcaaatgccagtatttaccacgtgaatactgtggtttttcccaacatgacatttatgtaaggactgcaactgcgtacgttatacatttcatgtacgcccgtgtgaagagaccaccaaacaggctttgtgtgagcaataaagctgtttatttcacctgagtgcaggtgggctgagtccaaaagagagtcagcgaagggagataggggtggggccattttctaagatttgggtaggtaaaggaaaattacagtcaaagggggtttgttctctggcgggcaggagtgggggtctcaaggtgctcagtgggggagttttttgagccacgaggagccaggaaaagggatttcacaaggtaatgtcatcacttaaggcaaggaccggccatttatacttcttttatggtggaatgtcatcagttaaggtggggcagggcatattcacttcttttgtgattcttcagttacttcaggccatctgggcttaaacgtgcaagtcacaggggatgcgtgcaagtcacaggggatgcgatggcttggcttgggctcagaggcctgacaatacatattgtgattctgttcatcagagtgcacatactgtatatattgtacgtatgatacctttgtagacttgcttttttcttctattaagaactagagttgcctgaggttcatgtctggataataaatccagtggtctgggtcatagcttaattaaccgattcaggttgtttatgcttattcaagcattgctgcacgaagactccttacacatgtatgtatttatgtgttgttaggatcccttttttctatgtccattattacattttactttgtatagaagggatctcactatggtgcccaggctagtctcaaactcctggcctcaagcgatcctcctatctcagcctcctgagtagctaggactacaggcgtgcaccaccaagcccagctactttataaattcttttgtggaaatggagtcttgctgtgttgcccgggctggtatccaactcctggcctcaagcgatccccctgcctcggtctcccaaagtactgagaattacaggcatgaaccacggtgtctggctacatcttgcattttatggcaagctttttgttgccctcagggacagtggagtggacaggacttggcccaggatggcctctcctcactgggatttcttcatgtgggttttcttccaggatgggaaggagtttggaataggggacctcgtgtggggaaagatcaagggcttctcctggtggcccgccatggtggtgtcttggaaggccacctccaagcgacaggctatgtctggcatgcggtgggtccagtggtttggcgatggcaagttctccgaggtgagtccggggaagggcaaggggttctgcaggcctgaggctgtgcctgcctgcctccctttgaagacaaaggcctgggattgtattctgcagatgtgtgagcctatgccttcacactgtctgggaggaaggacaaaacttcctgtgttaaccagctacagcagattccactcacacgggggacaaaagtgctagaaagttctggatccatgggcagttggattttatgttatttcttagatttatcttttgggggcagaatcatcagtgtggactctgaggggccaggagtggccacgtgagcaagtacccaaaagtgttcagtggagaagcctggaagagaccggaagcatggccgcggcctcttgtcatttagccctggggagagaaaggcatggagttgggtttagggtcacctggtatcagttgtgaaaagggtttttagtagaattgggtatttcagagtctcttgatgattgattctagccttttaaaatctttcttggtaatgacatttagctggggaagagctgtgttgggcataactaggctgttttgattcttacactctttcaacaaagatttttttgggggcggtgagaatggagtctcactctgttgcccagactggagtgcagtggtgcgatcttggctcactgcaacctccgcctcccaggttcaaacaattctcctgcctcagcctcctgagtggctggggttacaggcacctgccaccgcaccctgctaatatttgcatttttagtacagactgggtttcaccatgttggccaggctggtctccaactcctgacctcagatgatccacccgcctcggcctcccagtgctgggattacaggcgggagccaccacgcctggcctcaacaaagattttaatcagacagacctatcctgtgatggtctcttagaagtaaatgttagtcctaccctcagagccctgagagaggctaagttaggtgcctaaggtcattgggcaagttgcagcagaagcaagccaggcaggattgaaggaaggactgtacattcctgggattcagctcaagcagagattctgtttttcccaggaattgagctaccatggggccatttgccatgagctaattgaagtttcccaagggctacaataatatattgggtgtggagtctcctttgtaggagagcccctgcatgcagttgcctgctgtgaccagcagagggaggacaagtcctgggcccatgctggcagtgaggcagctgcttccagggatgggagagcagtaactcaagtgaaggaagatggattgtttgcaattgctttgccccatcgagacataaaatgcactttgcaagatagagtctgaggctaatacaatgcagtgtggggctgtcagcattaggggatgagatgacaatatgggacctgggtctggcctgggcaagtgcctgctcagcatgtgtacgctgtttgggttgtattggagctattgggcgctggaaccagcacttgtgttggagcggtttccccccaccagagccacagtgttttctccccagtggtggtcacacccccatataggaaatcaggcattccgtgataaaatggaggtttgcatgagtgtgagcactctttacggagactagaacattccctgtgtctttcagttcctttttttttttaagagatgaggtcctcactgtcacccaggctggagtgcagtggcactgtcttggctcactgcagcctcaatcacctgggctcaagcaatccttctgccttaacagagcagctgagactgcaggtgcacaccactgtgtttggctcttaaaagtttttgtagagatggggtcttgctgtgttgtccaggctagtcgaactcctgggctcaagcgatcctctcaactcccactcccaaagtgctgggaatataggcctgagccactacgtctggcctttcagttctgattagcatccctgaatggccattttctctctcactggcaactcagtcagttcatgcttggtccagggacttggtacatcaggagacttgtggaatatggattaaatcacaagaactaaagttaaataatcacaacaagtgaaaggtgctgtgtcgagcactgttttctaaacacattcattaggtgaactcattttaataaaagggtaaagagtaaacaattatcatgcttaggaaagaaggaatatgtgcaaaccctcaatgctggagcagccacagagaatattaggactgagcctcaggggtccacaccagggacacctgcttggaaaatgtatacaaacacagggttcgcctaattgccttcattcagagtatcctccttttccacagtggaagtgtcgtacctaacaaggttctggatatctgtgtgttgagactctgccatttctatttttctgcttttttctttccttcctttcaaatagatgtctgtggactttatccccaggaatggtctcttggttaaagtgtgtgaaaatcttctgcatctgatggacaacattgtgatagacatggcacctgggacacacctgtaggtggatgttgatgatgtctttctcttttaggtctctgcagacaaactggtggcactggggctgttcagccagcactttaatttggccaccttcaataagctcgtctcctatcgaaaagccatgtaccatgctctggaggtaacatgggatgagggaatgagggctaagccctgagagcagggatgaagcaagagacccacagaaacctagctcagtgttgccaagggtggtttggaggggacagggtggccagggaggaggtaaatgacaacataacatgatggccaccggattgggcctcccaacaaagggatttgagacatcccagctgccacttattgggaccactaactgaatcagaaggaaagagcacgggcagttaggggtgcaatattcgtatcagtgaatgtgcttttccagagacctcagagccttcttatgagggttggagttcacagcaagacagcagtggaggccagctgtcttctatctgtgggccgtcttatcccctatgaaccattataccctgtttctcccttcaccttgattttttccccccacctttgttcagcatttaagagccaacctcttctcattgctaaaggcttcattagacactgaaatccttggtccttcatgtaggacacaagttaatgtccccatctttagggagataaaacaagaaatctagtgccgccttatataagatacagaggagatgagatagtgctggctggggcttctatatcttggtggtagagttaattctgatatgtctgccttttgagtgggaggtgaccactgacattccctagggggaagagatcctatttggtgcctgcatgaaaagatttaaccacaaccccccttccgaggcctctccctgcacaggcccctccttcctctgtcacataccacagcccaggacagctgtctggctatgaaagggcccagtgtgaaggggaatgtaggccctggctgggggaatccctgggtgtggcctggcgagcacctcctccccacccccccattcatcacagactctgcctttgcagaaagctagggtgcgagctggcaagaccttccccagcagccctggagactcattggaggaccagctgaagcccatgttggagtgggcccacgggggcttcaagcccactgggatcgagggcctcaaacccaacaacacgcaaccaggtgggaatgagtccccatggcagcacccgctgcctctgctggtgggaccacttcttgggagagtcagccacccctgctgccccacaccccacccagctttctagcagctggtctcaactctgaatgttggaaaaataggagcaggcatacgaaggctgtgccagctctatctggcttccccggccactttcttgctgatggtcacgtgcatataatttgtattgaatctgacatctgtcttgaagtcaggatgcagtgttgactagcaccttttttattaaaggaaaaaatagttaagctatgctcatttgagaaaattggaaagtgttaaagaagaatatgccacctgctaacattttgaccagtaccatatttctcccattataagataactctggtttctagaaatccaggacttgtcttacaatccatagatttaaaggccaggcctagtggctcatgcctgtaatcgcagcactctgggaggctgaggcgagtggatcacttgaggcgatcacctggacaacatggtgaaaaatagaaaaattagcctggtgtgcttggcatgtgcctgtggtcccagctacccgggaggctgaggtgggagaattggcttgagcccaggaggcagaggttgcagtgcgccgagatcgcaccactgcattcaagcctgggtgacagagcaagaccttgtctcaaaaaagaaaacagtccatacatttaatgtaatgttttttctgttttgttttgttttcccctcaaaagtggttaataagtcgaaggtgcgtcgtgcaggcagtaggaaattagaatcaaggaaatacggtatttccttcctgtcttttgactgtgccctgttttctatgcactttcttctgatttctttgcatataaaatggtcactggaaaagaatcaaatttcttgaaaagtcaatctgaactccctccccactctcccctcacatcccaccctcacaaataccctccaggttaacgttgggttgcacatccttccagatttttctgaacactagttggattcctgctttcccctttattaatattaatactgtaagcactgtctgatgtcattttgtcactaaagggtccttaagatttttaatggctgtacaattttctttcctagggtcagagtcaaatttaaccatgtccattaagattttctgtgtagatggaatagaaatacaaatgggttttacaaaatcccatttatagaatgggagccatattatgtaaaattaaaaagtgctgggctcagtggctcacgcttataatcccagcattttgggatgcaaataaccatctcttggatttcccagcattttgggacgctgaggtgggcagattgcttgagctcaggagttccaagaccagcctgggcaacaggatgtaaccctgtttctaagagaaatacaaaattagctgggtgaggtggtgtgtgcctgtggaggctgaggtgggaggatcacctgagcccaggaagtcaggctgcagtttgctaagatcatgccactgcactccagcctgggtgacacactgagaacctgtctcaaaaaaaaaaaaaaaaaaaaaaaccaaaacagaaacaaaaaagaaagaaaaaaacgaggccaggtgcagtggctcatgcctgtaatcccagcactttgggaggctgaggcaggcagatcccttgtggtcgggagttcaccagcctggccagcatgatgaaaccccgtctctactaaaatacaaaaattagccaggtgtggtgctgcatgcctgtaacaggctgaggcaggagaatttcttgaatccaggaggcggaggttgcagtgagccaagatccacgtcattgccctccagcctgggcaacaagaaaggaacaggtgaaattaatacaaatcatgatttttttagcgctaaatttccaagatgttagcattttaatatccagctattataaaaactgagatagtctacatttatagtgctggtttcaaaatttcacttattttatatattttacatattacatattttacagatctcaattttgatgctaaatttgcaatgaaaatacttgatctgtattaactatatacagattcttgactaaatacagatgtagatggttaaacacaaattaactaaattcataaaacgtgcatttgagaaagcagactcatatgtctaggctagtcttaatgagccagttagttgacttacttgtcagtgttttaattaaccttaaatgcagaattcatttcctcaacagtttcaagttctcagtagccaccccctatgcctactgcccagcatgtcagatatcacagacatgggtatgccaggcttttagctttgaatcgagctttgctctctgagctgagtcatttttacatcctagttgtagccatttaaaaccttgtaaacatgtgttaaggatcctgggtgcaaggggttttgaatgagctcctgttgtgagttgcccatcaaggggccatatacattcagtgtggaccccctgtcatgccccaattgcagctggtacccaggcatagcatggtcttgtcctgggcccgcattctctctggaccctcctaccaagccacggctgcagtctaattacctttcacagagaacaagactcgaagacgcacagctgacgactcagccacctctgactactgccccgcacccaagcgcctcaagacaaattgctataacaacggcaaagaccgaggggatgaagatcagagccgaggtgattgttgggtacctgggatcatgggacagatgggaggaggacgctgcagatcaggaattgatctgtacccggctccctgacctcatctcatgccttcttcttttctcaatagaacaaatggcttcagatgttgccaacaacaagagcagcctggaaggtaacgttctctccctcccagtcatccccctcacaccctggctagggctctaggcctgccttgtcctggctcatccaccctgtcagggtttaacccagagctctgttccttaacctcaggccaaggcctatttctggaccctgcatcttagttgctagtttatggaatgagttgccaattgtgccccttaagagaaaggtacaggaagggtatggtgaggaacaagggaagctgggccattttggccgggagagccataacctaaaaccaagattactggtatcatgaaccttcccaaagaagaactgcaactaacaagcttttagtcacttgcctactgtcaggctaaatactctgcttgccctggctggggattgccactggattggatactctgatcagaatatacctcatggaatacagaatgtgtgaggatgaagtctcccttgcttccttaacccctagttactcaatgttgaataggaaaacaccacatccctgacccagagaacccggggaagagcttcggtttagaaatcctattccccaagactcactcccccatctggctaggtagggatgcttgtttgtgggttttataaaggtcctatctacccagccagggatgcaactccatgctgacctggtgatatgaagggaaggcagggttgcctactggttaaaggacctggattctgaaattacagccatttgctgtttacagggtgtgggcatgggcaagtcctatcatgagacaacaagccaattggagtcaccacaaaatccttagtgtcccagtatttaaagcttctcaaggattgtcacaccagggaggtccccctgctcagcgttctgcctgacatcatcctactggggcagccccttgcccatcttgatgttccccatctgtgaagtagggatgccacctggaagcattgttgagtggtagaagctgtgaggcatggcctgaggtgcaaagagtccttggcaagctgctggcctggagggaaatcttaggaactgagagaccccaggctttagcagctggtgtcagggcctcaactgccaaaagccacaaccctgtttttcttacagatggctgtttgtcttgtggcaggaaaaaccccgtgtccttccaccctctctttgagggggggctctgtcagacatgccgggtaagtcctcctactactgccctggaccttcctccccttgcctcctctaactcccctctccttcccaacagcacctgtgtggagactcagtgaagcccactcatcccagctgccttgcactctgcctctggggcaggatgggggacagctgtcacagaggccaatggcacgcaggtcacagccagttgtccttttaaaggacaccaagccaccagcagtgtgttctgcagctgtatcctagggcctccaccagcaagccggcagggcctgcccttctctggtctccgatttcactggtgtttctctctggctgccaggatcgcttccttgagctgttttacatgtatgatgacgatggctatcagtcttactgcactgtgtgctgcgagggccgagagctgctgctttgcagcaacacgagctgctgccggtgagcactgggccctgtggggtggatgtgggtgggcccccaaggctcctacgttcctgcagtctgcagacagctgtctgttgaatggaatcctaggcatgggaatagggagctaatttgccctggaagcagcacacagggtttatattttgtggtggctgtggttgtagcataattggagtagaactcatgtatagggaacggctcttttttttgagacagggtctccctgtgttgcccagggtgtacagtgacatgatcataggtcactgcagcctccaattcctgtgctcaagcaatcctcccacctcagcctcctgaacagcttgattataggcacatgccatcacacccagctagttattcttttttttttttgaggtggagtcttgctctgtcacccaggctggaatgcagtggcacaatcttggctcactgcaacctctgcctccagggtacaagcaattctcgtgcctcagcctcccaagtagctggaattataagtgcggagcaccacgcccagataatttttgtgtttttagtacagacagggtttcaccatgttgaccaggcttgtctcgaactcctgacctcaggtgatccacctgccccagcctctcaaatcccagcactcccaaagttctgggattacagtcatgatccaccgtgcctggcctattttttgtaataaataaaaagtgtaataaacgctgcctcggctggtctcaaatccctggggtcaagccattctcctacctcagcctcccaaagccccagagttgtaggtgtgagccaccacacccagctagaagtgctcttaataggccaagagcatgagggaaggggatgagtagggtgtcagggaaggctaattccctggtttgccagttggcctgtaatccaaagtgtccatggaatgaagtaggttgtcgggagagcatttctgatcagagagcctgtgggattaagggggttggggcatccaaggaagacgtcagggaagcccgtactgcacagggccccgcaggctatgctgttaagcagccgatcctaggtaagctttcaggagggggttggcatttccctgtggaagtggtaagggggtggcacaggagaccagctctgacaaaggcatcccttctccctgccactgggtccaggtgtttctgtgtggagtgcctggaggtgctggtgggcacaggcacagcggccgaggccaagcttcaggagccctggagctgttacatgtgtctcccgcagcgctgtcatggcgtcctgcggcgccggaaggactggaacgtgcgcctgcaggccttcttcaccagtgacacggggcttgaatatgtaagccacaggctcccgcctctaccaccacagatcccaggggcacagggtgttggaaagctctggaattctcagaaagagtaatagaagtaaagacacgttgtacctcttggagcctcaatggctgagagacctggcgaattgccagctcctctgcacggttttcagccgtgccagggttcattcactccctccttgccggcttctcagcgtatggattttcaggggcctgatgaagaaatggttgtatgtagccttctgagttagcagagctgagagggaaggaaacagtagaaatgaattttctagttcttagagggaagccctaggtcattcctgtctggggtgataccttttcatgtgtgcctctgtgcatacatatctggctcatgtccaaggataaattgaccattccttgccaaatgcaggctcgtgtggtacacacttgtctccccaatccccatcaagccttcagtgggctttttgcagtggctacggcaaggtttgaagccctctgagcagggtcagcctgcccctccctcagagcttgagtctttgccctgtgccttcaccaccatgacctccttccttacctggcaggaagcccccaagctgtaccctgccattcccgcagcccgaaggcggcccattcgagtcctgtcattgtttgatggcatcgcgacaggtgagttcggggaacacctggagacactgctatcgtgtcacaacagggtagccagggagtcagaaggcatggttaaggtgtctgacatcagtggcaagaaaggtccctggggattaccagccctgaaaaaaaccctgtctccttgtttctctccaccttctcaaccaccttgcagtcttggtcattgagttttatttatttattttttcgagatggagtctccctttgtcacccaggttagagtgcaatggcgtgatctgtgctcactgcagcccccatctccgaggttcaagtgattctctcctcagcctcccaagtagctgggattacaggtgctcaccaccacgcccagctaatttttatatttttcgtagagacggggtttctccacgttggtcaggttggtctcgaattcctgacctcaagtgatctgcccaccttggcatcccaaaccgctgggattagagacatgaaccaccgtgcctgggcagtcttggtcattttaaaaggacatacatcttagctgttacactttattttttatgtgcagttatcttgaacttgattttcattccacatgcataagtataattggagataaactagttaacaactactgctacctctggttttggttcccttcttttcctcctatatggagtttacacagccaatatgtgtggtgcgtgtacagcctttgctggattgaacgcatgtgatacagtcatgaggaactgttcattttaccatagcagggagtggaggaaatgagctgctgtgtgctcagcatcatttatgcttctgtgtctctctggcccccacaggctacctagtcctcaaagagttgggcataaaggtaggaaagtacgtcgcttctgaagtgtgtgaggagtccattgctgttggaaccgtgaagcacgaggggaatatcaaatacgtgaacgacgtgaggaacatcacaaagaaaaatgtgagggcagtctgtaccttgcgggcctcatctcttcctgtctttttccccagtcctccacaccctgaaacccacatgtaggccccatccctgagaccccagaaaaaaggattgaaatcctgtgggaatcttaagcattaggttagggtcagaagtggagttggtgaccaagcaagattctatttttttctggagacagtctccctctggagtgcagtggcatgatctcagctcactgtaacctctgcctcccgggtttaagcgattctcttgcctcagcctcccaaagtgctgggattacaggcacctgccaccatgctgggctaatttttatatttctagtagagttggggtttctccatgttggccaagctggtctcgaactcctgacctcaggtaatccacccccgccgtcagccttcctgggattacaggtgtgagccacctcgtccagccccacgcaagattctagaagtgggtccagctctctttccctctgtccacaccctcatcctgactctgtctctctctttcagattgaagaatggggcccatttgacttggtgattggcggaagcccatgcaacgatctctcaaatgtgaatccagccaggaaaggcctgtatggtgagcatccttctctctggcagtccctggagagcctatgtcacctgaccactggcccaggtgcagcagcctgagaaggagccacttgcttctggccaagttactggcagcatcaggggcctgttggtgctgcctacgctccatagtaaatcctcagcccacaagggaaataccctagtaaatagtgccctgctgctgcctgtgtccctgctgtcattcaggtggacatagactggtaggcatcaccctgaactgtcaggaggccattgggaacctgctggtctcagggaataaggtgggttgggctggaggtttcaaatgaaccctgcgctgtcatcttttctgagcacagagggtacaggccggctcttcttcgaattttaccacctgctgaattactcacgccccaaggagggtgatgaccggccgttcttctggatgtttgagaatgttgtagccatgaaggttggcgacaagagggacatctcacggttcctggaggtgagggaatctggggacctgattgtcacagacagccagggcagggaaagcgctgctggcagtgatgattggtgggtgttgccaacattgggaatgactttcccgttcttggtctggctagatccaatagtgagggattcagtgggttctcttagtacatggaaaatattttttttgagacagggtcttgctctgtcacccaggctgaagtacagtggcattattacagctcactggagcctcaaacagctgggctcaggcaatcctcctacctcagcctcccaaatggctgggactacaggggcacaccaccgtgcccagccaatttttgtatttttggtagagacagggtcttggtatgttgcacaccctagtcttgaactcctgggctcaagcaatccgcccacctcccaacgtgttgggattggagatagagatgtgagccaccatcccctgccagtacaaggaaaataattgatctctaatctcagcccaactctttgaagtcagaaatgatgaaacaaaccatcatctgctgttaaggactcatgagatttgactcaattttttactctagagagttttctcatttttgatatgaaaactgctttagaccaggcacagtggctcatgtctgcagtcctagcattttgggaggctgaggttggaggatcacttgagcccacggtgtatcatattttgtaataatctggcgtatcccaggggataccgtctcagaatctgcaggtttgaccttatctctttagctaccattagcatagtatgagggcatttaccatgtcctctagccagcctcctgatggcagtaggtctttcctgttttggaggatccgtgcctcatccatagtcagggaatagccctgtcacctgcaaaggtctggttgacactgaaactctaataataggctcctaacagtaaccttctttctccccacagtgtaatccagtgatgattgatgccatcaaagtttctgctgctcacagggcccgatacttctggggcaacctacccgggatgaacaggtaacaaagggctcttagtgggtcaggtaacagccaagttaaatatgtgataacaagctctgacattcaagccttcctagaaagacctggctctgctgagaaatagttatacttggatttcagaccacctgtggtcgtgcgggttgatctctgttaagatgttcagcaagtacctgggaatctctgtaggagtcccactcttacctgttgtaagctgctgatggacctgatcctaaaagtcccacgtggctgggtgtggtggctcacgcctgtaatcccagcactttgggaggccgaggctggaggatcgcttgagcccaggagttctagactagcctgggcaacaaagtgagaccccgtctctacaaaaaaataaagaaaaatacaagtctcatgagctgtggccagactgtgtacctccttcctgccagggatctctcaagacttgagcttgttgatgctcctgcccttcacctctcctccccgttgatgtagtgacagccgtctggaaatggaagtagattgttgttaccggtgcctttcctcctgccctggagatgaagcgatcttggccaggctcatggtgaccaaccaggtggcagagctgctatgacaaacaatagcccaaagactatgtccctcagattctcatcaccaggagcatttcatattttgttatcgtatactaaaaacagtcttcttcagacactctgaaagccacaaagcagctttgctgaggattaattatttcttctatatgtggtttcaaggagaagaacttgctaattaagatgtaaaatgttatggtaatgtgacatcccagacttgcaaatgagttgagcttaaaacattctcctgtagaaggaggcatggaaacataataaccttctgccacttagtgaagtgtggacagaggtgagggtcctggggtagcttggaggatttttgttggtcaccttgcccgtgtacttggctaagcagccagtcttagggtgccatgtctgtgtctggaattaaatgggttaatgctttcaacatttgaactcccagtaggccaggcactgttacgctgttgccattttcatggttaaacacatcatgtcgatagtgacatgccgaagggggagggagagaagacaatgatttggggtttattgctggcggatggacattggaagggttgatggggaaggcttctcattctagcgaaggtcctaagtgaagggatggacccatgcagttattagagtactccaggtgggaagagggtctgggatgatgggaaacatccccagaccagctcagagcaccctaggtggggtggctgggagagaaggaccaagtaacttgggccttaatgtggtaccgctgaaatcactttggcatgggaagttacagatgagatgaattgtgctttggttcatggtagtttctgggtggattatagacaataacaggatggaggcgggaatggggagacaagtgaagggactagactgctcaaagaaggagagatgactgattatgatgttatgccccaggaggtgccatccatagagaacacagtgtgagtggtggcccctggggtttgcagcacagcaatcctgtgacttagcaaggacggatcagattcaacatatgtggagggtaggacatttgctgatgcattggatgtgtaggctatgaggtggaaagagcagtgagacctgatgcagatctgatgctgtgactaagctctgcaggcttataggatgggtgtgtcaggcatcatttaggggacagacccaagtcatctggcttgtttagagcttaatcttatagtcagcacaaggcggggctgtgcagtgtccttttcttctgggccctcagctcccctgggtccatgtcggaggtaggaatggggatagaggtagcatttgaagcctggcaggtgaggtcaaggaaatctatcagtctaggggaaatatgtgttgtgatttcctcagcccctcttgtaggcacggttcccgttctcatgtctgagttgtttggccttgacgttcctaacacaggttactatggccgtccctgcgtccagtcctcttgcaccagtttctgttctggagctgctcaactactttcagttctagcccttgcccttcttagtcatctgtttgcctctctctgcatttgcaaaataattttcaagggtgaaagttaaaagggtgcttagtctttttttttttttttttttttggaaccttaagagacagggtctgtctcccaggctggagtgcagtgttgtaatcataactcactgtagcctccaactcctaggcttaagcgatcctcctgctttgaactcccaaattgctgggattaagggtaggaaccactgcaggcggttgccattcacttttaaagcctcctgaggctgtatccccagcagtgagccaccaaaccgtgggtgtgatatgataattgtatcaggtagacccacaaaaatctattccaagctcctcactttaaaatagacaggaagcccaaaggggtagtgtgactcgctcaagctcagtcagtgagcagtgtggagctgggacctgaggtttctcctgccctaccccatgcagtgttcctgctcaatgggaacctgactttgaagtccaggcaggggagcattacctcctggatgctgggctgtcccctctagcccatccttggctttggcacacaggcttgtgctcatgccaggatcattttcatcatttatttgtagccaagttcactgccagggcacatctctgcaacatagaccctcactcccaccttgtgcctagcagaggaccctctatagctagtaagaagtaatgggttttggctgttcccaggcccgtgatagcatcaaagaatgataaactcgagctgcaggactgcttggaatacaataggatagccaaggtaagacgagctgtggccctctggaaaaatgcacttggtgacctccaagtggggacttgggagatgaccttggtgtttgattggttcctactcctccccccacgtgacttcctggtgttgggcttccctctcccacatgattgttctgtcccatcctcaaatacagagactaggagacattcgtgataagtaatcacgacgagaaaaggcaactagtctttttaattttagtactggatacataaagacaaagagtttcagctggccctctcagggagaaaggaatcattaatccttttgccaaaaaattaatttgctgtcaagtcatagaatatgaagacctccataaacctaaatctcaatgtttgcatcaagctaagatccattttctaaactccaattgagcattctctgtatctgggtggtttttacttttttacttaatcttgcttgatcaggaactctggtgtcttcttggccccccacgtgatctcgttcatggtcacttttttgtttatctcattttctctgaggctggtccttcctgttaacgtcttggcatttgtgggaagcacaaaatgttcttgtctctccaactctgcttttcgctccctgccctgccattcctctcccgcgcctgccctctcccttccatctttcccaggtacttttctctcccagccctgccactcttctgccgcacctgcgctctcccctccatctttcccaggtacttttgagccttgactccccaggtcccttcattctgtgctcactccatgatgtcattttgttctccagttaaagaaagtacagacaataaccaccaagtcgaactcgatcaaacaggggaaaaaccaacttttccctgttgtcatgaatggcaaagaagatgttttgtggtgcactgagctcgaaaggtgagcaaggctgcacttggagagggaaactgtgtagatcaaaacacaaatgggcagacatgggcaggtgcttaccttcattcttgatggcctcactgccctttggtgttactggggcgaggagtaataataccttttcatagttcgcccttatttcctgacaaaaatggcggagggggtgtggtggtggtgaggaatctgagacatgaggtcattaggccacaccatctgtctgttggctgcactgccgtgacatctgcctgtcccaacatgctgggacactacgatgtgtgagaagccagtgaaagaaaaccccacagacatgccattcttgaagacttcagtttgctcattctataaatgattccttcttagccacagtttatcctctccttccctttctttgggctaagtttgtctgttttgatgcaaataaccatctcttggatttcagttctgttctgttctgttttctttcactcctctattgtttgttcattttgcttatactattttttaaaaatcattatttgctatagtgattatggctttgaacattcctctttacatgtattctgtattctgaaggctttgatatagagtattttcattccagatatttcacttctataactcatttaatttcttctttgacttaccaacagttttctgagtataaaagtaacttctgattagtatttatgctgtagattattctgtatggacctaaacctaaaatggttggtgcagatggctgacattgtgtagacgctaagaccaagcaagacacaggcctgaggtatcacatctttggcatgtttctgaataacccacgcagccattggcctgttgggatgacttttagtattggattgtatacctgagtaacactgaggctcagcctctgtagcctctttccaggcctggtagaatcctatagaggaagcttttggtatatttgatgccatctgcctggagtcatctagcatggtccttcatccggcagctgggtttgaagagggaaggaaaactctggttgcctgagcctgtgatgactgaaaatctaggctgtttttgagtgaccttgttccttattaaggaaattgcttaacttctcccatcatagtgttttgaaaatggatacattgctggctggctgatttagtatgcatgcatttattctaggaaggtcctctgagcaccaactctatgccaagagtatggtgctaggcctgcacaaaacgggggactttcatttgtgagcaatttgtaagcaagtgttctgaattaagggctctgaatttaggtccttggggaccttactgatgggactgagggatggcgagggcagaaagagtgggacctggctggttgaggctgtcaacatcctggaggcacttctgacttgctgtcttttcactccggtacccccaggatctttggctttcctgtgcactacacagacgtgtccaacatgggccgtggtgcccgccagaagctgctgggaaggtcctggagcgtgcctgtcatccgacacctcttcgcccctctgaaggactactttgcatgtgaatagttccagccaggccccaagcccactggggtgtgtggcagagccaggacccaggaggtgtgattcctgaaggcatccccaggccctgctcttcctcagctgtgtgggtcataccgtgtacctcagttccctcttgctcagtgggggcagagccacctgactcttgcaggggtagcctgaggtgccgcctccttgtgcacaaatcagacctggctgcttggagcagcctaacacggtgctcattttttcttctcctaaaactttaaaacttgaagtaggtagcaacgtggctttttttttttcccttcctgggtctaccactcagagaaacaatggctaagataccaaaaccacagtgccgacagctctccaatactcaggttaatgctgaaaaatcatccaagacagttattgcaagagtttaatttttgaaaactggctactgctctgtgtttacagacgtgtgcagttgtaggcatgtagctacaggacatttttaagggcccaggatcgttttttcccagggcaagcagaagagaaaatgttgtatatgtcttttacccggcacattccccttgcctaaatacaagggctggagtctgcacgggacctattagagtattttccacaatgatgatgatttcagcagggatgacgtcatcatcacattcagggctattttttcccccacaaacccaagggcaggggccactcttagctaaatccctccccgtgactgcaatagaaccctctggggagctcaggaaggggtgtgctgagttctataatataagctgccatatattttgtagacaagtatggctcctccatatctccctcttccctaggagaggagtgtgaagcaaggagcttagataagacaccccctcaaacccattccctctccaggagacctaccctccacaggcacaggtccccagatgagaagtctgctaccctcatttctcatctttttactaaactcagaggcagtgacagcagtcagggacagacatacatttctcataccttccccacatctgagagatgacagggaaaactgcaaagctcggtgctccctttggagattttttaatccttttttattccataagaagtcgtttttagggagaacgggaattcagacaagctgcatttcagaaatgctgtcataatggtttttaacaccttttactcttcttactggtgctattttgtagaataaggaacaacgttgacaagttttgtggggctttttatacactttttaaaatctcaaacttctatttttatgtttaacgttttcattaaaattttttttgtaactggagccacgacgtaacaaatatggggaaaaaactgtgccttgtttcaacagtttttgctaatttttaggctgaaagatgacggatgcctagagtttaccttatgtttaattaaaatcagtatttgtcta

SEQ ID NO: 1686 - DNA, 446136 bp, Homo sapiens
  source 1..446136: mol_type = genomic DNA
aggaaggaagtggggccctgcggcgcccagccaccccctgacggcttccccacgggaggacgcgaggccccggcccagccatggccccctggcgcaaagctgacaaggagcggcacggcgtgggtaggtgcgggccccagggcgcggcagggagcgggacaggtggcgggagagccgcgagcaggaggatgctgcggggccggcggcgcggggtgggcagggcgcgctgcctgcaggtcagagggcgcagcctgcggcggggcctcggggcgggaaagccgaggctcggggagaggacggcgggaccccaccccgcaggctaagcacagccctcgccctctcgcctgctgagggaaccttagacatttccgagatagggtcaagacctgcgcttgacaactcagttcttcgcgccaaactcggcgtccccaggagtgccccagctcgccgcgtgggagacttggccttgtagagggagctccactctcccctggctcagccttggcctgcccaccatgcatacttccaccccctccaaagcgacacccatttgcctgcttcccctgtctgttcctcctgggtcagatgactcctgatttggcagggcatccagagggcagctcaagcttgggggaatggggctggacggtggggttctctactcagccccccagagcctctggggaaaaaggctcccgccaggtggtcttagggtaaccaagaagctagcttcgtcagcctcagccatctaaactcccagaagcctctgcctggagctcaggggcggaagtggtggctgggggaagggaggcctcaggtgctgctactctaagtgtcatccgtggtgcaatctccatggactcactgtggtttttaaacttaaatatcaaataaaaagtcactctggagcttcctacacaggcggataccagacaccatctcagagataaatatttcgcaggtgaggcattggaagacccaaacacccagagggatttgatgcagggggtccccaggccactgtttgggaaacactgccctggagagatcagcagttatccactcaattactgggtaccgggcactgtggggtcattttgatataaatggtccccatccagagaacaaataataattcatatctcaaggggcagttacaaagtaaggaaggatacagcttctgcccttgaggagttatgtgtaaggctagaggcttggactgggaagtcagaactgagttcaaatcagggtctgtttcctcgtctataaagtggaagtaataataatgcaggtctcatgagactcttgtgaggattgaatggggttatgcatggaaagcatttagtagtgtgctggctcaataagagttagtgattcaggtccagggtcttacctagcagcttcagaaccaagagacaccagcaccaagatgcaccctaatgccagattcaggacagtcatgccttatgagactgtagtatttcatggtttgcaagaccaaaggtcatgcaatctctgtctgacttcagaacccccatgtgaggcagtgtattattcccaacttacaggtgaagtaaccaagtttacatcacttggaagcaatggagcgggccttaaattcaattgtcttcagaccctaggccctttgcatggcaccagaaaagcatctagaaggggaacatcatgggtaaaggcagggaactggcatccctgaagtgtgtgggtcaaacaataagtagtctgttttggttttagtattgcttttagtgttaaaaaaatttcagaggtagattatggctagattgtgaagggctttgagtgccaaccttcaaagtttggatttccttctctgagcactggaggttttgagcagtgtcatctggaagaagttaaatagttaattaggataggagtggggaattggacttagaatagaaggaaaatgggtaacagttttacctgtctgctgactgcctggttaatctagcaggaggtcacttataatcaacattgcctgttaacctttactaggttaatccactctgcctgaggctcttgtcagtgaagagagctttctccttgcaggagagaggaaagggcagaaaagaaggaggtagaaagagaaactaacagtatcagttagggttaagtgtgacaaagggtgacagaaaacctccaaaattgtggcctaaccaagctgcaagtttatttctgtctctcatggaaagctcagaaatggtctgggaagaggtggtaaggtggctcattctatatctcacactgtatccttggcatgtgacttctgcctcctgagccacataggctgcttaagcttcggtgatcaggtccaccttccagccagcaaaaaggatgcagggaaaaagaaggtcatggcttttccctttaaagacattttcctgaaggcacacttgacatttcttcttacattacatcctattggcaaaaatgtaatcacatgactgactatagctgcaagggaagctaggaaatgtagtctgtaatgtaggcagccatgtacccagctaaaaattaggagttctcttcataagtaaggagaggaggaagaatattgaggatgatatattagtttgctcaggctgctgtagcaaaataccaccaactgggtggcttaaacaacagaaatgtattttctcacagttctcgaggctggaagtctaagatcaaagcaccaccagggttggcttgtctcatggcctatctccatggtttgcagatggctgtcttgctgcctcttcattgctttctgtgcaggcacacccttgctgtctcttcctcctgtcatgagaacaccggtcatattggattagcatcccaccctaaaggactcattttaacttaataattcctttatctccgaatatgcacttatctccaaataggagtaccttctgagacactgatgactgggacttcagcataagaattttggtggggacacaaattcatgacaaataatctgtggtctctggcatggtattttgggactataaagagggcttcaaggcaggagtcctgagataaagggtgagggtagaaaagagttttgtttaccctgaagctgagcctgccaggcagatttgtgtgggactctagttattcttgtaggggagggaaaagcttctttctgctactgcatcttgggttttctgtaaattagactaacaaaagactgatgaacaagagaaaacaaacaagtttattagcatgtacatcctgcttacatatggagtactcaaagggttggtttgaacttgagcttatacagcatcttagcaaaggtacaataaaggtttagagaagtagcaagtcaaaggagggttttaggcctccaagggcagcaaactgtgggaagggaaatatatggggaatctaatggaagataaagggttatttgtgcaggttcatcttggagccaactttctgtcttcttcattgccataaaacttccctgggagaggggatttatgacagtccttatttcttaggagtttcttcagataaatatccaggaaagcttcttgctgtacctgttgattcttatttgcatccagctcaaaataatcaatatgccctatggaagtggcatattttgatcagaaacctgttctgtatgcagcttctctctagctatggttttacacccatgtgtggtgttgaggaatatttgttggtttcttctgagggctgagggaaaatctgttccaggtgtctcccccagctgccagtggtttgctggcaatcctcggcattccttggcttacaaaagcgttgccttgatcgctgcctccaacttcacgtggtattctcattgtgtgcgtgtctgtctccgcatttctccttttaaaaaggacatccagtcatattagattagggcccaccctagtgacttcagttaaatgtgattacctctgtaaagactgtctccaaataagatcacattctgaggtactgggagttgagactccaacgtctctttttttggagggggagggcacaattcaaaccataacaggctctgcagaagcagagaagggatctttttcacagcttggttggggaatatggaggaatccataaccagctcgtggttcagggatgtgggtgatgctgtcgcagcccaggaccctggacagagctgatccatgcacactgacagatttggcgtgggcaatgtgtgctggtgtcatttgcacatggatttttgttgaagggaacaaaatctagtcaaaccagttcaacgaaaatgtgtgtggtgtgtatctgtgggagagcagggagaagtggtgtattttagggtcagaggaatcacatggaaatccaggaaacaggaggagccaggcctcggaaagggcttgaactgaggcaaccctggaaacctctgcctctcctctcatggcttctcagcttctctgagcatgccaactgtggtctcctttctctccccaccacctccctctgattgcattgttccttcgtaactgatactctaataccacagtggtggccccagcatgcaacccacccatctctgcacaaccttgcagttcaagcatccactgaatcttctctgtgtttatttgttcaaagtcccaacagaagagagtggtagcttgatttccctttgtaagaaagacaacccaagtcagagttcattgccagcctaataatgggcctcactctggtgagggtgctgcccctggcaggtctaattctctgtgactatgaggtggggtcacatggcttgctactcctctagcaggagccatgggtggggactgattctttgagttggaagcatgagtggaaactgcatcccaaacatacccaggagcagaacttcactacagagggaccaattatactgcttttattgccaaatgcaacagttgaaaggatagagagcatcactcactcattaacttgtccatttgttcactcattcattcttcattaacttcttaaatatttgttgggtgtgtgtgccaggcattatgctagtcactgagattactagaattaggccaatatggcccctatccttctggagcctgtagtctaatagggaagatgaaaaagaatttcatgaataaatcagtaaccatataattacaaattgtgatatgtgctgttttaatatgagtgagaatattaggaatggtcttgaattagatgatgtgagaaggcctctcaggagcaatggggaaaagaatcccaaagccaatgcttggagggatattaatacatgcatctttgctacagtggctgactgtacctttggattggtccccagaaattagtctggtgaaacaaaaatacatggattagacatctaattccttcctgccaccaattcttaggtgccggggcttcctactttcagatgcttcagcaatttgggtctgtttaggagtgcctgctgggctggctgtttgagttcatgtaaggagattgtcctaatccgtagttatatgggcacctcattaggcagtggacatcttgcccctgaccataatgtttgcatttgaatgagccttgaagacagattgtgttttctaagctctgcttcctcctgagatcagcatcctattgctgctgtcttttgagagatgaaatgtagtcaccatactgctccgctaatttctggacctttggatttgttttttttttcaatagtcaattacacatgggtgccacagtctgtgctctgcagcatatgttctgcaaatggggaatgacagtgcttatcaccacgcaactccagaggagtctgggcggagacaccacaaatgttccctttaataggcactttctcctttcttcccccttcccttaattggtgtgaattgaaaaacagtcaggctgagtttgtgagctgcttaagtcttattctgttgttagttctccttggagaaagtcattccttgtctccctgcaccccaccaggtcagcttctgctttggtttaaagtcatggtggcagaaactgaggctggagaaagtatgaccgccaatgtggacactttccagagccctctccgttcatcactctagggcagtggtctgcaaccttttcagcaccagggctggtttggtggaagacaatttttccacagactgatggggaggtggggcggggcgggagggatggtttcgggatgaagctgttccacttcagatcatgaggcattaattagattctcataaggagcatacaacccagatccctcgcgtgtgcaggtcacaatagggttcctgctcctgtgagaatcgaatgcccctgctgatctgacaggaggcagagctcaggctaatgctggattgcctgctgctcacctcctgctctgcagcccggttcctaacaggccaccaaccagtaccggtcggtggcctggggagttggggacccctgttctagggcactcagttcccctgactgcacacggccccttggatcacagcctaagctaagatgatggttggagacataggtggacagtatgacgtgcacactgtcacggcacagggtctgaatggggtaataggcatttgtttggttgaattaaatggtgcaatgccaggcctagagacaccctgactgacatggtgggctgcagcagcagggccatcccagtgtcagctgaaccttgagggtttgcctggaaagtgggtttttgctgctggcttccctggcggtggcagtcagggaaggacccttctaagtagaacgaatagccaatataaagaggaggaagcctctctgatgtgtgggaggccagtgtggctgcagtagagtaagcaagatgcaaagcagtaaggaatggattctctgagagaggtcatagggagcagtgcctcgtaggtattgtgaggtccttggcttttactctgaatgggggagggggacattgcaggatttggagtagaattgtaggacgacctgtcttaagttttaagaggattgaacatagcagttttatggtgcattaatcagggggaattaaatgtggaaggagagggaccagttaggcagcaacagtgataactcaggccaagagatggcggtggcttgcagcaggagggagcagtggagacagtgagatatgcttagattcgggatgtatgtgttgtaggtcaagcaaatggggttttcctcttggaatggatgtgggtatgagaaggagagaggagccagtggtgactccgaggtttctggtctgaatagctagaagaatgagggctgcatcgaggccttccctagtgaaaaccttgatctaagtagtcatcgacattggcataaatcatgccattgccttaccttttgtaccacggtacttttttttttttttttaattttactgacagttctgggatacaagtgcagaacatgcaggtttgttacgtaggtatacatgtgccatggtggtttgctgcacctatcttcccgtcatctaggttttaagccccatatgcattagctatttgtcctaatgctctcccttccttgcaactcccccaccccctgacaggccccagtgtgtgatgtttctctccccgtggccatatgttctcattgttcaactcccacttatgagtgagaacaggcagtgtttggttttctgttcctgtgttagtttgctgagaatgatggcttccagctttatccctgtccctgcaaaggacatgatctcatttctttttatggctgcatagtattccatggtatatatgttgacattttctttatccaatctatcattgatgggcatttgggttggttccaagtgtttgttgttgtaaatagtgctgcgataaacatacgtgtgcatatgtctttatagtagaatgatttctattcctttgggtatatacctagtaatgggattgctgggccaaatggtatttctcgttctagatccttgaggaattgttttccacaatagttgaactaatttacattcccaccaacagtgtaaaagtattcttatttctccacagcctcaccagcatctatagtttcttgactttttagtaatcgccattctgactggcatgagatggtatctcattgtgcatttctcagatgatcagtggtgttgagcgttttttcatgtttgttggccacataaatgtcttctttctagaagtgtctgtttatatcctttgtccacattttgatggggttgtttgtttcttgtaaatttgtttaagtttcttatagattctggatattagccctttgtcagatgagtagattgcaaaaattttctcccattctgtaggttgcctgttcactttgatgatagtttcttttgctgtgcagaaactcttcagtttaattagatcccatttgttaattttggtttttgctgcaattgcttttggtgtttttgtcatgaagtctttgcccatgcatatgtcctgattggtattgcctaggttttcttctagggttttaaatttttatttatttatttttttgagacagagtctcactctgtctccctggctggagtgcagcggagcaatctcggctcactgcaagctccacctcctgggttcacgccattctcctgcctcagcctcccgagtagctgggactacacaggagcccaccaccacgcccggctaattttttgtatttttagtagagacggggtttcaccgtgttagccaggaaggtctcgatctcctgacctcatgatccgcccatctcagcctcccaaagtgctgggattacaggcatgagccaccacgcccagcctcttctagggtttttatggtttgggattttacatttaagtttgtaatccatcttgagttaattttcgtgtaagatataaggaaggggtccagtttcagttttccacatatggctggccagttttcccagcaccatttattaaataggagatccttattccattgcttctttttgtcaggtttgtcgaagatcaggtggttgtagatgcgtggtgttatttctgaggtctctgttctgttccattggtctatatatctgtttgagtaccagtcccatagcatggtacatttacaaagcccttgtgtcatcatgtttagccctcacagacaccctaagaaaaataacttctgtcttcattttgcaggtgaggaaactgaggcatagatctttgaggtctctctgaaaattccctctattttatggaagttgccccttttcaccttgtcttttagttaggtaactgcatgtcatcttccccactagctggtacattgttggagggcagagctgtatggagggttaactttgagtccattcagcatcactgcaatagcaggaacgtggtaggtcagagaaactaatcattattgtagcataggtcccattgagaatcctgtgaccgctagaaacacacttcttcccattaaaatatgcacatgtgcagttctgcattgtaatgtcgccaaaactcattcatggaagccagttaaggtccctggcaaaatgtgcttattttactctgtaactatttagtaaacaaatacaataggtatagccaaagcattctgcctaaggtttgaattcttgaagccaggagcttgtcaagagtcggaaaacaattcttacagtctgttcagatcaattaagttcagtaagcctgtcctgagtgatggtccttagctgggtgtttgggcccagagatgaataaaacagttcgggaagcttacagtccagtcataacctctctttctgtatgaggcagcagagagcaccattattagtactaatgtccccattggacaggttgggggcagtgccccctttgcttcatgttactagagctgccatcatccccttcatacttccttgcagcctcatgttgaatgatctgggcacctctgtagaatgcaagctctatgatggcagggccatgtctgttgttcttcttcagcacagagcaggtgctcagcggctgctgattggatggatgaagaggtggattcataggtggatggatagttgttgattagatggatgggtgggtagatggatgatagatgggtgagtggatgcatggatgggtgggtgggtagatgagtggagggggaggaggatgggtaaagggtaagagttggaggttttaaaattttctggtggccttataggattcagatggactgagttgccccatcttgcctttatcttcccacctcatccatttccctgtcaggaggcgaggtcctgtgagagcacagcacagcaataaatagagtactcttgaactcgtctccaaacagtggactcctgcagatggtcactctaccaagctcaccagttctccctgggactccattaagatggccctgccattcatccctcacacatcaagctggtttcccccctctcttccctgctgtcacaccctctccccacctccttgggggctctcagtccagttcttccccttgccagtctctgcccctccctctccctccagtctcacttccttagtggggcctctttttccctctgagagtccacagctgctgtgacttgcagtttagcctttcacttctgaagacagctctttgtttcttgtgtgtttattttgtctcttcgactagatttcacagaagctcaggagagcaggagccaccccctttcaccccacttttctagctgcaggatcctgcagagtgccagacgctctctgcatttggggctggagggctgatttgattgatttcaccataaactctcttccaactctgtagtgtgtgtgtgcatgtgtgagtgcaagagtgtgtgagaatgtgtgtgtgaatgtgcctataggagtactagaatggagagagtgaaatccagcatgatgtttcagagcagggtttatcaaccttgtcactattgacattgtgggccaggaaaatctttgttatggggctgtcctgtgcactgtaggatgtttagcagcatctctggcctctagtcactagaggctagtagcactgacacccccgactcccctcccccaggttgggacaagaaaaatgtctccagacatcaacaaatgtctcttctagtggggcaaattcgctcccagttgagatcactgtttgagagaattcactggaatcctaactttcgtcttgtcggctgggcatgtcactggctcgctaaaaactgtgcgctacaatatgcagcccataaggttgttatcatgatccagcaagaggcctaaagcacctggcacagtgctgggaccaaatgcatctccactcgtgagaggcgatgtgagtgtggtgcatggctgagagagtgtgctccggagccagcctgtctggggtgaaatcctcacttggccccttctttgctgtgttcaccccaggatgtttacttgatcttgcactacctcagtttcctcatctgtaaaacagagacgataataatcacacccaccccaagaactgcagattcacgatgaaatgggtggctgtgcgtaaagcccttggaatagtgtctggtatgcaggaagtgtttggcagaggttagctgttcttctgctctctgctctctcctggtgggtggaggaacacctcctccttctaggttccctctggctgtaattcttctgcctcatttgctgctgactagcgcccgcccgggtttgagctctggggtggctgccagaggcttctgctgggtcatcgcagtcaccctcgtggatgcaatgtcaggatgctgcctcagtgcggaggctgtcaacacctgtccagagacttcaggcacactgcttacgcatttcgatgagcgcatttcacttgaatccaccaaagtggacctgctgctagttctatttccccctggagtggagactctccaaagtgagcttcgggcaattacattctttctccattattgcttttgttcctcttacacagccacttgtccaaactctattaacacttggtgttggctgaagcttgtgttttcaaacatgtcagcagatggcagggccccagatgaggtacgaatccatcttgaagggtcacagggcactcgatggctgcaatcaaaattggcagccaagacgtgtcttttgaagcaatcttgataaatgcaagaaagaatatagccagaagaagggacatagctgcccttcatgttcattcacatcccttccgtccaatgagcatttcttaaaagttcaataaacattgattgcacttctactgtgggccaggcgctaggaattcagtggtcaacaagataggctcagtctccatccttactgaggctggatgtaacgaggatataaacaagcccagtgtatgtgtaatagagtgtgatgcctggtgaggaagcagggactctggactccactctaggtttgaatccgctttctgccactttctgtgtggctatgagcaagttccttaacatctctttgagtttcttgtatgttacaggaagagtaataacttgaggttactatgaagattaaatgggctgatacaagtaaagtgctagggatttttttttctttctttttttttttgccggcgtcttgctctgtcacccgggctggagtgcagtggtgtaatctcggctgactgcaacctctgcctcccaggttcaagcaattctcctgcctcagtcccccgagtagctgggactacaggtgtaccccaccacacttggttaatttttgtatttttagtacagtcggggtttcaccatgttggccaggctggtctcaaactcctgacctcaagtgatccacctgcctcccctagtgttgggattacaggcgtgagccgccgcacctggcagtgctggggattttgtctgtcttatctatcactgtgactatagtactcagagcaatatctagcacccagtaggtactacatactgtgtctacagtagttaggacagtatctagcacacactagatgttcacatggatatctgttgaaaacaccatggagtatatacttggcatttaaaatgtgctctaaatatttaccattttcttaggaaacagggtgtgcagtagttagaatttagactccgagatctatctatatatcttattaggtggagaagttgtttacccaccccttcctcagtttccttatatataaatcaaagagaaacattgaacttatctcctaaaattgcacaaagcacagagacccttctttagttgtttttgtgagccactgtgctagaacaatggtgtttactttcaccttagctccctctatttgaactcctgatgaatagagtacttcaatatgtttaggtggaattggtagctaatcagtggattcgatttccagggttgctagaagttccatctgcctcaaaatagcagtccggtggcttgccaacctgggatttccaatgtgagtccttgctggagtcagtgacccaagatggctccatacttgggaacatccctttgatccttggccataaatgctttgttctgggtgggcttgtcaggataccagtttctgttttggttcctatgtatggtgctttggtacaaggagaggtcaagtctttcctagggaatgtgtcagtattccccagggcttggcgacctggcacgatggggaagctggaatgagtatttgcgggaatggccgagggcctgagggctgtgggtaggcttccctgatttgtctatcttttgtggacaggcactgggcagggtggagcaggctatgatttcttcctcttgtttttctgcctttttcatcccttgttcaaaagttgagagtggttaggcccatcttagactggtcagaagcaaactgaaggacagagataagccatcaaacgtagcagaggggaattctggcttggagcttcctgttagtcatctagaagactaaacagaattgggtattcataggcaaagccacttcctttgtcagtcatgtctgcttttcttcaaatggagccttaagaggcccttatgcaaaggcagaaatagatttataaattaagtgccaaagtcagttactttcatttttgtaatcagtgagtacttggaatgaatacggatcttcactttgaatacccagtttcaagatctgtccaggacatcttaagccaatctactggcaccttctcacctgacattgctgggcagaggatgagggaagattcccgaggaaagcagggaggagctggtcacggagtaacacacggtcctgccccacctccacatatctgatggacacccctgatttgctcgtgctccagagactaacacacattgtgcctggttttcttctgttggaagcctcagttgcttccaccatcctgtccagttctactgccaagtcctcaggcagaccacttgggctgaaagagcagggagcagagtctacccagtgaggacaccagcaaactggagtatgtccaagcaacagcagcctatgaggggaagggggttgaaatcaggccaagtgcggagggaatgaagaaacaggctgcgtttatgcaggaggagagaagcctcagcatcccccgagggccctctctagatttgcttttggacaaaggattaatttgattaagtgttggtcgacagagcagttggttgcaaagtgcaggaaaggagatttaaaggctacacaaagctctggaggagtgagccttgttcaggagataatataatgctaataaaaagaaaagtgactacatttactgagcacttactatagctggacattaagtcaagtcgtgtatgggcattaatttcagctgagcctcccaggaacccagtaaggtagggaccattatttcttgcattctacagtcagaggaactgaggcttagggagattcagccacttgctcaagcaggctgcccctggctcctacagtgcctttgtgtggattacaaaaagatatccttcctctggtgggcacagtgccagggcagggtgcaagccttggcaagcagatcgcaggttgggtgccagccttcactgctctcttggctgggtggccttgtgcagggcacagcctgggcagttgtacactgcagccctaggcttgaggccagagccaggaaaagacagaactggcctcaaaagccacatctgtctgactccagagacaactagctcttaactcctaagctttatcatctctcaggatggagacttcatctctctgaatgcacacaaaagggaggttagggatatggggcacacctgggagtagaggggacagcctgtgctccgttccactgaagcatcctaaaaaccctgcgagataggtactgttaacatccccattgtaagaaagtgaggcagagaggtgaagtcacttgcccaagatcacacagtagtgagtggcagagctggggttccttctgaaccactctggtcttttaatgtggtttaggcagacgtgttggggtgattggaccaggggaaggaggaaggagggaagagagagggaaggaagggaaggagataagtgggaagaggcagagatgaatgagagttagagactggcggtggtctctgtgatgcaaaagaatctgcacagaacccagtggcatttcacccagcttctgcataggggttagacacagagcagcattggctatttagaccctggtcacttaatggatcagcctacggtccgtatcctcaaaggtaaaaggaggtaattatgaagaggtgtacctgtagagtagaggagtaggaaagagcatgggcctgtactcccagttccagcattgtatgaccttgggcaaggcaagtaacctctctctgtctgagtttctgtatctgaaatttggaaataataagacttctcacttgcaaggagtgttgtgagaattaaaggagtaaatgcacatggagaacttagaatcatgtctgggatataagtgattgctacacattcgttcttattaggatccacactgataagccacttccagaaaagtggggcctgcctacgtttagttcctctttaggaataataacctttttacagtggtatcttcttatcttagctccccacccaacattgtggggtgggtaagagtggcacaataatgcctactttaaaagtggggaaacggattcagagggaaagtgagtctgttttgtagctgtcaccagctagagcgggtttggaggagtctggagacgtagctactgcctgttgtgtgggcagcagcagggccaagggcgtcatgaaggactggagctcacaccggggccttcctcctggtaaatctcctacacaggttccttcccttgcgtagccctctccattgtcccaatggtgctgtgctggtcggggaggagcatgggcccagctcagctggccctgcctgcaggaagcctcctgtggcccccatgcatggctccagcatgttatctcctgtgctctcaaagcacctgtacctcctgagcccagaccatccatcaggtcattgcaggtggacctgtcagcttctcccattagaatacaaggccctggctgtctaattctaccatttggttactggttatggagcattacaacatggcaggctcttcacacactgggactgtctttctttctcataataatttgccatagatccctggggtgcctgagctgggactcaaccccaggcctggctgaaggaggggctcagggtctcagaggccacagctgcctggctctcctgctatcctgctcaccagtgcatctctcctacctggtatagcacctcaccacacttcaggtgcttagtatgcagttgtttctttttaattgtagcaaaacatgcataacaaatgatgtaacattttaactgcctggtgtacagtaagaggacagtccatagtaaatagcagcctccttgtcactcaggctcaatgcagggcctgtgttgaggaaaggtcaactttggttaatagaaggtcttgggagccaggctgagtctgaaataactcttgtggcaggcaataggtttctgtgttggttttgtttagcccaggtgggctgcgtgggcatgggatggacttgaggcagggaaagcaggaaggagcagagactaatgagatctagaggtctcacctagctgtctttctttctgtttcacagccatatacaacttccaaggcagcggagccccccagctctccctgcagatcggcgatgtggtgcgaatacaggagacgtgtggaggtgagtcactggcccacgccccaagtgctggacccttggctgatggaagcctatagtacacccaggcccctcagcgctgtctctgaacctgcaactgtgtggtctatttaaaaacgttttggtaacgctagtaattagaatttactaaacagaaatgctttctcattttaggaatgtatgtttcatagcaaaagcctaactgggtggttcgatgtttgttatgctctccatttgcttcagccatggggctattcagcctgtgactcttcctagatacagttctttattagtattaatatcacgataaagggaaataagcatcattagggtttggaagggtcccataaatcacacctctaattccaggagagccgatgtgcacagttgtgttgtttgtttactgcatgaaggcacccagcccagggagcaggagctcactcccctccccaagctgggagccctgtcttgggcaatgtggtggcatctctttctttctcctacaaagatgccattgccttgtgaagccaggtgtctactgggctgcgtccacccatggtggtgtgcttgtagggagtgctttttaaaatttgcacaaagatgaatggccttggactcataagtcaggcagttggaaatcaacatgtcattgataaacttgatattgggagcatggcttgggcatgagaaccaaatgagctgctgatctgttacctgcagtcaggcaggctcccacccctcactggcccaactggcctaccacagttccctcctacctgggcctgctgatacctcctgctgcatggagggcacagagcctgggcttcctgtgtctcggcagagtggtagaggaagaagagagagtgtattgagcacataggcctgttctgcccccagtgaatccattagaggaggccctggggagggagtgacggtcagggaggaggcaggtgtgccactgtgaaggagtcctttcatggggaaaggcggtcacctgcaggagtagccatctttggtcctttccacaaaatagacactgtgctaagttctttataacacatgatcctagtcactcctcaccacaacccacaggacaggcagtgtcatttccagtgctggattagctacatgcaacctcttaggcaacagagcccctagctgggtctgcagatttgtacaaggatgcttgtgtaaacacatacacacacacagacacacacaaagacacacacaaacatacatatgtacatatatacacatatgcatacctgtgcatgtagatacaaccaaaaaacatacagaaaaccattttgtgggcaaataatttgaaatttgatatgtcaagacaactttaaaaggggtcatgggggaaatgagaactttgttcatcttccttatatttattttatgctttagtattatttttacttggggttgtagatgaggggataccgtacacttttcagtgtccagggcctgcaaagttcacactccggccctgttgaaaccttttacgcaaggagtggacaaggctggaggagaggggtggagacgctgtcctagagaattgaattgggtctgtgattccacgcacgctgccccctgctcacagcataaccctatcttttacaaatctagttctgcccagtggcagataagcaaactgtaggtgactaccaaaggcaaagaatgaaaataaaaacagcagcaactctcctcagtgcctctttcatgctactggatgctaatcctgagaaacaggcacgagacctcacatttgcagatgaggaaatggaggcagtgaaatgactcatctaaggttgcacagtgagctagtggatttttttttttttttttaagacggactcttgcttttgtctcccaagctggagtgcagtgatgcgatctcggctcactgcagcctccgcctcccagattcaactgattcttgcgcctcagcctcattcgtagctgggattaccagcatgtgccaccacgcctgtattttcaatagagacggggtttcgccatgttggccaggctggtctcaaacacctggccctaggtgattcgtgcacctcggcctcccaaagtgctgggatgacaggggtgagccaccgcacctggccccagtggctcttttctgatagccaagcccacactctttcctccacccatgcctgccaaaacaatgacaaggccttggtcattattttctgtgtcctacattgtgaaatccagatgagtatttttctcttcgttgtatgcagtttccctgaatagaaagcttgagggaataaacctcccacacaggctgccatagtcagagccttgccagtacctttccctggcctggtgccctgacctttacgaaggctactctggtggactcaagccacctttattcatctctgggacacctttatcctttctttggttctggttttccatttctaattcaattagtcttattttaatgtatctttgtaaattagtcacaataacttgctggaaaaagctggatatattcattggtaaatggctaataatttattaattatttgaaaagacagtgtttggaagtctgctagaatgattctagctatctgaggaaatatcatatctcctggtacgcaaatcattaggacttctcatgcatacactcatggccatgcagagttttcaaataggggatccaaagtcttcttggggtgccttgagtggcagaaggtaatggagctggagggggtctgagagcaggtctggtgttgtctgccttcagatggggtgtatggtctgtgattctgattgaaaaaaaaagattcctctaaaaatataaaaggtgtgaaaaccacaatgttagtcaaaaattagtcaaaactgtgtagtagaaagaatatgggtgtacccgtgaaaccttcttacagaaaactacttcaaaaccaaaatccagccaactgagaggtgaatcacaatacaagaatattggattaaaaatctgtgataaaaggaaatagtggctaatattgggtccaaatgaatcgatttataaaaattgatattaaaaacagtaggaatttcttgtagaagggacaaacataaaaaagcagtgtgatttttttcctccaaccacttccttcagtcatatttggttgacatctttcctgagatttggtggcatcagaagactttatttaatcttatatccatgtgctgctcacccacttcttccctttcacccattcaaacaagacctggggaaggagtgagtttgggatgttttctttcctattctttgtcttctctactgaaataagcctaatgattggccagtccactgtacaaatagtcatgtagttgaggaatgaaatgccagatgcccctgacatcatgatttttatggctaccataaagaatgttattgttgggaacctagacaatattttaaaaaatctaataaagttgagacttgggaggagaatggaagataatagctaactcaatgacatcactttcacaacaaagtcaatgaatattaattggaaataaaacatggaattaaaaaaaataaccacgtctatctttgaatgcttttcataacaattttcattttagagaagttttcaggaaatctttttagtgataaagaaacattgaatcaaagttcaaatgtccctcaatttcacttggtttctttttcttctgctaaatacaaataagattaaataaaatttttatttatatcccagcactttgggaggcagaggcgggtggatcatgaggtcaggagatcgagaccctcctggctaacatggtgaaaccccatctctactaaaaatacaaaaaattagccgggcgtggtggcaggtgcctgtagtcccagctactcaggaggctgaggcaggagaattgcgtgaacctgggaggcggagcttgcagtaagccaagatcgcaccactgcactccagcctgggagacagagcaagcctccgtctcaaaaaaaaaaaaaaaaaaaaaatgtatttatatagtatcttcaccatatgctcatttttatgagagtattttaaaaaccatattttatctttttatctctctgtcattctatgtatataaatataaacgaagagttgactggaatgatattaatagtgtttttctgtgtaatgggattcaggataattctttaagcttatatgtttgtacttttctgtttagtttaaattctttataatagcatatattagttttaaacaaacaaaaaaaaatacagtctttaagttgggcatgatggtgtgtacctatagtcctagctacctgggaggctgaggcaggaggatcccttgagcccaggagtttaagactaacaagactccatctctgaaaaataaggcaaaaaaagtatgaagaataaaataacaatcacttacattccaaccacctataattaatcattgccaacacctgaggatatttgcttccaatctacaagactgcattattattattattattattattattattattattattattattattattattgagatgggggtttctctttgttgcccagtctggtctccaactccagggcccaagcagtcctcctgcctcagccttccaagtacctgggattacagatgcatgccaccttgccgggctttcaatagttttaaaatcttccccaccacccccaataaagaagtgaaaagagcactggcttttgaattagaaagttattccctgcttctgctacccactagtggagtcatcttgggtatgtaagctttaggtttctcatctgttaagtgggttgttttcaccttgctcctgagcttcttatggggataaaatgagaaaaagtaaagaagctgtctaccaccagcctggctcatagaaggttctctgtgtttgttaattccatcctctcccctattatgtagtgctgtactgaaactggcagatgtatatttttacaacatggcccagaagctgaatcttttcctggaatgggtgagactagcccttccttgcctatgtactaaatttactcagctgaatgaagagggaaaacaggaccctaaactggaagcttaaacaagggtgaatttcactttttattataaggataatatattgttatgataaaaactcacatagttcaagatggtactcatgctaggccatgctaagccttagacatcaaatgctgacttcattgcccatattatatctctcatgctgcctcttttatccagaggcggcataaacattctgtgttttagatgtggaaaacacaggtaagtgtattgagcagtaggaattcatcatagaagggacaaacacaaaaaaaagcagtgttattttatttccccccagtcacttcctccagtcatatttgattgacatctttcctgatatttgatgacatcagaagacttcaatctcatatattgtgcagctcacctacttcttctgtttccccagtttgaacaagacctggggaaggagggagtttggggtgctttctttccagttctttgtcttctctactgaaataagccctctatgatcagcttgtccattgtagaaatagccaggtagctggggaatgagatgccagatgcccctgacatctttgtgtgaagctcctggaatgcactcatactgtgtttggatgtagttttggggtggaggaactgtatcatgccctcctaaggcaacaacttcctacctccaaaggctgacgtgagagaattgcttgagcccaggagttcgaggctgcagtgaggcatgatcatgccactgcactccagactcagaggcagagtgagatcttctctctaaaaataaataaataaacaaacaaataaaatcagaggaatgagggaggagatggatagagcatcctctgctttgaaaaaatagcgcattgcttttgttgttgctgttttctagaaatgcaactacatactctatgtactattctgagaccttctgttctcatttgaaaatattggagtgctttctaagtgaacacatatctattaccacattgttggtttggctgcaaaagcttggcacaaggagattttgaatgtacccctcactgaggagggcacaccaagagccataggcagtggcttccatgctaataactcctttgagggtgatcttgacctatccaaattctttgcttttaatataagtgaggacattataagcacttaacatggaatctttttaaagcaccaccttgcaaggtgatagtcttttgttcaggtctgctgtagtgacaggtcactttgaaaaggactccattttcttcagtaaggctgctccattatcagcagtgtgtatgtgaagttttcctcccttctgagtgaggatgaggctcagacgtcagtaaacttccattatgtttcatttgcggcatgtctatttgctttgttgtgatggaaatatgttgaaatgactttagtgcaaaaaaaaaatgatattataaatccataggtcctgaaaataaaatagaaaatatgcccaactttctctgcattattattattttaattgatttttttagaagaatggtatctactaactcttttggacactggacaaactctctgagtttttaatccaatttaagcctgataagacactattattattcccatgagatgtgaggcactattattctcattttatagatgaggggactgaggctcagaagaaagtattaacaggtccatgattgcacagttaagtagcagatctccaacaaattcagactttcattgcagagctcatactctttaaaaatttttttaattgtatatgtttaaggtatacaacatgatgttatgagatacataataggtagtaaggtagtaagatagttacgatagtgaaacaaatgaccatatccatcatctcacatagttacccttcttttttgtttttgttttggtggcatcagcagctaaaatctaatcatttagcagaaagctcaaatacagtacaattttattgactatagatcccttgttgtacattagatctctagacttgttcttcctacatatctgttaccctgtaacctctaacctacgtttccccatttcattcctcccatcccctaccctccctggtaacccctgtttcattctctatgtctgtatatttgactcttttttttgttccatatataagtgaaataatgcaatactttctgtgtctgtcatatttcacttagcataatgtcttccaggttcatccatgctgtgacaaatggcaagatctcctcctttttaaagggtgaataatattccattgtatatgtatattacagtttctttatctactcatccactggtgagagcacttgggttgtttccgtatcttggctattgtgaataatgctgtaacgaatatgagagtatagacatatttgcaagacagttatttcattttctttggatatatgccttgaagaggaattgctggatcatatgctagttctatttttaatttctttaggaacttccatacctttttcaacaatgactaccaatctacattctcaccaacagtgtagaagagttcccctttttccacaccctcgccaacatttgttatctcttgactttttgataatagccattttcacaggcatgaggtgatatctcattgtggtttgattttcatttttctaacaactaatgatgtcaaacacctttccatgtatctgttggccatttgcatgtcttccttggagaaatgtctattcagtttctttgcctattttgtaatcaagttatttatttttatactattgagttatatgagttctttataaaatttttgatattaaccccttatcagatgtatagtttgcaattttttccctaattcacaggtttttgtttcattttgttgttttctttggtatgcagaaagtttttagtagtcaggattcacactcttaaccagtgtattagtctgttttcacactgctgtaaagaactacctgagactgggtaatttatgaagaaaagaggtttaattgactcacagttctgcatggctggagaggcctcaggaaacttaaaatcatggtggaagatgaaggggaagcaaggcatgttttacatggcagcaggagagagagagaacaagaagggaagtgccatacgtttaaaccatcagatctcgtgagaactcacttactatcacaagaacagaatgggggaaaccgtccctatgatccagtcacttcccaccaggtccctcccctgacacatggggattacaatttgagatgagatgtgggtggggacacagagccaaatcacatcattcctcccctggcccttcccaaatctcatgtccttcttacattgcaaaatcagtcatgccttcccaacagtcccccaaagtcttaactcactccagcattaactcaaaaggccaagtccaaagtctcatctgagacaaggcaagttccttccacatatgagcctgtaaaatcaaaacaacaagtcagttacttccaagatacaatgggggtacaagcattgggtaaattctctcattctgaaaaggagaaattagccaaaacaaaggggctacaggcctcatgcaagtccaaaacccagctgggcagccattgaatcataaagctctaaaatctcctttgattccatgtctcacatctatgcaaggccacattgatgcaagggatgggtccccaaggccttgggcagctctccctctgtggcattgcagggtacagaccccacagcttctttcacaagctggtattgagtacctgcaggttttctaggcacacagtgcaagctgttggtggatctacaattctggggtctggaggatggtgaccctcttctcacagctccactaggcagtgcctcacgggggactctgtgtgggggctccaaccccacatttccctgctgcactgccctagtagaggttatccatgaagattctgcccctgcagaagacttctgccttgacatccaggcatttccatacatcctctgaaatctaagcagagattcccaaagctcaactcttgtctcctgtgcacctgcaggcctaacaccacatgaaagccaccaaatcttggggcctgaaccctctgaaacaacagtttgagctgtaccttggccccttttagccatagctggaggtggagtggctggcatacagggtgccaagtcctgaggctgcacagcaacagggccctgggcccagcccacaaaaccatatttccttcctaggcctctgggcctgtgattggaggggctgatgtgaagatctctgaaatgccctggagacattttccctactatcttggctgttaacattcagctccttgttacttatataaatttctgcagctcgtttgaatttctccacagaaaatgggtttttcttttctaccacatggtcaggctgaaaattttccaaacttttactctctgcttcccttttaaacataatttccaatttcagaccatctctttgtgaatgcatatgactatatacttttagaaacagccaggtcaaatcttgaatgctatgctgcttagaaatttattctgccagataccctaaatcatctctcttaagttcagatttttacagatctctagggcaggggaaaagtgctgccagccagtcttttgccaaagcatagctagagtgacctttgctccagttcctaagaagttcctcatttccatctgagagcacctcatcctggatttcattgtccatatcactatcagtattttggtcaaaaccattcaacaagtctctagcaagttccaaactttcccacatctttctatctttttctgagccctttaaactgttccaacctctgcccagttccaaaactgattccagattttcaggcatcttatagcagtccccgacttctctcagtaccaagtttctgtattattctgttttcacactgttataaagaactacccgagactgggtaatttatgaagaaaagaggtttaattgacttgcagttctgcatggctaaagaggccgcagaaaacttacaatcatggtggaaggtgaagggggaagcaggcacatcttacatggcagcaggagagagagacagcaaggggaaagtgccacatttttaaaccatcagatctcacgagaactcgttatcaccagaacagcatgagggaaatcacccctatgatccaatcacctccgaccaggtccctcctctgacataaggggattaaaatttggtatgagatttgggtggggacacaaagccaaatcatatcaaccagtgataggtacaagcttccatctgatctcaatcttattatatatttcaacacacaagaaagaaaaagcactcttaagcactcatcactcatataaatatcagcatatctatatatgtttatatataaatatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatctatatatgtttatatataagtatcagcatatttatatatgtttatatataaatatggtagtgggagaacttatatatgtgtgtgtatatttatatgtatatacacatgtttatatgtatatacacatgtttatatgtatatacacacacatatgtatgtgcttgcttcagacatttgtttttaagaaataaaaatttctagtgcaattgaaatccctttttacccctcctctattcttttttcttttgtccatatgtaggtaacacttatcctgaaatcagtatgtttttttcccatccaactttttgtacctttgccagatgcatacactttttaactttgtctaaaaaaatagtgtttgtagcactcctctggggctaggtgttatttccctcactttacagatagaaacactgaggcttaagtgacatgaccaaaggccatgtggcttggaaatggcatagggaggactggatctctagaccttggattcttttttgatgttgtgggatattttaaatctcctgcctcccttgactcttagaggatttgagactctagatgtatttgatattggtatttgagatgtgaaaagggaggattatttgaataattggcactttataattttccaaaagaattgtaaaaatttttccttttctcatcttcctccagaatgcatgtctagtcagtccaggctactgtgtatcataaactgcttaaataagaggaatttattcctcatacttatggagactggaaagttgaagatctaggcaccagcagatctggtttctggtgggggccgcttcttggtttgtagatggctgtgttcttgtcatagcctctcacatggcagagagcaaagagagagggagcaaactctcctgtaagggcactaatcccattcataaaggctccattctcatgacctaattacctcccaaggaccccacctcctaatgccatcacatcaggtgtcagaattgcaacatacgaattttgggaggacacattcagtccatagcaatgcacactgtgaattttatgttaaagaaagtggttatctcatgaaaacggttagcaaaaaagcccttgttattgttgaattcaaaagagtgttgaactcaggagcgggttctgggacatggtaaatgccatgttacactgagcctgcttttgatcatggtgtccactgtccaggaatttttctcttttgtaccaaccgttgttatctgcccagtcatgttttggagcatagatagatatagctgattggtgaccatattagggaaccaacatcagtggtcagagataaatgacctggcagaagtaaaaatgccagaaaaaagtcataaggatagtccggatgcagttgatgcactaggcatgggtttggattctggtttggctgcttttctgctaaagaatgtgttggaatttcttccccacctgtttgatctcagtgtcaccatccagcaagtggagataaagccttcttgcaatgaatccctggggatttatccctggaagcatgtagcccagtgcaatatacatagttggtgcacaattaatattgattgaacttgaacctgggagccagaataagaatattgggtgtaagtgtcagcagaatcctgtcgtcaggagtgaggtgcaactctgagaattaggaaacctataagacgtacacacataaccgagttttgagggtcagagcaggcaaactccttggatccaggaagacaagttaccttaatggagtccctgtcacagagatgcagatgtggacatgagctttgtgtagggaccatctattggtccctcgattgtttttctgttttttggtggattttagtgaccttagccatcatgtgggttcaagtcactgctaccagatgaccctatctctatttgcactctaaccccatcacatgggagacaatgtggccaaccagctttaaggattggctttgaagtcacataagcttgagtttgaactctggttgtatgatcttggcccagcccatcaattgacttgaatatcagtttcctcatctataaaatgggaatgataatacttagctcacagtgtcgctctgaggattaaatgagagaatgcctgtacaacgtttagcatacagctttgcatgttgcaggtgaccagtgaaagacaggtaataataatattacaaagttgcatttctgtctagttggtgaaaaggggcaactaaaggaggttgttgtagcacagcgcagcagggtgttgcttgagtgtaaatctcagctgcatcacccactagctgtgtgaccatcagcaagctgcttaatctctgtgcctgtctattttcatttgcagagctgaagcagtaatagtacctacttaataggattgttgtaaagattaatttacaataagacaaaacaaaaaatgtcaacagagttaccagcacataggaagcacttagaaagtataagcagtattgttaattatggattatttttcaacagttattgacaaataattagaggccactgaaaatagaatgtgatgcttcatgaagtagaacatcttccatcactggaagtattcaggtggaaagtagcttagtggagatttagttttggagatttagacattgagaagttggaaatattaatattaggtaaccatcaaatcattccctcataatataggaagcataggtgatagttgcttatgttgaaaacctgacactgcaacctactagctgtgtgatccttggaaagtcacttaacttctctgtgcctcaggtaggccactcatttgtaaaacaggataataaccgttcctacttcatgcggttgttatgaatattgaagggcttaatatataaagagtgcttagaatggtatttttatttcccacctgagattctctttccaacctccctttcttccttctgtttttcctctctccttcctttctccttttctccttcctctcactttctgtcactcaaaaagaagctatcacggccccctgttgcttcagagtttcctttaggacctggccgtcaggctggctcatgactatgaagggtgactttgcatgttaagttgtttgtttttgggcttggttgtatgtctgttgggaacatatttcatcaacaatctgtcagcccggtaatgaggggtctgctagtgaggctcctgacagacgcgttttatttacaaagatgacaaatgccactccttggctgtgttggaatcatttcaaaggccagccgactcattacagtcatcaggacttgctgcactcaggcgtattttgtctgaggactgtgtgtaatttggatttctgctcattgatacattttttaatataatattcctgcaaagggtagatctcttaaaatccctgtccctttatctgtccctaaacttacttgttttgtaacgactaacttttgtaaatcgcattttagacactatttgctgctgttagaactgtcagtgttattttaggatgtttgcccaaatcaggagcatttctttgtcccgaaggcaggaattgaaagcatgcagatggtcacagggcccaggaaggcaatggacacaagggaggggctgcgttgaggctggtggactggaggcagatgctctgtctggtggaccctgctgcttttctcctcccagccagttgggagcactggccagcactactggggctcctgatttttcaaaatcaggagcacctttatatgaagtctatttttagatgttattttgagatgttggcaaccaattcaacagatttcaaagactatgagcttccagagtttgatctgtacccaaggtctaaagcaatttgcagtagttttactagtttaaaacaaaacaaaacaaaacagaaaaacactagcaacaaacttgtaataaatgagggaactgtttctttgttttctttttgcagactggtataggggatacctcataaagcacaaaatgttacaggtaaggtcacctggtttttatttgtgtcagtactggaggtcttcatatggccccgctatcccatctgagcaggtctctcccaccattgctcctcagcaaagggaatccatctctccctcctgtgccctgtgctctctgacctctgtgccttgtcactcgctgtgctcagctccctcccactttccctcattctttaaggttcatctctggtgccatctccctgcaacttttcctgatatgccactcacttatgatttctcccttcctcgagtctctgtggaattgtgcgttataaatttgaaatttattctactgccttcctttagagttgtttgcagcattcagtcatctcctcatccgtatacccaggtcaacacagaaaggacaggcctgatttctacttttgaggggttctcttgttctaacctcacatttcactattgtctccatgagagcaggcgcttgctttgcttgtctcattttctctcacagcacctagcacagtgaccagatgtccccagtatgcacattggttgcatttatgaagggatttccaagtaattgataaacttaccttgttaactgagccaaatgtatggagtaaggaaataatagaagcttcttccttcttccctgacatgctgtgtcgggagggatggtcctattctgctctctcaaagaacaatggaataaatgcaggcagaataggtctcaaatcgaactagcccaaatgcacctaggaacattgttgcttcaggaccagttatttctgaccttccagttgttcctgactgtgaagggtgaccgctttccggaatcgggcaggcaatgggagaagcagagctcctcgtctcgcttaaagtcagtgagtggtttaggttgtctttcaaacgatactgtcttatagcccacctgcaggatgagtggccataatgggttggagcatcccttgggatctagggctatggtgagatctagggctattgtgggatctagagcaactgatggagaactggagggaaagccagatctaaacaagtagatttagaatccagcccctgttctatctggctctgggtttattcctttaaagtctggggattttataagccagtagcttttggaaaaaaattataaagacgtagggtcattcatttctgtggtgatatatctttttattttattttgttttgttttgttttgtttccaacagggcatttttcctaagtcatttatccacatcaaggaagtgacagttgagaaaagaaggtatttgccattcttcaccagacttgagcctccagtggctcatggatgtctctgtcctgtttattttgaaaatctgacttggaagagctgagggttgctcagcttatcttctttgtgcctgtgtatatttgtgggtctcctttccgttactcaatgggagatctaatccaaattgattcatactgagatctgactctgagggggtattagtttggagaatcaaactttttgctggcagctaccttagaactgtattaaagtagattaatcctaaataatgagcccaccctagcgaaggaggacataacaaagcaagtcccttgtatttgcataatgtagttggtgtggctattggaggtgttttagtctaatgtcaggaaggcccctccgcagctgcagcttaatgcaaatttgttggtgttttatcttgttagcacctgggtctcaatttcacaccactttttctcccaccttaaatagaaatactgagaacatcattcctgcagaaattcctctggcacaagaagtgacaacgacactttgggaatggggaagcatctggaaacaactctatgtggtgagactcagaactctgctccctgagttggaagcttcttgcaatcttcagtttggttccagttttcattttagcattgagtcaggcaggtggaggtggctttggtgacatagcagagcgcacactattacgtgtgaggacatcaaggcccagagaggatcagggactttctcaaagccacagagctagtgacagagccataatcaatggagtctactgtgaaccttcggtgtttagtgcagaagttgtcaaacttgagcatgcataagaatcaccttaagaactgttaaaaataaagcttcctcccaaggggtttaataatctgcatttttaataaactcagatttgatttgctagtctgctgataacacattgagaaatactgttcttatactttaaccaatggctattgtcctcacatctatgaagaagttttgactttggaaaaacaaagaatatatttttgcatttgttttccctgttttgaagcaaatctaattttaaatcctcctttgatgctctaaagctcctaatgaaagcaattagctaagcaaaccattaagctgagagtgaaaatgtcaaccaaggcttactgcatgtttattatggcaccgtggacacctgctggtgtatgcacaggatttgtagacttacctttcgtggtcttaaatgttgactcccatgtggacatttcataatatgaagatgtaattggcacactcaattttacatgtttctcaaagtttttagaaaagtgtaggggaaaaatagtatccttgtggctaaagcaattttttgttcatctccactatacgctgaccttttttttttatttattttttatttttttgagatggagtctcgctctgttgcccaggctggagtgcaatggcatgatcttggctcactgcagcctctgcctcctgggttcaagtgattatcctgccttggcctcctgagtagctgggattacaggtgcccgccaccacgcccagctaattttttgtatttttagtagagatggggtttcatcatgttggtcaggctggccttgaactcctgacctcaagtgatccacccaccttggccttccaaagtgctgagattacaggcatgagccaccacgcccggcctactaccccttttaaaacatcacaatcacacgtaccattgaagcttggcattttcccttaggaaatctttgaatagcagtaagtccatttactctagtcaggagatccttcaacatctagtacttcggtatcacattcctgattcttgccatatctgcatacaacctgtgtaatatttacttaatagctgctttggatctcctttcagtaaacctgaatctatagacataaagaatgagatagcatgctgcatcattccagcagttcttgattccccgtcaccaactagatgccccacaattcagttcaacgctgactacccagggttactgccagactccatgggtttaaagcctcaatcccacaagattgccctcactttagatgccagtcgcaagtcctgggttcccaggttacctgaacttctgttggacttggctataaattcagggattctcactacccctccctgcctgggcacccccttttttcacttccagtttcataatttgttagaacaactcagagaactcaggaaagtgctatacatgtgattacggttttattataaagaatgtaattcaggatcagccttgtggaagagacacagggctaggcatagaggggcatagagcttccgtgtcctcggcacaccaccctcccagcacattgatgtgttcaccttctgggaagcccctcaaatgttattaaccaagagttttaatcagagtttcattacacaggcatgattgattaaattattggctattggtgcttgagctcaatcctcagtccccctcccctcccagaggttggggtggggcaggtggaggggagtggggctaagttccaaccctctaatcatgtgattgggggtttggttcctagttggttcctctgcaaccagcccctcatcctgaagctatctaggggcccacctagaatcacctcattagcataaactcaggtatcattgaaaggggattgttaggaataacaaaatacattcttatcactctggtcattgcaggagttttaggagcactgcttcaagaaccaaggacaaaaatcaagtgtgtatatatatatatttttttgttgttgtttttttaattataccacccacactttcccaaatggaaagacaaaagtacttgacacaattagaagaacattattcatctaaatacaatgaaaacaagataacattatttttataaaaaaaaatttagagacagggtcttgctctgtcacccccgctggagtgcagtgggaccatcatagctcactgcagtgctaaactcctggcctcaagctatcctcccgccttagcctccggaacatgcttgctattgtacctgtcaaaagctctgagtccaaaccttttctctctgtttgttaaaaaagacattaacaatatgtgagaggtgttagagacatattactatgaaactgcaactttctctttcccttacacagaaggatggaaatggagtgggagagaatcacctagggatccatgttgtttgaccttgtatctttgtaccacgaagagccatcttgcttcccataggtggtacgcgtgccacactttggagaatgctgccctagaagcagtcctttatcaccagagaaatggccctggctcccagcctcaaaaggcctgagctctgggacctccattagggcagatgttcgtagcattcctgttcaataaatatctttttagataaagtcagaaatcactcattccttaaccaagaaatgattgagatttttatttttgcttttgggaaatccctgtggtccacggggaataaatacatcaacgactaggacccccacctaatccttttgtagtgggtagggcagggagagagcctcaggccatggcccttgaccacactcacctgactttggcacagcctgccaaatagatggtcatgcccctttaacacaggtaattatgggttgtttcttgtctcctaggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaagtaacctctctttcctctgcaaagaggttttcttcccccagccatcctctttcttccctctctccccagaagcttgttttcatttttagatgcaattttgtcactttctgtttgggagaaggttgtgaccaatggctgtgcttgcgtgccgttgttaccacccctgggggacctagggacatgcaggtggagagaaggcttgtacttaacatggtgttattaccaggctgagagatttaggacactcatttaacctacttccgatggactagggagcatagtcatgctggttcactttcagcttagttgtcattttatacctgcatttgcaaaactctcccttaaatcccaatgtgagacttaatgtctcttcccccatcctaaagtagccaacccacacaccatcaactaactcaaatgcacaattacaaaaatgtttcctcaaaagggaagagaagtaaaaattggttggatttgaatgctatgaagttaaggagaaaatgaaccaattatttgaggtgggacaacccactgataataacattataagtaactcttaatcagagctcattgtacaccaggcttggtgctaagtgttttgcaggcattgtctcatttaattcttataataactctatggagtatgcagtttgattatccccacttttttccgataaagaaaccgagggttttcagtagggtaggtaacttgtccagagtcgcgcagctagtaaatgacagaatctgaacttagacccaggcagtctggctccagggtccacctggagtccagggcctcctggagtggagtccagggcctcaccactctgctacttggatagcatttgagaactataaggaccttccctccctcctgatcttttgaatggcttccaaacattctgttcatttgttcattcattcctaccacaaacatgtattgaggacttatagttggctggatttcctgctaggtattggggctgtagaaataaaagtccctgtccactaaagggtcacagttccaattaggagtaagccacaagtaaactgctgatatgtactgtgagaagttcgatagctcaggaagcaagagttacttttaatgagccttagagaaggaagtcaaggaagacttcctgaaggaggcgacccctgagctgaagtttgaaggataaagagatattaagcaggctaaaaaaggagagtcaggggctcatgagagagcatggcatactcaaggaactgcaaagtgggtctgaaggctggaacacagggcctgagggggaagtaaaaagcccatttaatgggaataaaaagaagtttccccagcagccaggccaggctttcttgccctgacataagcactagggggaggattcggagaggaaagtcaatggctccaactcacagctggtctccatcccaggaacacagtccctctgctgatgccccattggcatctggcaagcgtgtccaaatctgcttataaagcacatcatcctaaagtgacaggaagggtttgccccgcagctgctactgccgttggttccatgatgtctttagctgagcacagttgcagctgagtgtgtgggaattgagggctgctttacaatgacatctacgaccttcaaatgttgttttctcaatgggggctcctgagaagaaggaccaggaatggaagaagtggtcactactcataggaagccttccctgattttccactacccgccttggcccggggtaggtgctcttgaaggccctgagtagtaattgcctcctttttggcctggcttccctcctattgtggaagatcctatagatgttgactgtctaaagcacctctctgcctgtgcctggaacaaggtctgcacatagtaggttctcagtgagtgacaactgagtgagtgggcgaatggtggtgatgggagaaaaagaagaaagagggtcctccctaaaccagcccctcctctgcagcatcctctgacctatagccctgtgcttttagttctgtcagtttcctttggggaagtgagggatgctccgtggcacagactgagacctcaagctcaggggcccccttattcacctgactgcttcagctgcaagcgagagagttgggcaacttatcactggcctgatagtttaggtgctcagagctctggtatgggatgggcagcttcctcaaatccaggaggcccagcgtctgggccaagtgtcaggatcagcctgggaacacccacctccaacttccagcagctgggagattgggtgggggtggcacaaagtggaactgaaccttggaggagtgatcagaatgagcttgtttcttctctcattcattccgttccttcattcagatatcaaactttctttgcacacctggtaggccccaagggtacagggtacagacacatacacaatacagtctctgtttttaacaacaatcaaaaagcaagcaatgagaaccagtgataacttctgaagcgctcactgtacaccaggcaccatttaaagcactttccatatattaactctgtgaagtatcaaaacaactttatgaggtaggcactattctcaccctgtttctcaggtgaggaaagtgaggctcaagagtgattaggtgtgtgagctgagaaaccaacacaggtgcctctttatcaactaagatggactctaaggttaaggaaacaacagctgcctatgggtcaggttgagcattcaggggagctggcatggcaactccctaaattcctacagctacaagaaaaacacactcttgtcaaactccctaacaataggagctatcaggcaaattatcagacccttcctaactctgatttacatccacaccactataactctaagtggacagaggactggcctgctaaacattcttttttttgataaagaactgcaaatcttaagtcagtttcagctagctgaaggctgcccgcaaactgtgtccagtagttcaccttttgatgtaaagtgccaagtttcatcttattttaataataaaccccaccccaaagtgtacatgggatgtatgttacatacatgtttacccgttgtgcatgctcttgtctccataaatatgtatgatttttcccctaaacctgctgaatatgtatgatgttggccctgtgaggcataaaacccaacatgtcctttccgtcttcaaagagagagcaccttccagacatgacagagactgtctcttcaaagtttgcaaaccgatgtaaccagtgaggttctccttttgtaatgaagtgcaggctctgctgctcgctgcttgcaaagccagtaacggggacacagggcattgtaaggaaagtgactttatttccgaagccagccatggggaaacatacaggctcacccctctggaaaccacttcaaaactctgggctgagggcaggggtttcaaaaagggaagctggatgtgggaggcatgcaggagctgtgtagggtgcaggggctgtgtgttttgccctgatgccagtcttgagttatggtccacctggagcacagactggtgccatcttgacagtggccaggctgtagatgatccatcttgaggcagtctttaagtgggggagaattctgtagctgcgctctcatgcctggtttgttttaaattagcccctggaatttcttaacaagcacagagttaagtaaatgtgcatggagtaagagagtatatgttagaagacggaagggaatggagcttcaaagtatgtttcaagggtatacttaagactaaggaaaaaaaaaggcttctatagtttttctcaaggttacatcttcagtcttgagaaaagtttttgtttttttttttcttttttgagacagagtctcgatctgtcacccaggctagagtgcagagtgcactgcaacatccgcctcccaggttcaagtgattctcctgcctcagtctcccaagtagctgggactataggcacacgtcaccatgccaggctaatttttgtatttttagtagagacggggtttcaccagtctctaccaggctggtcttgaactcctgaccttgtgatccacctgccttggcctgcaaaagtgctgggattacagtcataagccaccgagcctggccaagaaaaaagttttaaaatgcattttgaagctgagatcctcggttacactttctactatttggccatcctggtggtcttttgaacggcaggtgattttgctcaagatgcagtggaatttgaactgataatgtggctccagagttcaagtgcttgactgctgtattctactgccttccatgagctgtgtgagttaataagggaggcagagaagtaaacagccactttcagtcggaagtcatatacattaggagtgcaggaagcatgggcaagaaggttggaggacatgggggtgggagtcagggtggggatgacaaccactctgaatctaactagaccagcaggaattattaggtgaaatggagaagagaaactcggagggagagaatgtgggagatgagaggttgacatgaccacggagaggaagacatgggtggactggggctggaaccttgaggattttagcaccaactgagtctggatttgtccagacagcaatggggagccatcacagatttttaggctggcatatgcagtggtgcagtcacagctcactacagtctccttctcctggggtcaagtgatcctcccacctcagcctcccgaggagctggaactacaggtgcgtgccaccatgcccagctgattttaccttttttaaaaattttattataaataaatgcatacagtggggccttttccctctaccctcatcttggcttcattttatcacttccttgaacagaagagagcactggggttacatcctgatgagagaatgcctaaatgttctgctccccaaaattcatggtggctgcattcagaggctgtggaggacagcctctcctgcccctgggccatgagagtcctgtcaatcctaccaaagctcccaaagttccaagtgattttgatgtccaaggattgaggaatcctcaaatgacttcttcacatcccaagatagccagacctaggagaatgttttattcatgtattttagaaccgaatccactttgataaattttgaggagaaacagccagagagatcttggcattaaattatgtatcagcgatgctccatcttttccaaggtcaggagagcctctgctaagcattagctgaatgtgtttcttcccccttagcattgccgttgggcagcatggccgtgtaccattatgagtcatgttaagttgggagttaatttcctaatgaatgtggacaaatgggtgaaccttggctcgcttctgactgcatttggatgagatgagagatgcgcctctcaattcgattctctgatagagatgaagacttagtttccttcatttgtccttgctacccttccagaatctggtacttagtagtcgcaaccaagcaggagtatggttggccttctcagaatccatcagccccacctcctcctaccttctttgtatggacaactgaggctcttcatctcaatatcaagtgcaaaagcagtttcaagttcaaggtttctgcaaacacaccctaccccactccacaacccatatactgctcctaagctcctcctatctattatagtaagcataccagagaggttatgagtgtggacaaagatgtattcttagtttttactagctatatgaccttgagcaattagtcctcatatcctcagtcttttcttcatttgtaaaatggggttattgatagtacctccttcatagggttgttatgagaattaaatggattaattttatgtaaaacacttattgtatgtgagctgattgtaagtgctgtgtgagtttgctgctattagtatcactgatgccgatcaggatgacaggtgtagttgaaacaaatcaataccaaacagggaaaagcttgtggcctggaagtcaaatagctgaaagcaagctgtgggtaacagtcaacatgtctgagattgtttttccccaaccactattttcaaatttttattgagtaatatataaatacctcctctgtgtatatatttaaaaagaggctaggtacggtagtagctgggcatggtggcatgtgcctgtagtcccagctgctcaggaggctgaggtgggaggattgcttgagcccaagagttcaaggctgtgggaagctatgatcacaccactgtaccccagcctggaagacagagcaagaccctgactcattaaaaaaaaaattaaataaattgagacaaggcacatgtaacctttgacccctttactcctccagccctaggcccctacctgtccccacagataacctgtgttggtagtttggtccttttttcattcagagctttctctcatacataagcttattcttatacatgaacccagataacatatctggcctattttttgtttatttgttttattgttatttatttataaaaataaatattgtatgcacactgtatgcatctttccatgcttgatttttgcactgaaatatattattaaacatagcaaaactatataatattttaaaaggtctgctatgtggtattccattatagatagatcactgttgatttagccatttctcttttagtagaccttttttttttttttttttttttttttctgagatggagtctcgctctgtcaccgaggctggagtgcagtggtgcaatctcggctcgctgcaacttccgcctcccaggttcaagaaattctcctgtctcagcctcccgagtagctgggattacaggagctcaccaccatgcctggctaatttttgtatttttagtagagacagggtttcaccatcttggccaggctagtcttgaactcctgacctcaggtgatccacccacctcggcctcccaaagtgctgggattacaggcgtgagtcaccgtacccagctaacattttttttttttttcaatacttgctgatgtgaacaagtctgcaacacatcctagttcaagtgttgggtgtttcagtttaataccatggaaaatacacctttttaaaaaattgaatgcacactactacagtaccttctaaagggggtctactataccaatatgtgctcactagcagtgtcccaggctatcagtgtagagctcttctatgtgactatatgacccccagaaatcagctgaactttctggtaaaaagcttctcaccagtgacctaaagttctcccctgatttgtcttcacctccagtttttgctttacagaatccttgagcttgatttgattgtcagagatgaagacggaaatatcttggaccctgataataccagtgtcatcagcttgttccatgcacatgaggaagcaactgataaaatcacagagcgtatcaaagaagaaatggtgagctttactaaataggctttggccaagtgatacaatcatttagcacatcataaacttaaaataatgggctaatgaaccagactgtgtattattcaaggggcatctgtctatgacctgagatgatcagcaaccacatgtgtttaactgtggtttcgtactcaaatctgtaattcattcaacatccatctcacaggtagttaaatggcaggcaagtttcttgatctcttggagcttgtagattccagaaggggaaaagaagaaaggcgataacaaagtaaataaataagtgaaaatattaattccagatgagtgtataaaaggcaatgaaccagggttatgtgaatcaaagtgactcaggagctatgttaaaaggcactgccaggagaggcttctctcaagagtgacatttgagctgacacctgaatcatgtgagggcaccaggcctgggatgatctgggacagggtgttccaggcagagggcacagcaggtgcaaaggccctgaggtaggactgcattctgactattcaaggagtaggaaagccaaacaaggatgaggtgtggtgaacaccaggggagtttaggcaatgatttgcagaggccgggtaggtggagacagatctcaaagggcctgaggggttttggaaaagagttgtgatgttattcccacggatgggaaatcagtgagagatttcaaggaaaggttaacagtctgacttttatttaaaaaaattattttagctactctgtgttatttgaaagcaattttgtttttagatttattaagatataattttcatatagtacatttcactcattttaaattactctttaatgaatcgtaataatatattgtgttggataaacatcgtgacaatcaagataaagaacacttccatcaccctaaaagtttctttgtgctccttctccagccccaagccccgtgcaacccctaatttcctgtcactgtagatttgccttttctagagtttcatataagtggaatcgtgcagtattaattttctgtttgacttttactcagcaagatgtttttgaggtttatgttgttgtgcatattaacattttggtcctttttattactgagtcagtataccactggccagttaccaatggtatatagcattgaccaattattgggcatttgggtaagttttcagttcagagctattatactaatgcaactatgaacatttggaaacaaatccttgtgcggacatgttttaattccttttgggcaatacttagcagtgggattgctggatcatgtgataagtgtatatataactttttaaggtattgccatgctgtttctcaaaatggctgtacaattttttttgtttttttgagacagggtctctcactctatcacccaggctggagtataatggtgtgatcatggctcactgtagcttcgaccccctgggctcaggtgattgttctacctcagcctcccaagtagctgggatcacaggtgcatgccaacatgcctggctaattttttttattttctgtagagatgggttttcactatgttgccgaggctgatcttgaattcctgggctcaaatggtcagcccatctcagccttccaaagtgctgagattacaggtgtgagccaccacgccagcctaattttgcatttctaccagcaatatatgagagctttagttgctctacatcctcgtcaacacttgatatcagactttttaacttagccattctagtggttgtgtagttgtatctcattgtagttttaattttcattttttttgataagtagtaatgttgagtatctctttatgtgcttcctgtcatttccacttgtattttctcttgggaagtgtctggtcaaacattttacccattttaattgggttattttcctcataattagttgtaagagttatttgtatgttctagatacaaattctttgtcagatatgttttgcaagtttctccaaatctgtacctagctgttgcatctttcaaagagcaaaagtttatagttttgaaaaaatccatttaagcaatatttttcttttctagtttgtgctttttatgacactaactttatgaagaagtctgggtcaatggtgacatttcccaagatagaaaaatacaggccaagagagtcaaagcgaattgattcaggttacagaagcttttgatggcagagctggatggaatgcccaaactttaggcttgaacccaatatccttgactatctctctgttgctctaagtggtgctaggctaattttctccatcttctttccttcttccttctgcctttcagtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataaggtaggtgtgtccagggttgccctacttctctgactatgggaagcagtgcacagagcatcttttctttccatcctcacttgtggagcaatctccacctggaaaagagactgcacctgagtgagaatgtggaaataacttctttggaggttgtaggagtcaagtggaagtgttatttaccaccagttttttcccacagtggagtttatggttgtagggttttgtaaaatagattttgattgccagaaagcagtcagaaataacaagattcagacaagtagcattggctagaataaaaatatgtacttcttttttgttttgagacagggtctcactctgttgcccaggctggagtgcatgggtgcaatcacggctcgctgtagacttgaactcctaggctcaagtggttctcccacctcagcctcctgagtagctgggactataggcatgtgccaccacacctgcttaatttttaattttttatagaggcagggtcttgctgcattgtccagtctggtgtcgaactcttggcttcgagtgatcctcccaccttggcttcccaaagtgctgggattataggggtgagccactgctacctgccaatatctactttcaaaataggagctaagaaatgaatgctccaaatcctctgtagcagcaataggctaagggtataggctctgagatctgtctgggttcacatctaggccccagcctttactctttcttaacatggggcaggttgttaatgtttcttaagcctgagtttcccatctgcataatgcgagtgctgacctcacagggtcatttgcttcaggctttaatgagaaagagtttgtgatgcacaaggcctggcacatgttgcctgtactgcaaggggcagtggttgttattattactactttaataagttgttcttgggaatggaggaagtgagggaacttctgggtgcctcagctcaaggaagggaaaatactcttgggaatctccagggaagagactttgctgctcctccggctcccactgccagactcctggcctctacttgtggcttagaccatccttcctctcaggcgaccactgcctgtctcctccattggggttttagcccaagacatggtctcatatttgagaccactgaccgtgactgcaggcatgcgccaccacgcccggctaatttttaagtttttgtagaggcacacattagaaaagagctaggacatgatctctctgcctttgtgggaaaaatggataaaatgatgtcttcctggcttgttgttatgatgattaaatgaacgaatacaccatgcctgaggaatagtggtgctttagtaaacagcggcctcctggagacatgcatgaaactggaggggctgtccatctcagaagaatgtgctggggtctgtacattgtctcatctaatcctcatggttccgtgtcactaagatgagaaaatgaggctcagggaagtcaagcaacttgcccaaagtcacaaatatttgtaaacagcagagctgggatttatatacaggcccatctaactccaaagacaagctatttcccacgtaagtctgtcaccaaggaatgagttgtgtcaaatattctaaatggttttcaccagggtttcagcaccattatggtggaaaggtaatttttattatgcaccaaagtccctaacctcaaagagtcagcccaattcacctggcttagccttggtggaccccgataatgagtgtccctggtcccttacgcccaccttgaaatggtttgggagtcagaggcaggggccccttgctgttccctgtcagttactcccaaggttcctgaaaggctcactggctgcagtttcaggagccttagaagcaaccgagaggaaacagtatggggcctatgacacacagcagatctgaaagtgctcactgcctgccacattgacaagggagtgtggtcggctggccccatctcagtgatggatggctggaccagctctgtggagggagaccatgaatcagcgaggtggcagctgtgctccctgccgtgccacctggcaggccatgctcaatggggtgtgcctgagtgacatctctgagagtgctggagacgagggccagcccagggagagtggggatgaacagagagaggaggacaaagggggcagaaaccagcaattgtgaaaagaggagaaagcaaaggaagaagagaagaggcacaatgcaggaaggagggcaggggaatctgggaacactcccaatgtcagtctcactctgaagagctgctctttccctaagcaagaaatctgggctcctgcctgctgtagccaggatcgacatacagtgaacaacaggcaggttaagacatcttcagtgtggcccagatgtggactggggagaatatagctaggatcgatgttttaatgttggactgaatcacggtcagatacccagtagatccctgaagggatcctgtttgggaaatttaatgtaaatttttacaggacaaaagagaagcagttcaggtatcaggctagcagtaaggcttatgcccaaaaattgtgtgatgaggagttggaatagtactcctcgttcctctgagtaggttgtcatttggaggaggtcttacatgtcttggtgctgtgagccttcagattctaccacctagatcttcctgggtgaggatggatgggaccagctcagccctccaaattgttttccttatttatgattgtgcttctcctggaagaaaattgctggtgcttgctgtttagacgtagcaagctgggtcactgaggggcttgctacatatgatggaaggtactggaatatatctaagcatttcactaacaacagtacagaaattaccaatgagaaagcattaaaaataaaaaaaatttgcatggagacttcctagttagtttactgcaaactccactacaatttttagatcttactgaaaaaaacacaaaagatgaaaagatccacttaacttgattgagttttaagcattggttaatctgggactgtgttcatttttgctattggccccattgcctgcttgaactctgctcagtctgctctcattaaccttttaggggtgactggagagagaggaacgaggcatcagagataaaacaagctctaaaaggaagtcaagtccctttaattttgctgaatcccgttatgccttcttaggctaacttgatttttgaatttttaaaaaatcttgttcctaatttaaaataatgggcacttatttagcaccaactatatgctcctaaatggcgtggaaaatctgatgactcaactcagcaaactatattaagcttcttctaacttaaataagtgctagacctctctatcttcctggagtgatgggactgaccagcatgacggctgctaggagatatgagatggcaaaggatcgtacgttagaaccatatagctggtcctcataaaaccctccaatgggtttccattactctcatcatcaaggcaaaaatccttgaatggcctataaagcctatgtggtctggcctctccctctaatttttctcttgtaactttccgttgaatctgtttatttttatttatttattttttgagatggagtctcccttttcacccagactggagtgcagtggcatgacctcagctcactgcaacctccacctcccgggttcaagtgattcttctgcctcagccaccctagtagctgggactacaggcatgtgccaccatgcctggctaattttttatatttttagtagaggcagggtttcaccatgttgcccaagctggtcttgaactcctgaactcaggtgatctgcccaccttggccttgcaaagtgctgggattacaggcatgagccactgtgcccagcccccttgaatctgtttcctagatgcatccagctgtttcctgcctcgtggcctttactcacgttgactttgcctgaagcatttccctttcctaccttcttttcttgaccaactttatttcatgtcatttcctcagcaaagacttccttgaccacccactaggtcaggcccatttgatacacattcatacaacatcctgaacttttcctttatacagcctgactattccttatttgaaacgcttgggaccagaattgttttggatttcagattttctcttggattttggaatatttgcattatatatatctaccagttgagcatctctaatcccaaaatctgaaatctaaaatattctgatgaacatttcctttgagcatcatgttgacacttaaaaattttcaggtttgggagcatttcatatttgggattttcagattaagggtgcttagcctgtagcacaattttatataaatagtgttacaatggcatttaaacagttatttaattgtatcttagataatggctgagaccctatatgacccatcactgtatgacattccattcaaggaaacagctctacattcaaagggtaacttaaaataattcagatctttactcagtcttgaatggggaacgggccggaaagggtaaatatattcttaatgtccaataaaatatactaaagtcctttcccctctcatctctgccattctcaataacctctatcagtatgcagatgctcctcaaaaatattagacagctgtgccagaatttgcttagcagatgggagagggatagtagtggcaaatacgcataggttaatagttctttgctcttgcctgtctaatgtctgtctcccaacacaactgtgatctctcggagggaaggaccatgtctttcttaaacacctgcatacccccagcagccagtatggtgttgggcacatagtagatgcttggtgaatgttttgactaaatggatgtcaggtcccttggcagtaacgggctgccactcttcttcccacagtgagaactacctagtgcgatggggcagccggggcttccctaaggagattgagatgctcaacaatctgaaggtggtcttcacggtgagtgtgcaccctcttctcgttaccgtgctccccaaccacaaaaatgtgaccttggaaatgaggctggtcaggagctcagggtgaagtgtggctgtcctgcagagctgtgttgtgggctccaagcagaaatccaaagctgacaaaggacattgtgtgccttgaggaagctttcggaaagatggatgttcacctctgtttttcctcatctctccctatccgtctcactcctgcacacacagagaacatatgcagaatgctacataaacaagcaccaacttctttgagcaataatgcccaggtgaactgggcacaacagcaattttgattttccggttcattcatgattaacctgagttcctttctttgttcagggctttctgaaaaatctttctaaaatatatcagaaaaaaataggacctttctagaatattgactgccttggtaaattggacattctgaatataattaagtcatagatgactaacgatctggtgggtccttaggatcatccttctaaataccaatactcactgagcaagacatgtacgtagaaatgttgaaatcgattgttatttggatgatttatttctgagagcgaagctggctttttagctctgaataggggaaacaagggaaagaaggagataagtaaaggttataatttttagtagagacccctttctcatcctgtttccataagggtgtgaagagtgtgatttttttttttttttttttgagatggagtctcactctgttgcccaggctggggtgcagtggcaccatctcggctctcaaggagaatctcaagtgattctcctgcctcagcctcctgagtagctggaattacaggtgtgagccacctcacccagcaagtgtgatcttaagacacctaaatatcttagcattgtctgtaagcttctttggggagaacactgtttatgagatttttcactacattgcctgtattagctagggaaattacagagaaggagccagggagggatttgggcattgaccaaacagatgagttggatccaggagtgaccgacatgctagattaacctaccttgctctacaataattttttggttacagcccattaattgcaatgtcttatgttatgttgtgattacattgaggaatagctgattaattttgttattttctttaaaaaatgggccagaggcatggaatgggatcataggtcctaattgcttaggcaaagttttcttggcatatatagatgtgcctccatcctgtttatctgttattagttacaaggaggagcctatttattttctggataaataggagagtcccacaggccttcctgattaaaccacaagacagatgttgcatgagagggagaagaacggggaatcaatcagtggttcattttgcagagaaccaattcatgatgtaaacatgggggaaagagcatcagtaaatttgtgtcacacagcattaatgagaatgtaatcctgccttcatggaattctgcctgggccacacctccgctcctcagaacaagtggagttgagagccttggttgacaggctcaacaggtggatgcttccctctgttaagatgatcagtcttgatctgggggtgtattagttcattcttgcatggctataaagaaatccctgaaactgggtaatttgtaaagaaaagagctttaattggctcatggttcttcaggctgtacgagaagggtgatgttggcatcttctcgacttctgggggggcctcaggaaagttgccatcatggcagaaggcaaagggaaagcaggcttgtcctatgtgaccagagcaggaacaagagacacgggggaggtgctacacacttttaaacaaccaggtcttaggagaactcgctatcatgatgatagcacctttggtgtcatttctcctggtgttaaaccataagaaagcacccccatgatccaatcacctcccatcaggccccacctccagcctggggattacattttaacatgagatttgggtggggacagtgatccagaccatatcagggggcaaggaaggtgatggtgctctcacttcttatatcgatccaagagctagccaatgagtgcctactatgcatgtgctctgtgctaagcactggccatacagcagtgagtgctttcatggtgcagtggggttaaattcagataataaaatgcatgcacaaataaacaagagcaatgtcagaaagcaatccaagcaatgcagataattaaaacagggtgatgtgatggtatgtgactggaagttactttcaactgggtgttgaggtgacgtttaaattagagatgagataagacttggcaagcatgtgtcttgctggccttatttcctccctctctggatgttagctcttcctggtctcctatgttgggggaaggcttccagatctttgagcctctctgagcctctctgagcctggcatgtgggtccagctgactgttgactttccctatgttttgttttatttatttatttatttatttatttttatttatttttttttttgagatggagtcttgctctgtcgccaggctggagtgctgtggtgcaatctcagctcactgcaacctccacctcctgggttcaagcaattcccctgcttcagcctcccaagtagctgagactacaggtacatgctaccacgccccactaattttttgtattttagtatagacggggtttcaccatgttggccaggatggtcttgatctcctgacctcgtgatccacccacctcagcctcccaaagtgctgggattacaggcgtgagccactgctcctggccctttccctctgttttgtaagggtttaccccacaaggctatgtaagaagaaagcagcatatactacgaggttccctaagatttagcccagttttggggtggttgctaacacacaggaaacaagagtgaacaataaaagaagcactaatgagttcctaaatcaggtgatgcttgttaagttccattgccctgcttccccaatactttcgagttttgtaaggccgaagcagaaatgactgggagacaccatagattggagcacaattctgtatgaggattgccagttgacacaccctccagagaatataatgtgaatatagcatttggctattttttacactttaagattctttagtgtggaggtgtgtgtgtgggggtggggtggcgggggggcgctgtccgatgagacagctctaagaggtctgacatcttcctttgagcaagtaaaaaattgttaagagaagaaggtggaatgggggcttacctgggaatcttctaggtttatgtagtatattagtttgctaggcctgccataactatcacagattggttcatgcaaacaagagaaatgtattttctcacaattctggagtctagaagtctgagattaaggtgttggcagggttggtttcttctgaggcctcttgccttggtttgcagatgactgtcttctccctgagtcttcaccgtggtcttctctctgtgtttgtctgtgccctgatatcttcttataaggacaccagtcatactgaccaaacaacctctttttaacttaattacttatttaaagaccctgtttccaaatgcagtcatgttgtgagacactgaagattaggtattcaatatatgaatttggggtgtgtgtgtgggggtgggggagcaattcagccccttcaagtctaggaagctttcaggtaccagggcctctgtcgctctgaaaggcaccaatctaagtatttcaaaaatatggagaatcctaatttgaggagagaaggtattagggatggaggtcattatgaaggaaggaggattcaagttttaaagatggaaaggatgtggatatgtagaggaggaagaggcaagcattggaggggaagtgtgggagcagggtggttaggaagaaagatccagagttggaagtgagcattgtgtgtttatggagcaataaagaaatctttgtgacaaaaataacctacttatattcagagagtcatggggaatcagtgggctaggacagctggatatattatgtctaggtcctttcatgtcaactgggaaagagtagaactaatagggtaggaaatagggagctattaatgttgttggggggaaataaatgaaataatagatgcgatgtctaaagatgaattcataagagatttcaggatggtttggaggaaggagtcaggcaggccagagacaaggctgttccaaccatctggacgtgaaataattgggatctcaaattcaaatgcctgcagaagaaggcaagggatgcagatgatggggtggggggtctttcttagcctgaaaagcagatgtccattcctgcagctggtgggatgaacagcccttgtaccagtcagtgctctctggggaaacagaacccatggaatataagtttgcgatcctaaaggcaggctggcaggctggaaactcaggcaggatttctatactacagtcttgaggcagaattcctccttgtctggcaaacctgtttttgctcttaagaccttcagctggttggatgaggcccacggacattatagaacgtcatctcctttacttagtcagctggttgtagatattaatcaggtctacaaaataccttcatagcaatatccagaccggtgtttgaccaaacagctaggcaccacaacctagccaggttggcatacaaaatttaaccgtcatggtccccaggcaggaaggtgtggaccacactggggccttgccctgttcccagagactctgcacagccccactcccttcctcctataccagcatagtgagaggcaggggatggcagctgtgccttggtcctggatctgatgtgagccgacagcttattcccagtgcatatgcccatatgagaattaactcgaaggagaataaactgttcccttttgagacctggcccagggtactctactctgatgccaacagcatgtcttgttgtttcttccttagctgatccttactggcagggggcctcaagatcactgaagcttttagattcgagcatgaagtcaggagtttcctcctgcatgcctttctgatggcaagggagctgtactgtagtagctatgtttgtggtctttggtgtcagggactgggctcaaagcccagagtctcatgggctatggtcatgaccttggggaagcctcttatcttctttgtgtctcagtttccccatctgtcaaatggggatgcaataattgtatgtacttcagagatgtgagagattgaatatggtgatgcaggaatcacttagcacagtggatgagagtgcgtttcaccagttttggcttttctagactcagttgagctgggtctggtggctcatgtctgtaatcccagcactttcggaggctgatgtgggaggattgcttgagcccaggagtttgaaatcagcctggacaacatagtgagaccccatctcttaaaaaaaaaattaggtaggcatggtggctcatgcctgtagtcccagctactcaagaggctgaggtgggaggattatttgagcctgggagactgaggctgcagtgagctgtgatcatgctactgccctctagcctgtgtgacagagtgaagccctgtctcaaaataaataaaataaataaataaacaaacagatagttgactgcagtttcctgaccccttgaagtcaggtgcggccatatgcctttctttggcaaatgacatgcaagcaaaaagtgatgtgcatctctcttgggtagatgatttaaaagccagaagtgatttgccacattcctttcccctgtggcagagacagtgagcgcacccgtgctgagacagagctgccagccaagggcccagagtaagtaagtaatcagagcccccacccctctgcattggccctgtagactgcaccagaagtaaacttctgctgtgttgtaagcactgagatattggggttgttagcactacctcaacccaactgatggccacactttagatgtgcaggaaatggtagctgttatgatttttttctcttccttttgtcttctctctcagaggttctgagcaatgatgtgaccgatggtgtcatccgagtcatctgtagcaaatgctacttttggatctatcacctcggcatatggggaatcctgtctgtacagctgatattccacctctacccttctcttgccctatcattttgagagggaagaattgggattaaacactagagttttatcactcattttcctttgcaaaccttaccttgcttatctgtgaaatggatgtgagagccttgtttctatcttttccaggacttattgtatgattggtccatgtatagcaagtattatatacatccctcagaaattactattactgggttttcttgtctaccttttttcccccattcagcacatgatggtcaattttttgtttctttccccccaggatcttggaaacaaagacctcaacagggataaaatttacttgatttgtcaaatagtccgggtcggcaagatggatcttaaggatactggtgcaaagaagtgcacgcagggactgaggaggccctttggggtggcaggtaaggggcacactctgcatcattgatttttatgggagcgcacattttatgtggctgaattgtaatgatgatttgtttcccaaccgcctcctgctgcccccacccctgcaaaatttatgccagacagcccttaataactacatttctggtgactaaatcaaaataattggtgactaagtccagatttatgatgaacacagtgaatcatgggctcctcttgtctggagtagagcatcgggagaccggggccgtctgagcagttgacacctttgctccccagctctgtgaaaaaggaaaaacaatacaggcaggatctaattatgaggagcaaatcatttaaaaagtacatctaggacaggaaatgcagttacacagaatgagtcacctaccacacatctaaattccagatggaaacggacatttggagaattggcgtgacctgaggcagagccctgcatgaggctgctgtacagcaacatcagctctgcattcctcttaagctttagctctcctggggtttctaaggcttcgtcattcttgccccacttttatggttttagttatgtttgactaccacttgtactgttatttaccaaatatagtttcttttaatcaacctgctttacataatgtatgtttttcatcaaaggcgatttaaattcctgtgaaaatggcaatttgatatgccagttttctttttattaaaatataaaattttaagagtataccgtgcataacccctatgtaccatagctaacctcagtgtttcaggtttctcacttcaagatgctctgatctgtaatcgcagacctgcttactctccaactagtcccctggcactgcttgcaaagcggtggagtggaggatgttttactgagctcactgttttttttttttttttaacctggcactgcggctagctagccagccagtgatattgggcaagcattttccccagagccttagttttattatgtgcaaaatgaaggactcatacctggttaattcatgaaatcctctactgctctaaaatgctctgattctacttgtgggggcatttctgacatcatggtgtttctgttaaggcagtaaggatccttcaaccttactgcaaagtgtgtctttgtcctcagctgtagcctgccctctcttttggtgtcagatgacagaaatctgatctaaactggtagaagaaggaaaagaaaaggtactttattggtgtaactgaagagcttatgaatagatcgcttcaggcatagctggatccaggaactcaaatcagtttgtctctttcttgctcccatgtcctcatgctggcttactatgaagaatttgtctctttcttgctcagcccctatgtcttcatgctggcttactaagaagatggctgtccaactagttggcaaattatcagccagctgttccaagcttgcatcctaccaacttagcaaccagtggaaagaatgtacctctttcccattagtttcagcagaagccccaggagctttaatataggtcacgtcctcatctccatagtctttactctgggcagggagagatgattatctgatctaccaggtcctatgaataactttggagccaaagggaaattgccctgccctaatcacagccctgaggatggatgaggagagtcagttagagagaatggatgctcggtttctcctcctgtctgctctctgactcccctctctatctagatgcagtcagtggttgattattacccaagcaattttaatggcccctgcccagtgcctggagtgtttgacgtattttctgtaactagggtatgagcttgattggagtagcttttctcagccctctcctacactcccacttctataatccccattctagtgtaggagttctttaccttggttttgggacctttagtggctgatttaaggaaaggtttcagaggatccaggatacctctggaatcacaggatttgaggattcttcagttatgtatctgtacatatgagtatgcttatgaaaagagggtggatatttcatgagattctcagatcctacagagacccaatcactgctgtctggttttgtaggcatggtagacattcaatacatgcatgtcaaatccaaacctaattgctgaattccacagccacggctctgaccctttccttttggcctctgctaagccatggtgctcttggatgcctccctggccctctgacctcccagtctgctttgcctggaggtatttgccctggtgctgcacgcgaggaacctctgctgtctgagtgttgtgcagcactggcttgcttgccattttaggccttcctgacccccaggcatcccaggctctacctcctgtcccataagctcatcccactgtcatcccttatgggaacaggaagaagttaaaccattaattcattctgtcttctttctagttatggatataacagacatcatcaaggggaaagcagagagtgatgaagaaaagcagcacttcattccttttcacccgtaagacatttcccatttctttccattctcttcaaccacaccctttgtcatcaagggctgctggagctcagagggtaccagttccctgagttagtgataggcaggtggagcctcccaagggaagctcagggtgagaatcactggctcagtgcccaggcactcaaaaccaaacagctcttcagccattcattcatcagatgttatttatgccacagacatttattggtggcctggcagaggctggcactgtgctaggtgtggaggatgaagtagtgaacaagatgggccctgtcttcatggagctcatagtatagatggggaattaaacagataatcaacaaaagattaatgcattaattacaagtgcagcagaaaccacgaagctgtgaagcagcagcatttcaggagcgtgtggcagggaatcctaacctggttctcatggatagacgtatccatgacttaggaggagggcaataagggaggtcaatgtcctctcctctcctgttccaaaaggagtcttccagaaagcagggctccagtttgagagcatcatcagtacttaatagccctaaggatggtccaggtaatgaggctagtgactttgctgaaggcgtgtgataacgacttagcaggagcaactcttgctaagcagatatgcatgttgaaagctttggaatcctacctttataagcatcttcctggagaataagaaatggcctctacctgtagcattgatattcccaaatttcagagccacattgctttgtgataaaaagtgaggtacctcttgatggcatgtatataccctgggctgacatatgcaaactcacttttcacctgaggcgtgtggaggggctggggagattcatgggaccccttgaaacgcaaggaggacacgatgtggacatttcatgctctcttttcctttccagggttacagctgagaatgacttcctacacagcctgctgggcaaagtcatagcctccaagggggacagtggagggcaaggtaaagtgccaatatgccagtgggctgagcctgctccagcttgggagcccctaactcttcagcaaatgaatcaaaatcctgaaccctgggatacttagctttccttccagacagaccactgggaagaatgggaacatatgatctacagggataagtcacattttctgaagaaaattggaggcatgtcctggtgcccaaaagcagagaggaattgatacatcctgaatatctccggtgttccgggggcactttaataagttaccttgtttgatttctttcttaatccaggcctgagagataggtgttgtcatcctcactttgggcttagagaagtgggataatttgccagaggctgacaccgctagaaatcattagcgggattcagacccagagatcgcctgttccagaggccctgtgggctgggtggctgcatctgtggctgtatgactctgttcccagtgatctccagaaagacagaggggagaggtggcgggagggccgactgaggggtcacttgcaaaagtgggctcttcacggtgagctgttcctttgcaggcctctgggtgaccatgaagatgctggtgggtgacatcattcagattcgcaaggactatccacacctggtggacaggaccaccgtggtggccaggaagctgggattcccagagatcatcatgccaggtgagacacagctgctctgaccttcccctggggacataggggccaattcagcttgtctaattcattttccttctaaagagtcaactccttccttttttactgcctctctccatttctgtccctgaaggtaacaactaaaaatgatgtctgtatatccaaaaacttctatgcattaacaaaatagacacaagcatgtaaatataaacacataccccttctccccacaaatggggtcatattttatattcctttacttaatatactttatatagtattctacaacttgtttttatcacttaataatttattgtggccatcatttatattttatacatgcagaacagttgcactctttctgggagaatattgtcattctcttatatttttaagctttttttttttatattaccaaaggaatttgtgttcattgtaaaatattcaaatggcctgaaaaggtataaagtgaaatgttaaaagttcctttatatctttgtctccagaagtagccactacatttccaaatgtgtgtataattttaaaaaatgagtttatataatattaaacaaaaattataggagggcattgttttggactaagttcctgcaccagcccccaacaaaccagactgaaaatcaaaatggagtcagctatgctaaagggtcatgtcatcaaacctaaactaaactgttatctgatcttgcaagaaattcggagaggggagagagggcggcgggcgggggcagggagagagagagagagagaaagaaaggaaggaacgaaagaaaagacaagaaaaagaaggagagaaagaaagaaagaaagaaagagaaacagcctattttccagacaggccattttcaattttcaatgggcatgataatgaagttcctgaagtaacctgatgttaacaatcagtcacttttctatttttctgtttccctgtttcagccttatgagggctataactttgaaataaccaattcactctgtcttgcttctacttccttcaggccttctctgtctataaagccaacctcttctgctcagctctttggaatactgattctattttatggaatgaagcattgcccgattctagaattgcaatagagccaagtgaggtcttcaaactaaatttgttgtaattttgtcttttgacaatggtaatactcttttgaaacttctctttgtgtcttaaacctgtgtcttggacttccgttcacgatggctctcactgactggctgtttctttccacatttgtctggcggttgtctcctagggcctgtgctgtcatttatttgtccatgctttacctgagacttcagttacttgtgtaaccccttgtaggattttctattcctttttttttttctttttgtttttttgagatggggtttagctctgttacttaggctggagtgcagagtacagtggtttgacctcagctcactgcagcctctgcctcccaggctcaagcaatcctcctacctcagcctcctgagcagttgggaccacaggcatgtgccaccacactcggctaatttttttgtattttttgatacagacagggttttgccatgtttcccaggctggttttgaactcctgagctcaggcgatctgcccgctttggcctcccaaagtgctgggattacaggcatgagctacctgtgtctggcagattttctatttttcttacctcccttcctgaagatcctctgcagctccctcctaaccctgtgtccctaggacacatggaaagttgctctattctgctcctacacagtgaaatatcggcagatgtatatgtttggttgttttcatgggacaggatcaattcaattggagctttcctttgccttcccagaaggtgtcactagaggatgaaaattaaatgacttttaatgtcgagaaaaacatggccaattttgagtgtccctacttccctttttgcaactgatttcctagcatcccttcatccccgtgttacctacttctccagcctccctgatgagggaaaaatgctttctctaagcaattctgattttaattaataccaatccaggtgggagagcttcttctcaccctccatcccctctagttagtcagcgtctctcctgctgtaatccacactaactcttgtctctctctccctctgcctcaggggatgtcaggaacgacatctacattactctcttacaaggtgactttgacaagtacaacaagaccacacagaggaatgtggaagtcatcatgtgtgtgtgcgcggaggatggcaaaacgctgcctgtaagggactcactgctgctctgggtgacagggtccgccttgggggcctctgcttgtaaagacgtacttttcctctccctgattctgttgtctaaatgccaggtgcctttgggatggtgttgaataatgtgttcaacaccttttgagcttggttagtgcagtgttccataataagaccttgtgatatttccttacaccaaagcagtttttcaatgtctgttcctttcctttcacaacttcttcttgtatgtatgtatgtatgtatgtatgtatttatttatttatttacttttgcttggtctcagcttataggttagctttctgcagttaaaatgttctcactgaaacctgagctggtttattcaggcaaagtccatggtaagaaagaggatcaatacagtgccttgggctggtgtggaggctcaggatgtgcttaaagcaggcattctcaacacttaatctaactccccagcgctcagccagaaatgctggtggaaagccttattcgtaaattggtctccagagagctagcagggtgtattcaggaatgcaaagcgcattgctatatttatacagcatatgtcctgtccaatatttgtcatgtgtgtttatatttatttgcttgtattttctttaaggttgtcagtgctgtgtccagtgtgtaggagggttttgtttctcagttcctcctgacagagtagttagctgaaaagaaaatcagctctcaggagaaattttagcatgggcgaatattcctcttaggccactgtgagtgatcaaatagccaagcagggcgggtgtgttcatcagagaggggatgtgaagatggaagaggcatcatttttgtccttggggcctggagatcagactgatactttgtacccaagaataactaacattcacaggggaattaccatgtgtcaggctgtgtgatagtatgacacatttcctttattatgccccattttacagatagggaaacaaaacccgtgtcacttacagtaactcgcccaaagccataatgttagcatatgtcagagatggggtttgactggttccaggccctctgagacacttcactacaatgcccgtacatgtagcaaaattctccaatttatttctcattttaaaaaatgaggctaataaccactgctggcaaatttgggaagattcataatcgttttttaaatgtaaagaaatcctcacaattgcctttttgttcataaagactggtcatgttaattagtatctatttgaacaaaatctaagcattgaacgcatcctccttttgttgcagtctgaaactttttccaaaaaataaaataagtgagaaatacttgactcaaaggaacataaaggagcggagggtttttatctgaaagggaaattgcaattcccaaatgtagagaccattgctttgaagttacttttatccaacttccctggtagagaactttttaacctcagcttcatttttgaaacattgatacgcttaccttccatgttgccaaaggacaaattaaaagacacagttaacaggcaagcagccatcttatctcctgtctgagccactctttcttccacttttgtcaccctttcaagtcactaccgagcaggctgagcagatgcacttatccaagatgagtaggtaagcaggtattctgggggctgacatggaaagggaactgtggggcatggtgatgatttgtggtttcctctattagggaaattctgggggagttcagttgactgactattgaaaattgcttaggaagcctgtgggaggcttttctttctctatttgtagaaataaatattactgcctaattaagtgtcagtcagtacattcaaacacttctgtttgatattggtgggctcctgtggaaatggtcccctttagaaatattgatttctcctcctgctctaggtgcatgcacactgtctttggcagagcaggaccagagggcagaggaggttaggcctgctcatggctcaccttggggtgtcaagggccttgctcaggaggggtcatagcagagaagctaatggggtgggctctggggtcaggcagacagggttcaaattccagcctcccctcatattagctgtgtgatcttaggcaagtttattcatgtgtaaaaagaaataataacctcttctcgtggggttgcaggttaaacaaaagagtaggtattaaaacaactaaaagagtatgattggattgtttataacacaaaggataaatgcttgaggacatggatccccatcttccatgatgtgatttttatgcattgtatgcctctatcaaaacatctcatttactccatatatatgtgtgtgtgtgtgtgtgtgtgtgtgtgtgtgtgtgtgtgtgtgtgtatgtgtatgcacacactatgtgcccacaaaaattaaaaattttaaaattaaaaaattttaaaaataaacatgctgctgggcacagcggctcacacctgtaatcccagcactttgggaggccaaggggggcagatcacttgaggtcaggagtttgagaccagcctggccaagaaggtgaaaccttgtctttactgaaaatacaaaaattagctgagtgtggtggcaagcacctgtaatcccagctactcaggaggctgaggcacgagaattgcttgaaccctggaggcagaggttgcagtgagctgagatcgcaccccagccactccagcctggccgacaaagtgagaccctttctcaacaaacagacaaaacacgccataggtataaggcacctggtattgcagtaagtacccagcaacaggaaggagggtcacattcagagaagaggaccaagtgcagggtgaagccctctgagggacctgagggagtcaaacaggcaatccagccagaagcaaattctggtgaaagagaaaggcttagatgctgggccaagaaacctctgtttttctgagaccacccaacttgaggcggtggaggcaggggataggggaagtatgggatagtggttaagaccatgacccctggggccagacagccaggtgcaaagcccagctctgcctgaattagtaagaggatgttgaggcagttacataacctctctaagcctgagagtctctgtctgaaaataggaccagcaatggcactttgctcttgtgaatatcagatgaggtaatctacataataggtgtgcattaaatttagctattattattagaagggtatactgagctcccagcctgattcctaccttaggcatgctaatcgacatcccatgatgtggtcttgtgagaggagaacactgtctttcctaaagtgtgttcacatccctggtgtcatctctttctcacctgattcctaccaagtaaacaggacatgtgttaggagcctggtttttcttcctgcagagatgtttcttctaaggccaagccaacatgaaagcctccaggcttcctgatccatactcagattttcttcaactgacctgaagtctcccacacctatgaggggctctcactgttaattgggggccatggggataggcaatgtagaaaattatggaacagtgttatttgagatatataccagtgtatattttccctagaactgggctcagtccctggtcacaatgctctctcagtgcacttcccaacactgttatttctctgaagtgctgaggcctatggcactatctttggcttttctctgactggtactgagacttttttctccagccttaggaaatcaaaaattttcatcatcagtacagttttgtgagatccagttgcctgccatgcggcagttttactttcaccagagatatatgtgtagtttctgatttggtaagctacatgggatttactgtaactacagaaactctaagcccataaatgtcaacagatataaatctttgtaggctggaaggcatctaggttcttatagaaggaacactggatgagtatttagagggtctgtgatgttgtcctggctttgccactttttgggcaagtggtttaatctctcagggactcaggtcacccagctgtgaaatggggatgctgacagtaagcatcagaggtggctatgaggactgaattaagcgaggtggtgtgtgtgcagggcttagtgtgatgctggacacaaagcccactctaaatggttagaaagactttggaagcatgtttttagctcagtgcctcgggaagttctggaaggcttcatcccatggaaaaacaaggagagctgtgtgtcttcactcagttctggttcattggttacacttgtttttcttttaaagatacattctgaaaggactgctgtgtattctgttttcaaatggatcgatttggctgcaagtactgtcagtcaatattgaaactgagctcattccttttccatacctcggaagcacaaggggagatttccagtgtgaagggcgagtcttcctttccccaggttagcatggttggccagggctcacggagtgcctgtatgtggccagctttggtgattcagcctgctgaaggtcaaggacccacgggagaatctgattgaatctcatgagaggcatgactcgctcaccatcaacatgccgagaggcacacagtttgcaatttcaggggctggggctccaaaaccaaatcttatgaatctggcaatttgaggattgaaaattgtttggcctaatataaaaaccacacttcgggccccttctgggtaatcctagcttggatcttgtttgggggccaaacggctggaatgaccatagaagtaggcattgttgtatgtgaccaggaggtcattccttgtgagtcagctcctttctgaacctctgagggtgatttttatggcaaggaataaatgtcccacttggacatgtgtgctctgtgctcactctctgctcagaaagcccctcccacatttctgctgtgtgccaacttggaaactttcttcaagattctcaactgtcattgcctccaacaaatcttccctgattcctcacctgtccttgtgtccttcctctgtgcccaacagtagtgtgtacacatgtctgtcatcacgttgccttgctgtcatgacgtgttccctaatgtttcctgcacaaaactgtgagctcacgtcaggttcaatgtctgacccattcctataccccagtgcacagcatggagtaccaagaagatgtttccattattgtgacctgaactgagcctcctccccggaaccccctcaccccagacttgttctttaaggcaggtgctcatgtgtctctctgaagcctgtgctctctccttttgtccagcactgcccaccgccctgacgtgttagctgtagaaattcatcgcaaagagttgctgcttggctgatctgagcctgttagtaaactttctgcacattcacatttaggaaacaaataggattaataagactggcagtgtgcagtaactccaaggctggttgtcacttacagtaaggcagccacatcaatgccctggtgcactccagtggtttccagaatggaagtaatggaatttctgtagttaagtgcctgtcagtcctgtggctggggcactcctgtgtaaatctgtaatagagaaggagccattatgggcacctggcatgagggctagggaaggcagggttggcccaggccctaaggctggtcgtggcctagggaccaaacctgcacaagcacagaaaatgacaattctgtagtcttttccctcactttgtttttcttgggtcagaatgcaatttgcgtgggagcaggggacaagcccatgaatgagtatcgctccgttgtgtactatcaagtcaaacagccacgctggatggaaacagtcaaggtaataattaataatagcagcaaacacatgtctagttcttaccatgaaccaggcactgttttaagtgctttatttaaataatttatgtattgcttacaacagccgtgtgaggtttgtactaatatttccttcattttatagttgaggaaactggcactgaacagggaagtagcctgaccacgaccacgctgctaggaaatatcagagctgggattcaaacctgagcagtctggctctgggtctgtgctcatccccgcaagctgagggagcagaatactgactggaacaattagcattcttcttttttttttttttgagacagagtctcactctgttgcccaggctggagtgtagttttaccatctctgctcactgcaaccactgtctcccaggttctagtgattctcctgtctcagccccctgagtagttgggattacaagcgtgtgccaccacaccaggctaatttttgtgtttttagtagaaatggggtttcaccttgtaggccaggctggtctcaaactcctgatctcaagtgatctgcccaccttggcctcccaaagtactgggattatgggcatgagccaccacacccagccttcttccttttaatgagagcagttgagcaaggcagttctgtgcatagaccctaggcccagagagtctgggttcgtattccagccctaatgctcaccaatggtgtgaccttgggcaagtcattcacctgctctgtgccctggtttcctcacctgtaaaatgggagcaataggttgactgtggaagtaaaaggacttaatacacataatactgtcagacaagtccttggaagagagtacttattcaattaatacaactcttgattatacttggcagttatctcagtctgcaaaattgaactagattttgcattccttcaagatgcccttcaaacacttgacccttgcctgttttttaaccacccctctacaggcagtctaattggtagtggcaggcagctttgtgcctctctgtgtagttgtggggagaaggcagagggaaggtatagttgttccagatatctgttgcagtctccctccaggtccttctcatatggcatctccccgcaaaatgttttgtggaatactaagtggtgttttattaaaataacgttttaggccaggtgcagtggctcatgcctgtaatcccagcactatgagaggctgaggcaggtggatgacctgaggtcacgagctcgagaccagcctgggcaacatggtgaaactctgtctctactaaaaataaatacatacatacatacatacataaatgagtcgtgcatggtgtcatgtgcctatagttccagctactcaggaggctgaggcatgacaatcacttgaacctgggaggcggaggttgcagtgagctgagattgcaccactgcactccagcctaggtgacagtgcgagactccttctcagaaaaaaaaaaattcatacgttaaatgtattaaaataacatttcctggtcaaatgtgagaaacttgagaacaaatatagaagttaaaggcttccttatgtcaagttcttagagcccttgagatgtaaatgtgctctgcagacctgcaaaaggaaataagaatgcagagcacgtcccaaaactcgttgactaccgagcattttcctttttcctagtgtcatatcctggggctaggattctgttgaacatattttagaaattctttgttttagccaaagcaggtgggaggcttgatggatcaatgtgattgtgaacaacatatgagaatatattatgtttctcttcatgaaatatctaactcaattctgaggccagtcatgaacatactggagggacatagagtgacagaaaaacttctttagctctagtttatagcagaagtcaccatctgtaagagcttagggtccttggaggcacctctctgaatctgaaatgaccccctagcatgtgtctggtggtattgtcagccagtggaaatggaggccaggtgggtgagcaccctggttcccttgatcacccttccttggtgcaggatgtaaccaaagtggaattgtcaaatagtcctcttgtgggtggtgcccagttcatcaagctgcaccattctactcagcaatgaggagtgacagagcttgcaagccaatgtgagcctatcacaggctgtataatgcctgaaagatgcccttttggaataattccttgacagaagtgacattaactacaaatattacattaccagatcgtcacactaagcagaaaggaataacctgcattggaataaggatttggaattaattcagtgaacactgcagcttgatcatagcttcagatatctctgccttatcattagcagcattctttattccccccgggctctgactccaaacacaagatgcacacttgacttccttttcagtgagagctattcaaaccccagcggttctccacttattacacatattattactttgctcagtgtgtctccccatacccaatgccttcgaattgatgacccggtcaactctgtggtcagaaagttaatgtaccaggtcaggtttcccttctctgttctctcttgcacctcagttgtatctccttgctagcccttgtcacagggctgttacacattgccccatgtgtaacacggaacaatgagctctttgagtgtgaggactctgccttgtatcagcatggccagcaccccacatgattgtagcttctagtgaacattcaacactcagggaaagaatgaattggctgcagttacccatgagaccctcagttcctttgctctgcctgaaacatagacaggatggtggacctcctcaggctcaagcctcattttctgcaacagaaagtgcccccaagtatacatttgttttggcgtttaataggcatctgtacagtacaaatgtattcctttttaaaatcagtgtccttctctcaggtagctaaccttctccgcattggcctgaatctcagattgcagaggagctgtgagactttgggaggtgggcagcacagagccaggctgaaagcatcacaatcagtggtaccagtgggtcattcactggacagggatgcctgggtgaccagtgggttgttgtcttagctcagtgtccttggaatcaaaaacatctggacatgtgtctgatcaagggtgagatgagccctaggatttttccaaatattattggattaaagcatttttattaatttgcataaatgagattcctcaagcaaaccccctaacaaccattgttaatttgctaagccctgctgcaattgccagaactcctggagtgtgtaaggaaaatgtgcattgtgcagtttgcagtgcatcaaatcctgtgctaaagttatgtgacttttatatcaatttggggagactcatttttcctcactataatttacagacctcttttcattggctgggaatgcaatttgccaaatggattacatttggtactttattttctcttcatagctagttcttctgtaatttatttacagttcatcagcctcaatggatgggttgtaaatcagcaggcagctctctcagttaaatggtcaggctgctgtggaagtgtgtaggggggtgcagtggggagggccctttaactcattgtgttctgagctctgtttctgtctgctgaggtggctgtccctattgaagacatgcagaggatccatctgcgattcatgtttcgacatcggtcatctctggaatgtgagtaccatactgaatggcatctctgcacctccccctaaggggagaagaatggaagagctgggtggcccatgtatcattttctttcctgaccccacaatgctatttccagctaaagataaaggagaaaagaactttgccatgtcctatgtgaagctgatgaaagaagatgggactactctacacgatggattccatgacttagttgtcctcaaggtaccatgagttggaaggagctctgcactgaggggagtgcaggaagaaagggggtgatggcaaaattgcttagtggtcaacagcagggaccccagaatcacacacaccagagtttaccaactttgtggcctcttataaactcttgacttctctgggcctctgtttcctcatctttgtgccctcagtgaatatttgtgaaaattatgagacagtggatgtaaacatagcaatgatgagtacatggaagaactcaatacatggaaaaggttattgttatttacagaaaggttattgttaatgactgttatatactcttgactctgtagggacctctgtggcatgtgtagaggatgtacaataaacatttgagagatgctgcattgtagctaatgggaaaatattaaaacctgcagtcctgatcctgctgctgactaagcctggactcatctcacatattttcctgagtctcagtttcttttttcttaagcagttgtggcaatatttatgacaacccactaggatgacccatgaaaaatggccatctaaactataaagggagtgcagatgtccactatttttatttttacattatgagacttggactgtttttgagacatggaggagcatttgtctggtttttacctgctgcttttccacatgtcctcttatgacaacagaatgcatctactagcacctggctggaggcaagtgtatggctgtgaggtggagcaaggttgagtagccagcacatggatcacacccttgcccttggctttcttagccttgtaggctgaaattgcccttttgcctgtgggatgcatggcaaacacagcctcgtcaaggcttcatctcatagtactcttgtactcttctctgagtctctctgacttttccagaaaaccccctttcttctgtacagcctctgttttctcatttatcacacatagaattcttggcttgaaagcccttcttccctgacagaatgtgaactccttggggtcagaggcctagttgcagtcaattttcttttacttacccccattaggtcccagtttccttgactgaggataataacagtgtctgcttcatatgtttgttatgaggcttaaatgaaatgaaccaagacatataaaacacttggtttcactcctggtgcggagtaagataaatgttatcttctgtaatgcctacctctagtcattcattttaacatgccactcatttatgtgtgtatcactctgctatgtattctatatgcattattccatattatctgctcaggtattctaggaagtagggatgatgattgtcttcagtttactaatgaaaaaaaaaatgagacacaaagaggcaaaatagtgtattcaagatagcatagacctgtgaatggcaaaacagggtccagatcccagcacactcttacttagtgcctttgccattaaattcctctttaagctagagtccttattttgctggtgagcagatattatggtctcaaaaaaaggatgaattaaaatgtactgtctgggaattttcaattccgtttttattttgccattaatgaggttcacagagctttcacctggtggatcaaccccctttctattaatgtgtctttgaattcttacctgtattgtggaaaaacagtcctgcctcaccagccaatgtctattgcttctctgatgattttcttcactctttatgactctccccacttcacagtgtctaatttgtctgctgcaggctctgtgtggcattgggcatggagccttggcttggggcagtaaccaagtgttgtttccagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatggtaatcgggtcatcaagagttgtgtctgtggggagtgtgtgtgtccgtgtgtgtgtacatgtgtgtatgtgcttgcagacccaaggaggtcctgatatggacagttaggccagtaatgatacttctgaatgtctggactctattttagtgggcttgctgggtttgctgaagtggcgtatgaagcctcaactgctacaggagaatttagaaaagttgaagattgtggatggagaggaagtggtgaaggtcagtggggcttcattttgattgtattcttacactagtgacagaactctccatgtgggtggcttcaggggaaaaacaaggtattgaaggacatggggaaacttttcttccaacagtaggatacactctcccgagttgccttgaggaatctttattgggaaatccaggggagtgacttggttcaatggcactgaatgttgggtgccagaaaacaatggttatgctcaatctctggaaatagatgagcctgggtgtaaatcccagctctcccacatgccaactttatgtgataatataaaagtgacatagttctcagggctgttatgagcattcaaggtgataatatttaaaacttactcaacagtctcttacacatagtacacaacaattaaaccaaagcatataaaacaaagttcaataaatggtaattattatttttgttgtcatatgttgatatatatgtatatgcatatatatgtatgtatgtgtgtgagcatatatatgtgtgcatatgtatatatacatatatatatagtagtatgatctgttagtactacccacagatcattgttagaaataaaaagtattcttggtttctgctgcttggagagcattatgtattaaagacgggaaagggaaagacatcagggcttacattttaagtgaaataagcagaaaacaatgcaaatgtcagatgtattattgcatccacatggtagtggagaatagaaagcgtctgaagtgcaaatctaattaaagcaacccttctctccagccttatgaattgggacaagtgtttcccaatggtcctggagatcttgtttccttgatacagctagaaattctgagattaaacatctttatatggtagctctgtgttttgagggattataggaaatattgacccatcccttaggagggaggaaaatcaagttttatttaattgcctctacctggagaagcagtggcagaatttccagatgccgtaaatgtataccactgacccatctacctcgttcagcaatggcagagtaactccccaagacaccactttaataaagtctatagccttttggtagcttggagaagtcatggaagagatgaggcttttgttgtcttcctcttgcattcttttttctttttttttttttaaaaaagtttgttatttaaatatgatatacatatgatgaaatagatacagagcagttatcttaagagtatagcataatggatttttacacacgtaaacaccatgtgtactcaccacccagaagaggatacagaccacttttagcattatagtagattccctcataccccttctcagccagtagtcccccggggtaatcactgtcctgacaaccatcattgtagatgggtttttgcctactctcaaatttcataagaatggaatagtgaagagtgtactttctgtgcctgatgtattttactgcatataatgcttgtgagaatcatcctcatttctgcctgtggaagtagtttgcactttagtccagctgtgtagtattctctagtgtgaacatgccaccatctgtgcatccattctgctgttgatgggcagttgggttcctccaacttctggctctcgtgagtaaaactactctagacgttttgagcatgacatgtggtggatgtgtgctctcattctcttatagatagttaggagtgggattgctggttcacctgtactttgtcttgtttctgaagtagtgcaacctttgttatttcttccagtttctccaggatactctggatgccctcttcaacatcatgatggagcattctcaaagtgatgaatatgacatcctcgtctttgatgccttggtaagagagaggggaaaagtgtctagtgacaacaggcattaatgtatgtcttactgtgaaaatactgagaactcatggccctcatggccctcatggcctttttcatgaattctttggaggtgttgtaatgtttggcaacaagaccaataatgagctgctatttccttttgcttcttgccagttcatttgaaagcatgaggcattgtgggtgaaaggggaattttaaatgctgatgtcagattgacactggctgaaggtacatgaggctggatattgtgaatgattgcttctgctttctatgaatgttgggagctagtccctggctaggttgtaaagcaccaaaaatgtttcttagctttcctttcaccttcttctccccatttcctccaactcactaatcattacatttctcctacccacccagaacttttcatgatgctgtaccatccagatcttccttcttttagtcctcccctatggtctttttgtcctctccctatctcgactcagattttctcagtgttatgtcaaaataaacacaagaaacatctgcattagggaatcagtgcccaacaaagtttttaagtgttaaccccttgtgtcatggatatttgcatttttaaagaggttactgagagacaactgtggcttaatcaagtgcttccccagagagtaccctagaatgctagctctcagaaaagatgtttcatgacaaatatatactttgattaattaatttagggaagtgttgaatgttgcatgacccttttagagattcacaatgtacataagtatattaaagattctaaaaagttttgcaataagaaagtctaataatgataacctgacatttctcaaaacctatttgaccatgaaatccttttcatcttataacaccccacagcacacttcatgaaacattttctttgggaagatgctaccttaataaagagaactcattatgtattagtgagctaattcctgggcaaaggattttaatgggggttgaattatgccaggtaaagatggcttcctgccctgggtttgccctgaaaatactgctgccttgcatcttcctcagatttacataataggactcattgcagaccggaaatttcagcatttcaacaccgttctggaggcttacatccaacagcatttcagtgcgaccttggcttacaagtaagtaattgtgcacatgggaacttcttctctaccaccctcttgccctgccaggatgcctagggcacaggaacttgagtaattttcttttgtgactcatctgtgtgagctctccattctctaacaaaatctaacctatgcttgggttatttggatatcattaaaaatgtggaatacccataggtttggatgaatgccttatggttgcagtggtacctggaagtgctcattcatccattcagctagcgtgctctcatttcttgagtggacaccaggacttaaaggctacagagaagaccaggtgtggtggctcacgcctgtaatcccaggactttgggaggctgagataggtggatcacctgaggtcaggagttggagaccagcctggccaacatggtgaaaccctgtctctactaaaaatacaaaaattagctgagcatggtggtgggagcctgtaatcccagctactcgggaggctgaggcaggagaatcacttgaaccctggaggtggagattgcattgtgcagagatcacaccactgcactccagcctgggtgacagtaagactcatctcaaaaacaaaacaaaacaaaacaaaacaaaaacagcgggggagctacacagaagaaagtgcacatgccaagtagctcagtctggtttgggtgtagggagagggtgagagataggagatgatgccacagggagtttggtggggaccagtttgtgaaggggccttgaaagtcaggccaagtaatttgaagtctgccctatggtaaagaagaaacatagaaagttcctaagcaaacttagagttctgtgatattacaagagcatgttctatagaaagaaaaagttgaaaaaaaagacattattgccaccattattccccattattcccacttgtagcctgattgtgactagttctcctagtcaaaagatttttttttcctccctatctttttctttgctggctttttatgagcaggaaatacttattaattccctgtaataaatataatttttatgcagagttatctttatgcttacaaatgagtaagtgagcttggctctactaccacctttaacctttgattgaatgccttataatttactgagcaaactaattaccatgatgaaagagatgtattttgaaaatattatcccttattcaggaaattgatgacagtgctgaagacttacttggatacctccagcagaggggagcaatgtgagccaatcctaagaacgctgaaggctttggaatatgtgttcaagttcattgttcggtcgaggacattattttcacagtgagtacttgttatgtaagagtgattgattagctctgcaattcctctgggatacaacagtatttttactgtaggagaaactcgtttaaaaaattataaccagctgtcgatcaaaaacagctcaagaatccaacctagagagtaatgaatatgtaataattgtaccctctaagttcatttgggaaaaaaaagaaatcttaacaggttgcagagttatgtttaaccagtaaatgtgatttgaggctcttctgtgtttcatctaacattcttcatttgatttgaaatatggtgaacattttccagcaatctatatccaatgttagagggcctgggagcaggaagggcagaactcagggagtctgacatttacttggctcttgtaggttgtacatggccaataagctggtatttgcagttgacctgtctgtccttgagatcctagtagccaaaaagtgagctgatgtattagagtaccttagaagattttgatggtcagtatcacagaggccagctgcctttttgaagggctttggagaggaaggtattcaaatgcaatttatagaagaacaattcatgttcatcttggccatagggcaaagttaggtagaggattgtttgtgtgtaatcaggttggttgtgtgtgatggaaaataagaaaaacattcaaggaaagtattgtctggattcttagtgcaaacaaagaacacgcaactgaaactgacttagggagaaatgagactttatttcacatcattgaaaaaccaagggtgtagtcggcctcaggcatggctgagtccagatgctcagcgttattgggatagtctctgtctgtctagatctggactctgctttctttttgttgattgtcttataaggcaagttttccgacgcagaggctgctagaatcctcaagtttacattctaccagtggaagcaactctatgttccttgttgtcctagcaaaaccctatgccaagaactgttttgggtcttgtatagttgtggtcatgtgtgcattactggagtcatagccaggtcagccacttatggtgtggacttgttattttagagatgagttctcaaaagaaacttgaattagcctgggcaacaaagcaagactctgactcttaaaaaaaaaaaaaagaccatcattgtgattgtgatcatgacaatggatgggctgctaaagctttatatttgacagtgcatctgaaacaggcaatcatttgggattctcttaacacattctttgagatttcaggttatgaatagaaagatgtgagtgtcttgaaccatgcgacagaacaaatgcacttaggtcattctgaaagtgaagtgtctgtttcagattcctctggcttgtcatttagtcaagtctgagtcgggtattctaggtttgagagatacttctcagtgatttgggaaaaccaatgagactccagtgaatctaagagtgattttcttggaggagttcaagaattcagacattgcagttacagcttaaaagtcaaggatatcttatcccatcttccaagtgagaatgttttatgtataagtagaatatgtcttttctacttctcagaccttttcagttcttccttttggtgtatttattttattgcttctcctctctcctatatttctttccttttccatcccttcctccctccctttcttccttccttccttccattttttccttccattttcaaggattgagcttctttacaaagcctcttgcagtgcctgaagctcagacaaccagctgcgctaatcctcaagggttctgagcttgtggaattatacagagtttggagcaggctgagcttccctgttccatgagatggacactgagcggctccccttcctactggaaggcacatggagatgagactgcagagcttctgttaagataactctcttatttatttattaattttgagacagagtcttgctctgtcactagagcaatggcgcaatcacggctagagggcaatggcacaatcatggctcactgcgatctccgcctcccaccttcaactgattctcctgcctcagcctcccaagtagttgggattacaggcacgcatcaccacacccagctaattttttagtagagacggggtttcaccatgttggccaggatggtcttgatctcctgatctcgtgatctgcccacctcggcctcccaaagtgctgggattacaggcgtgagccactgcgcccagccagtataactctctcatgtcttacgtctgttagtttttgtgttttccatctactgggacaaaatacatttgtgcatttgttttgctcttctctgcctcaaggcatataatcttgcagaacccctaactctttaactggtgtaaattcagtgctgctgtgacgtaaatgctaagtgacttttggcttattcaggagcagggtgatctgttattccttgctgtatccctagaatagcagcacatcactgacatttggtcaggagaggtctctaaagcaacccaagcctaatcttgaatccttcctcatgaacagaaatgtaggctgacctgcaaagacggtctaggacctcatgctaggagaaggtaggttttgtgtcttgttctttttagaatctttagcaatgatctgctctccagtggagtctctagggcattgggaagctattggggtatttctccatacgagggggcatcttctgtgggaaactagaaaacagaagtttcaatgctttgagatgtctaacccagctgttgggaaatcagaattgaattattggtttggggctaattgtatctggtattgtgtgtctgtttcctgtgaatcctttattctctttccctgcttgcataactgcagcggatctagctcccattatttgttcccttgccattattttttgcacatcctgcccaggaacacttgcaagggctaaggattttcctgtgtcagtatgcaacgtatagttgggtaaggaaagaagagtcgttgtggagaaggggtggaatttttattttactatattgttcagaaggattcatttttatctatagccaaagaaagaagagagtgagttccttgtccctcgcttcttgtgtcactagctcctgagtcaaagtctggatcaagtgtctctgattaggcacatgccagtgctgtagctgcaaaggaagctggcagagcaggttctagcttctgccacagggaggcagtcttatgagtaattcctaaattataggaagtgtgtctgaaagatgctggtggccataaatatgtccaatatccactaggcttttgtagaatgactgagctcctgggaggtattgagcattgtaaggaacattcagaaagagttgaagtgataatcttctacgattcagcttctttacaaagccccttgcagtgcctttaatcctgaagctcagacaaccagctgtgcagatgcccaaggtttctgagcttgtggaattacacaaagtttggagcagaccatgcttccctgttccatgtgatggacactaagcagctccctgtcctactggcaggcacagagaatcagactgcagagttaggataactctctaaaagggagaggaaccagaacactgtgctgcaacaggagttgctcccacttgtctctgctcctcacagatcctcatgctgccccaggctagagtgcaaggggcagcatggagtaagagttatgaggagatgttcatgcaggacagacaatgggtatagtggtatctctgcctctataagtacctgggttagtgattgaatcagcctctctgagcctcagcatcctcatctataaatggggataaaccagttcattgtgtttcaatgatgaaatgagattatgggtacaaagtgctccatgcaatatctggtacttatttcataaatttaataaatgttagctggtatcatgttttcacttaggagaaacagcaagggtgcttttttcaaaaactcagatttaaattattaagaagaaattccagggtcttgattcaagcttaaaatttgacttactactcatactatcctaaacatttcttacagtttatttctctggaggcagggataacttttaccaggtgtctgtgctttttgaggaccacaatgtggtactctcctggccccaggaattcacgctggtctactgctagccctcactgggtggtcctgattctgtgtgttgctcttatttcctctgtgagtgtgatcaggcccctctggccagagcagctgtggtgcccgggtctctggcccctgcttgctatgcctgcttttctttgcatcctgccttctgctcttattacagacctgcttatttgggtcttgcttccttccccatctccatttaaccctgatctcctgcttccacaaactcctccttcaccagccccagctccagctcatttgcttatgagaaactgccagctcagaggtgaaaggcacagtctccaaagccaagtctgcttgggtgtgaattctgagttggaatcttgccattacatttactagcatttacaaccttggacaaattatttaatctgcctaaagctcaatttcctcatatgtaacacggtcataatagtacctaccatacagggttggtgtacagactaagtgagcccaatggatgtaaggtacttacttagcacagtgctggtcacatagccagtatacatggttattcacttatcatcttcagcagtcttcacaaaaattctacggaggaccccattttctgactttatctcctgctactcctcactcactttgtgccaaccacactggacttgctgtggctcaagctccttccttccttgaagacctttgcacccttccccagatccatttgttaactccctcaccatttttatatctttgctcaaacctctctttcactaccctatttaaaattgcaacccctgtcccgagcactgctgatttctctcttccttttgatgtctttttctccccatagaactaaacatggcatactatatagtaatcatgcttttgttgactgtcccttccttgctggaatgtcagatccatcagtacaggaacctttgactgttttgtactctgtggtacactaaagcaactagaatgtagtaagcactcattaagtatgaaattggacaccatttctagccccctttcacaaagaaggagactgaggcttagagtcaagctcaatgatcacacagctaagaaatatagcagagtgaggctttgcactctgcctcatctgatgaagcaaatgtgagaacctgatcatttttctgggccatgcaaatgtgaagtctggctggccatgttgaggggctgtcctgagggagggcgactctgactggaggggctgacgtactgagtgacattaggggctgctgagaggcacatggctccttgggtttcagtgctaggaagcatggtaacatccctaagtgcagtaggaattctgcaaacaacaacaacaagatgagctggagcaggagtggtcaggaaaggcatccttgctgttatagtgaagctattcaggcaaatgtgactttgtcttcatccccagggaatgaataaagaaaagttgacacagggcaggccaggtgagctcacactccttgggaacaagtcactggttggggagagaaaaattgcactctgtgtcctgatgggagcttcagcacctggaagcttcatcctgctccctacccccgagagccgagaaagcctgccctggtgtgcacagttccactggcctgcactggagctgccaccacattaacaagggcatctcaggagcatggttcgcagctcagcgacgcctccagtctagcttacctcacccagggccagacgtgattgccctttctctaattgccttcagcatcaatgaccagaccccagacaccggctttctggtactttcttttgtcttttttttttttttcttatttgcctatttatttattccgtgccaccctaccaatcaacctccaccttatcccctcccaccagctcagtttcttcctatgtaaatattgcatagtagtttaccctctaggtcatgaatatgttaggcagcaagattgtctgaataaagctcagggcaagtcagtgtagcttgcagtcggagggagcacataagcctctgccttttgaaacaaatatgaatttaactcagaggtgcttgccagtgtgatttgtttttattgttcatgtatgaataaatattaaaatgtaatcatctgtttatgccgagcatgagctgaaatgcctgtgacattgagattcctgtttcttctgcgtgtaatttgtttgcatattaatgccatttatttctgtgtaagcctctgtttttggttttgaatataatttcactttttgaagacagtaatggcttagtaaactgaacaattgcagttaatggaactattttatgatagcattaacttggcgtcagatcaggatgaaagagaaaactgtcaccgaaaggatatcatcaaacagtgacttctctttattatttattttatgaattgctgcagtactcagggaaagctaaacagcctttctcatgaacatatgtgaaagtggtttgtcaactgttaagtaagttgcctgattataacatgaaattgtgcatatgcatgagctgttttttctttttatttatttatttatttattatttttcttttttaaaattatatcttaagttctagggtacatgtgcacaaagtgcacatttgttacataggtatacatgtgccatgttggtttgctgcacccatcagctcatcatttacattaggtatttctcctaatgctattcctcccccagcccccaacccccgacaggccccggtgtgtgatgttccccaccatgtgtccatgtgttctcattgttcacctctcacctatgagtgagaacatgcggtgtttggttttctctccttgcgatagtttgcttagaatgatggtttccagcttcattcatgtccctgcaaaggacatgaactcatccttttttatggctgcatagtattccatggtgtatatgtgccacatttttaaatccagtctatcattgatggacatttgggttggttccaagtctttgctattgtgaatagtgctgcaataaaaaatacatgtgcatgtgtctttatagcagcatgatttataatcctttgggtacatacccagtaatgggatccctgggtcaaatggtgtttctggttctagatccttgaggaatcgccacactgtcttccacaatgattgaactaatttacactcccaccaagagtgtaaaagtgttcctatttctccacatcctctccagcatctgttgtttcctgactttttaatgatcgccattctaactggtgtgagatggtatctcattgtggttttgatttgcatttccctaatgaccagtgataatgagcatttttttcatgtttgttggctgcataaatgtcttcttttgagaagtgtctgtttatatactttgcccactttttgatggggttgtttgattttttcttgtaaatttgtttaagttctttgtagattctgcatattagccctttgtcagataggaagattgtaaaaattttctcccgttctgtaggttgcctgttcactctgatggtagtttcttttgctgtgcagaagctctttagtttaattagatcccatttgtctattttggctttttttgccattgcttttggtgttttagtcatgaagtcttatgcatgaacttttaaatagttctctgttccctttgcctatggaaatattagtaaatatttattgggcacctattatgtgctaggcactttgttaagtcatggggaccctgaaattagtaagtcagccttcctcaagtattggcaatgtagtggacaagataaacatgcatcccagcaatcaaatcacagttgcctgggataagcaatgatcagtgatgcaatatcacagtggaggcctggaaattgttcttgtgggagcagacagatttgaatgacaaaccttaccttgggaggatcagtaattcttctcagaggaggtgatgtttcaaactagacattgaaatgtatttaagaagccaggctagccaggtgcggtggctactggagaggctgaggtgaaagaattgcttgaactggggggtggaggttgcagtgagctgagatcgtgccactgcactccagtctgagtgatagagtgcgaccctgtctcaaaaaaaaaaaaaagaaaaaagaaagaaagaaaagaaaaggagccagtccatgggacgaaagagactctctaattctaaatacaatctgtgaaatagaacttccaatgactcctgcttctcttcagtatcatttatgaagcctctcctctgtgcttggccctgcattgctttttactccacctcacttaatacaacaacgctgcaaagcataggtattatgatgttcattatataaaagagaaaatgaggctcagaaaggtacagaaagtgactccaggtcacactctagatgtcggcggggagggatctgacactcaagctgaggttcttgctgttgtgctgtacccacacacgaatgtcatgtttgtggagaagagtagctagtgaatgaagccgtggtggtggaggggggcctgatgcatctggagaggtggcttgaagctgaattgtgaaacaccttgaatgtcagacccagcagcttgacgtcatcctgtatccagggggattttgatgtagatcctaccttttactcttagagagcacacagtgagtgccccagtaggtgtacacactaagctattgggatcagataaaactattaaaattattttatctcacatgaagacattaaacttataaacacttaatttagactagcagatggatatcatttataaataaataagcatctattgagttttgtgcttaaaatgaaaaaaaaaatttttttctccaaggagcagtttggaaacttctgcttttggcggtggggagccactgaagttctaaagcaggggattaacatgattagattcatcttttggatagagtactggggaagaaaggttagttcgtggaagatgagatagaaagcaagagatggagacgggtgatcaatggtgaagctatcacaataatccaggcaagagctcttgaactaaggtagtgacggtggtactggggaagaggagaggaagaagataaaggtttacagatgaggagatggccagaactaattgaatgtaggaatggaattcaaggagagggccaagccagatgatctgactctggactttctggtccatttgacctggcattgcaaaccagcatgagaaatacaggggagtagtgggtttttatagtgtattgggtttgggacataaaatgtttgaggtgtttattggcagaaccggatgaaaatgtatagcaggcagttagatacagattaggagttcaggagaatggagacacagttttggttgaaattgatccaaagagatatttgaagctatagcacaaggtgagtaatactataaaactcagaatgaaacccagggagtcagcccattgaagggatgggtgaaaaaagggtcccactgaaagctggattagggacataggataacaggcagaaaggattgtcattccaggaaccaggaaggacagtgtttcaaggagggagtgtcggcagtgtcaggtgctacagggagatcatgggactggaaactgattagaggcatgatattttgcaatagaaggtcattgttaagttagccaaccctttcccagagcttagcatctttcctaatatctggtccaaaggccatcagagcaaggggtcaaagtttgaagtgcatttgatttcctcttatctgtttgtgaattacctacatttggattgcctttttccagggtgtaatcctagactgacttcccccatccatccttcagaatctggggaaaatttcatacttcactcatagcaaagcgtaagacactggtcttgtctgcttccacctccctttaaatggtgtggaatgaggctatcctgtgctgtagacaattaagggtaaggctgtggaggacacagatattcattcttttaggttgaaatggtaaactatttcctctgattgttaactcattattggaaatctgggagctagattgctggttgaacccttgcctgagagcaaagatggctatttctgtcaaatgctgaggctgacagttgctcagagaatgacttgggtgggagagcaatttactgaataaacgtgtagatttagaaactgcatttgcaaatcccctgtaacgaaatatgaacataccggataagaagggtctagtttgccagaagggtgaaatttgccatgctaacgcaattgtcagggatgctaagtgcaattggtatgactagacgtactttgtgatcttcgtcaaatgtacttgaggcaggcatcaccccgaaggagaatttgtttccttagtagaaaataatatattgctcactcattgggcttgttatttattgtgtctttggggtggaaggaagattgaaaaggacttcatcatgtggcacatatggtcactgtccttcaagtctctaaactggcccctctacctggcagatctactctcccacatacaggagagacatatagcctgctacagagacacattgatttcattcattcatttgtgtattcaatagtcacttttgagtcttactatttggccaagttctatgctaggagactctagtgaaaaagacagatggagtgtcttcttcatgctgcccttatattatactgggggagatggaaaaacatagagaaatgaataaaccaagttgtttcaaatggtaataaatgtcagtgaaggaataagcaagtgtgtggctgagacaggggtagtgagggtggggggtagcagagtgcagggtatagcacagtggtgaggctctggagccacactgcctgggtttgaatcccagtaactgtgaccttgggcaaagtcacttcacctctgggtcttagtttcctggtctaaagtggggattacctcagaatgttattgtgagggttctgaaaatgtgatatttatttatttatatttatattttggaggtggagtctcactctgttgcccaggctggagtgcaatggcacaatctcgactcactgcagcctctgcctcctgggttcaagtgattctcctgcctcagcctcccgagtagctgggactacaggcatgcaccaccacacccagctaatttttgtatttttagtagagatggggttttgccatgttgaccaggctggtcttgaactcctgacctcagcttatctgcctgcctcagcctcccaaagtgctgggattacaggcatgagccactgctcctggccctgtaaactgagatgtgatagatgcaaatgaatcagccatgcgatggctggatgggagaaggaggtgcagggaggaaagctatgagcaagtgctctcacagggtgaagcttttcagaaagttagagaagactggtgctgggggatgtaaggtgagcataggggagaacaggagaaagatgaatttggacagcgagtcagaggctaccatgcagggattattctaggcacattgcaaactgctcagaggggatttaactaaaaacgcttgtatggcaggtagcacgtataatacttgggtgacaagaagggtttgtgtcatggaccacacgtgtgtcgtaacctctacaagtctctttagttacctcacttaagatatataggacataaactgtccattctttaatcatgctagatggaggatggacatcctgtgtttcctcaaatcagtgaacaatccctagagttctagcaatcgctcaactcccttaagcatttttgttctacagtcaccacacttactatttttaagagccatttatgtttcagccaccatgaatttttggttacagttttgaacaagtttattttttaattttaggtatatgattatagctaccactctctctctctctcttttttttagagacaaggtcttgctctgttgcacaggctgaagtacagtggcatgatcacagctcactgtagccttgaactcctgggctcaagtgatcctcctgttttggcctcccaagtagctaggactaatgcccagctaatttttaaatttttttgtggagatgcagtctcactgtgttgctgaggctggtcttgaacttctggcctcaagtgatcctcccacctcagtctcccaaaatgctgagagtacaggtgtgagccaccacacccagccttgccacttctcaatgctgtgttaatgtatcggtctaaagaccctgatatggtttggctgtgtccacacccaaatctcatcttgaattgtaactcccacaattcccatgtgtcctgggaggagccctatgggaggtgattgaattacaggggtgggtcttttctgtgctgttctcatgatagtgaatgagtctcatgagatctgatggttttaaaaactgtagttttcctgcacaagctccctctttgcctgctgccatccgtgtaaaacgtgagttgcttctccttgcctttccccgtgattgtgaggcttccccagacacatggaatgtaagtccattaaacctctttcttttgtaaatggcctagtctcggctatgtctttatcagcaacacgaaaacggactaatacagacccttattcctcaaagtaacagatgctataaaagccatttgatgtgattattagcagtcattgtgcccaggtacattcttgtacacaagtgtattttcctcagaataaggttcttccaaagtataatttgctgggctaaagggtattaattatttttttcctgagttcctatcagatggacattctttggggaagggcaaacttgcatgtcttgagtgccataggagtgataaaatgaagagcttgcctatatttggggcctggtgtggtggctcatgcctgtaatcttgcactttgggaggctgaggtgggaggatcacctgagctcaggagtttgagactagcctgggcaacatggtgaaaccccatctctactaaaactacaaaaattagtctggcatggtggcacagcctgaagtcccagctactcgggaagctgaggcaggagaatcacttcaacccgggaggcagaagttgcagtgagccgagattgcaccactgcactccagcctgggtgacagagtgagaccccatcttaaaacaaaacaaaaaacaataaccatattttgtgaataagccacaggtgataatactatcatgctaataattaagaataccctaaatagcatgagccacagcattttattctgctgacctctgtctcttcctggaatcacttttcttcccttggctcactaacacagaactctttttgtattcctcataccgttattttctctctggaggtcctaaatgctttttggtgtcctcctttcactcgcttcccactccctagctgaatgcatccacgcccgttgcttcagttatcatttctatgcaggtaacacagaaatccagcctcacctcttcaccaagttccagatccatatatccaatcacttgatatcttcttttctagtatatcaaaggcaactcaaagttagcacatcgggaatcaaattcatgatgtgctctatctcactgacccacaaaccagtatgcagcgtgagacagaaaagagggactcattcttgacacctcattctgttactccacatatggtccacagtcaagtctcaaacctttctccctgaaacgtatctcaatttatctatatctttccatctttactgctaacctcctactccatgttctcaccctctcacatgtggaatactgtatttgctttctccagtggtcttgctatatccattcttgccttcctacagtctattctctataaaggtttttggatttcctaaatagacaattatagcatctataaatatagaacattttgtacctccctttctaatcttaattctttttctccctgtcttactgtacgggctaggagtctaggtcagtgttgaatagaaatggtaatacatattgtgctttggatatttattgtagatgcttttcatcagtttaaggaagtcaataattatgtctgttatgaagagataagaggtttaattgtgatgactgatgttttgaattcatttctaccattttagctgtgcatcctccacaccaccccctgatttttctgtcctttttctccctttctttttttgggattgttttcaatttcctcattcccttttttcccctttattagtttgaaagttacattctgtgtttaattatattagtggctacctgcatattttatcatacatatttaacttagtaaagtctaaagttacatttttaacatttccctgagtaataagatttcagaaggctctgtcacctccttcttaaatatcatgctagaattatgcagcattttagttttactttctaaaaataactccacatactagatattattattgttttaaacagttagtatttatgtttttaccaataaaagttcaacactattctactgtatacttaaaaatgattaagatggtaaattttatgttatatgtttttaaccacaattaaaaaaaagctcatcactctttctcttatcttagacatttcatatttgcttactttctttctgaagttaatcttgtagacttaactttaagaaattctgttggtaaaatccctgaaattaaattatctgattttattctgaaactcgaaaggaagtttttctagatatagacttatagctcattttttgtttactgtcatctactgttaatgttaactgttagtcttactattgtttctttataggcattctggttttatctctctggtggcttgtaagatcatctctttctctttgatgttctgcagtttcaccatgatgtacttaggaatgattttgttgatgttgctaaaagttagttttcctggatttgaagttttgaatatttaataccaattccaaaaaaactattattcttgcttttttaaatattcacatttctccatatattttattatctctctgaaatatcaatcagcatatgttagacctcattatattctctagttctcataaattctctttcatattttctatcttttttgttttctcggttcattctgcctaatttctttaaacccattttccagcttaccaagttctctctttagctttgtctaatatgttctttaactgactgaggtttttctttcaattacaatattattttcaaaaactccattttgttctttttcaaatctaattttttgtttttataatattttgtttcttgatcatattttcaagcatctttttaatgttttgaagcatagtgagtgtgctgggtttgtacactttgttgcataattccagtagtgggaatctttgtgggttctcattctgtctctctgttttgggtgaccctgcttctttatgcattttgttgtttttattatttcctaaagctaattgtccttggaacttcatcagttggtatatattttaattaaagttttttattttcctccaaagaaaatcagagtttccttctttcattcacctggggcaataccaaccagatacctcattagttaaaatttctgtttatggatacaagcaaggaacatgaattggaaaacaaaaacaaaacacaggtcaggactgacttgtggttaagaattctcactggagatatgtttgcgtttttcttctacatacagcatcgaagaccagggcatttccttcctgtttccttttgtgcaataggtttatttcttttcctctattttgaagaagatgcaacaaactgggaaaccagctttatatgagggtctccaatatgcaggccctaggattgatctcatttcttctattccccaggcagccatcaaaatagaactttaaggacacgagggcttgcagacgcctttggggcaaagctggctgcattgctctgacgtacccagagacctgctttgctttgtgtttgtcctcggtgtattccttactttcttgacagtttagtgacttatatttaaaatccagctttgatagttgttttcactgacaggttttccaggatattttgttcaccatactgtcagaaatggaagtctttaaacttcaccctacagtcagagtgatctttccacagttcaaatcagatcacagtactcaccttcttaaaatcctcttatttctttttattcttcttaggatgaagacaaaacctaatgtggcctgcaagggtctcctggtctggccctgtagcccctctggtcccctttgacctgacttccctaggtgaaaggagaagtctttctccactctggaattggtggctttcattcagctcctctgattctctcagctcccttctgctgtggggcctgtgcacttgctgttccttcaacctgaactgctcttccctctccttcttacctaattttctcttatttatctttcctgtgtcctctcaagcatcactttctcagggaatctatccctgtattttctggctaggtcaaagctccctattttaccttttcattgcccacgtattttgtgtttgaagtacatatcacagtttctgttttacatgtatagacgtcagtttttatttatttgtataaattccttaattgcacagtgactggtgcatagtagatgctcagcaccgtcattggcacaataacaaaaacacatttttgttagttgaataacttatcttatggagaccctaagcacacctactttagccaagtaaaagctgccggtattagtctgttctcaattgctataaagaactacctgagcctgggtaatttatgaagaaaagagtaagtttaatggactcaacacttccacaggctgtacaggaagcatggctgggaggcttcaggaaacttacaaacatggcagaaggtgaaggggaagcaagcatgccttagcatggcagagcaggggggagagggagagagagagagagagagagggagagagagagtgagagagaaccaagtgggaagtactacacacttttaaacaaccagatcttatgagaactcactcactgtcatgagaacagcaagaagggaatctgcccccatgatccaatcatctctcgccaggtccctcccccaacattgtaaattacaatttgacaggagatttgggcggggatgtggaaccaaaccatatcacagcccttctcctagaattgagagtccatgatttttgagtttttatttctttcacccctcgtggcttgcttcctggggtaaagtgatgggtcttttcactggtttcaggccaggtatgcacagctgggtcagcagggtctggtagctgaaatgcagccctggattttaaagctcacctgtttgggtcaggggccttcttcttttatcaacttttcctcctctgatatgttttaatgtaatattctagtgcctctccattgcagtaagtgttagaatgtgacctctcctaaaccctagaagtccacacagggtgtgttaaatgccctgcactggtttgcaccccagcctttgtctgctgtgtgcattgcatgcccagattttctacctgggcttttgtcatggtgttcccactttggaaggcatctgtgggtttctcagcctggaatataaagatggtgaacaatttttcagtatatgggtatttcttaacttttaacaaattgctcttaaagcctgtagcttccaaaacacctttaactcaggatttattcatccttacattcagcaacaatgcatcacatacctgtcccatgcatactgggccataaaacttagtttctttttttaagcacatgagtagataatgaaagtttctatctcaaaataagttcaaatacgtgtctagtggtagaactttggtttgcattagtaatcacatgtttatccaacacatatcgagtaggccactatgctaggtactagaaatataacaatgaactggacagactagtggaattagacaaaggtatgaaagtttttagtgtagttgagaagagacatgaagcagataatcatgtgggtgcatgtaaaatcaaggggaaatgcatgtgaggtgccctgggatcatgctatgaagagatcagctttcatcacagggtcaggaatacttctctgaggaagtaccatctaagctgtgacctgaatgatgagtaggagttggcaggtgaagaggaggagggtgtagtaggtgaaaataaagccagagggagctccctgagataggagggagtttgacccaaaggaactgtggaaagtctagggtggctggaattcagtgaccaagggatagaatgactggacattgcctaaaagggtaggaaggggtggctcttgaagaaccttgagtgtcaggccatgacctctagaaattatcttagggaaatggggagctgtgatattatgaagtgtatacttggtctttgatcctttttcctggcatacatgtcctagaatccttagaatctccaaaaagtgatgtctttttgcatgctaatgagttgactgaagcctggaaacccttaggtagtttcaggatgaggggtggccatctgaaagagcaaggcagaattagagggttgagactttcagcctcccccatagggaggggagagggttgaagttaacttgatcaccaatggccaatgctacataacaaagcctatataaaatcacaaaaggactgggttctgagagaacccagcaattccagacagctgaacacgtggcacttcctggaaggtggcattcctggaccgggcatggaagctccgcataccttcctccccattcctgtatcttttgtaataaataccctttatatcaaataggtaaatgtgtttccctgagttctgtgagcagctctagcaagttaatcaaacccgaggagggagttttgggaactcaaattaatagccagttggtcagaggcacaggtaaaacaacctgggcttatgattggcattggaaatggggggcagtcctggggactgagccctcacccaataggatctgactctctccaggtagataatgttgggtttggactgaattagaggacaccagctgtgtccactgcagaattcattgcttgcttggtggtggggatagactctcgcacatttgttacagatgtcttctgtgttcatggttgcggcatgggagcagagggaaagtagcgtgtgttttttccacttaggaatttttaaaggattttcaacaggaaaatgctatgatcgcatctgtgtttttagaaaggtccctctgaccattatgtagaaactggattgaaagaaaataagagagagggaagggacactggttcagagacccccacaggtgaaaggaaatggaggcttggtcctccatggtactgatgaagatggagaggggtaaatggcttttggggtggaattaatgggtcttgatgactcaataactttcaagcaattcaagatagtcccttcttagcccaaggctttgacttgggcaccagtggggcctttaggctgtgcttggaaactagagggtgtttttttattgtccaaaaacaggcttggttttggacaatacatgttctgaaatagatagtaatgttcattttcaactcaggtgcttaaaaaagaagctaagtcttatgggccagtatgtatggaacatgtatgtaacgtgttattgctgaacgtaaggaagaactctttgacaatagaagccagataagaatcctggagaattacctcaatggtaaatagtttacctaaagatgaggacacaagggcccagacaggagtgatctaaagtctgaatgtctgtaaatgctagtctggtttagaattcactcagtcctgtgaccgataccattgctccttctgttaccctgtcctctgcgggcagcctggtgggcccttggtcatcctactgctcaaagaggtctccaggcactcaaacctcagtgtgtttgatctccacattccttgggtgttcccaaatttcaaaacaaagagttttattgcacatgcatttttaaaactggcaccattagcaaggaaaatgttaaaagaagaaatcacttaactacacacaccaaatgtcagggctctcagtggaagagcctggggttaattatccttttcaggaagccatggaatcaaaggatgaagttcaatgctcttggcatgaccatagtttagagtaataataacttggcatttcttgggccgttgtgtctctagctgcagtttatgccagaaactgggaggcaggtgaaaaatcagcatcttgattctgtaattgtagagggaaaatggcctctagttgtatgtgaccttcagttagattctccagccccagccttattcccacatgagaatgagaaatttcaggaaaggctttggagaaatggactgttgtaggaaggagctataaggcaagaaatacaccaaagaaagagtagatctctctttttaaagttaaatgaaaatttcacttgtgtttaaaaatcagaatataaaataagtgtatataatgggcatgttatacctaatccccttttccaagaggtagctaaattatcaatttaatgtacagatttgcagattttattagctttgcacgtgtgtctgcgtaatcatctggcaagccatttttttctgttatatattttcaattatatagaaacctcctagattgtaaacaaacaaataaaaacactgagggaacaaatgataaaagaagtggtcaaaatccaacttcttcttggcacccagacttttataccaactgggccatagagaaagagctggaaggagtgtgctgaatattagctgctttttcaagtagatgatgtaatctatatatttctctgtatgtcttggaagcagggaagaaagaaagagagatagagagtgtgcatgcgtgtgcttctttctatccttaggaatattgttttggaaacattcaatttctaattatattggggggaaaaaccctaaataccatttttcatgctaatggagaaatttacttaagtgcagaattatgcaacttagttttctcgccaaattacataaagtgtgcagctcctctgaatagaatgaaggatggcatgggcacacatcacacactgttcataacttaaagttcttttcaggctttttcctgcatcttattacctacttactattaatttattacacagggttgccatattttaaaagtaaagtgaatgtttcagatggattgtttttctttcatttctcccatattgttaacttcttttttttttatttagaactgtttatacttccatcagaggcagtttttcttcagtgattgcattaatttttatgtgttcattctagacatttttcaaacagaatctccacatgttgagtttgtcttcttttctctcatccacaaatcattctttcctggtgttatttacaggaagatgttagtgaatctcctttgctatttgccctaaggagtgatcccaccccaaatgtcaggctctggaaaagtaacagctcaatagaaataatctcgtcattgacaaaagtacttggcaccaggagctgatctgcaccccgcctgttggctgctgggggtattcaatgaagtaaagcctgcacaggcacctctgtggcctctagggctgcttgacagttgacactagcaacactgtagtcatcctaaccgttccttacatattctgtttctcatgaggctttgctctttctcttctgacagaataaatatttccacttcaactttgttaccctttagaggagaatttctctgaccactgtgtatgtgttttgtttttgtttttgtttttggagacagggtctcattgtgtcacctaggctggagtgcagtggcttgattatggctcactgcaaccttgacttcctgggctcgggcgatcctccagcctcagcctcccaaatagctttaaccacaggcatgcaccaccacacctagctaatttttgtatttttttgtggagacattttcccaggttggtcttgaactcctaggctcaagtgatcctcccatttcggcctcccaaagtgttgggattataggtgtgagccactgcacccagccatctgaccattgctgagtaagacagctaactctcagattctgtgtctttgcaatttcttatttatttcaggtccatacaccttgatggtggggaagaggtggggatggtggcagtgaccttacagggaagggatgaattaggaagggaaccgtctctttcacgaatcctttgcatgcctatttcattgacttaaatgtgcctgcctagtgcattgaagggtctcattctatgaacaggattgggaagtgcaaggatgatcttcagacagactcagccactggtttagctgtaattattcttggtcccaggttgtggggtgggagggagagagggagagaatacacatcactccttgactcttgtcttaaagtattatgattttcccagagtaatcactcttttgaaaccaggaaagattcaatggttctttttgtaaagtcactaatttacacttatctgaatagggcaaattattggctcaggggaaggaacaccagccaagtcaccttggttttagagcttgaatagaaaaagcgtagagccagccttctagcttccctccaacagtcccatagcgtcatcccctggataacggatgcctccctacccactgacttgctcttgttcctggggtcataaattatttagctgccacttatctcccaggatcttttactattttttttttttttttttttttttgagacggagtctcgctctgtctcccaggctggagtgcagtggtgcgatctcagcttaccgcaagctctgcctcccgggttcacgccatcctcctgcctcagcctcccaagtagctgagactacaggcgcccaccaccctgcccagctaattttttaaatattttttttatagtagagatggagtttcaccgtgttagccaggatggtctcaatctcctgacctcgtgatctgcccatctcggcctcccaaagtgctgggattacaggtgtgagccactgcgcccagcccttttactcatttttatctgcagtgtggtgcctggcatgtagtaagtgctcagtaaatggtagttgtctttatgaaaatgctgatttctttcttcttacagttcaggaagcaaaaatgggtgtatccggaagaaaaactgtatatgatgtaatagtagctgacatctgttgttgactatgtactagactctgctaatggctttatgtgcattgtttgattttcgagcaaccttatggggctaatacaattttactaatgagaaatctgagtctcagagagattaggtaccttagccaaggtcacccaactaataagcgacagagcaaggctaggaacccaggcagtgctgcctaaacttctctattgcttcgaagagtcagagaaggaatcggagggatggatgcctataaatgtggaagtgactgaggtacagaaaataaaagagggtcagggtgttaggaggctctccctccacccctgattctcaagggaatcttcccacttgctttctgcatcctgaggttgctttggttagattctgctcccctgggatgctagcctgaggttggcatctcagttttgggctgaggctttatgtacctgcgtgaaagaggtggtacagagcattgtacacaacatatggggctccatttgcatttagtgagtgctcagctgtgcacagtgtctccttaatgaatcacatgcaagccgagcatcgctatatttatccaagccctgggagccggagtgctggctgtggtcgacttgcatgccccagaacagtgccttgcaggttgttccagttttccttgtggtcagggccttagggcccttcaataatttgttccctggcaaaatctgctggtttctgaagtatctttccaggcgttctaggccagaaaaaatgtttacatcctgaagctgtaacagagatcaagcgctaaaaaagaacctggaagctacatctgctgtgcccttgacttcaaggccacatctgaagaatcgcagacagatgaggcatttttattttcttttcaagcttttcaagggggggtcccacaatgcttaatgcttaatcaccctgctgtcatcaggttatttcttccttgtaatctaaaacccttatgaatttttttccttagtcactccttaattgaaatatttctttttatagctgggcattggtggcttgtgcctgtcatcccagctactcaggaggctgaggctggaggatcacttgagtctgggagtttgaggccagcttgggcaacatattgagaccctgtatcttacaaaatattcctcttatgctcagatcagagagtttgcccaaataatcacttctgtgcttaggaatcaagaacaagaatttataatgtttacttaacgctgattaaatgccagctacaatattaagcacttaaaaataattatctcatgtttttcacctcaaaataaccatttgaatgagcattaggactcctttttatcaggaataaaagtaaaatttcagaaaagtaattaactgaggccacacagcaagtatatggaggagtctggcttgatagcaaagcgctttatatgaaatagatttttctttcctttcttcttcccagctgtagtcatgtcctgtgactcttcttcccattcccagccattcttcagctaaaaagaaagtaaatattttaaaatatgtatatatattttagatatatatatttatattttaagacatatagataatatataatttatgatttatatttaaatttgtataaacttatatttaaattataaatttaagatttatattattatatatatatatgtacttttcccccattttcctcctagaattgtttttttatcctttataagacttaggcaggtgcaggatatattttcatccctggactcaagtgtggtgtcaagacccttaacttgtgacatgaatagcaaggagcagattggattcccactggagtggaggcccctaatcatggcttcctgggatttgtgttatctgccttcccctgttagatgctgagaacatagaagaagaataccaggttctggttcaagctatatcattggcacagtctgtgacctagagcagatcactgctctctttctcgtgaaaatcaaatttagtttcctacaaaatttaaagttgagcagagccttggtttagtcttacagactaaaaatcttttttccttccagttcagtcacataatatttataagatggtgaagccaagtcacttgccctctctggccctgagtctcttcatctgtacaataagagcaagaactaaatgctcaccggacttcccagcagctcttggtttcaaactcaggggagctgcaggaagaagctggctctactctgccaagttctgactagtgagggtttgcaacaaaaccagccagggctagtctaggcaaaaaggagagtttattttaaagatatttgtgcagctcataaaatcaaaaaaaaaaaagttaaataatgagacacagagaagttgggaaccaggacagcctcagggatctcttcagcaggagctcatgacccttccccctggagtgctgccattaagatcactccaaaaaagcctgtttttatgtttctttcttaaaaatgacaaattccagaaggagaactgccagggggccattcagttatggagggtaggattggacaggccaaccagcaggaaagtgttgctggagcccagccttgttggaggagcaggtggttcccaggaggacctgggcagaactccccaccacacacacaggtacaccctacagaaagagcccatgtgtctgtaaatgattgggaagccaggtcgggatgttaaatgtgggtgggagacacagtgggcaggttcaatactctagaccagtagcagccatggtgatggaattcattcagcgttttcaggcagctgtgcctcatggaagagtaacagacttcaaggcaaaaggcatgatgagtggacagtccattagggattgctggtggctgtgggcacaaagaaagacaaacagtgtgatctcatggggaggctgaccaccaccatgctggattaggatcctctcttttcagccaggtcaaggacagggtactctggtcccatcttttctactttgatgacatttgggcaagtttcaacctcttgagagtttttctgtttccttatctgtgaagtggggatgagagcaatgataatcatgctactcttccaactgacaacagtacggcaggcgctaacatctgctggggccaggcacccatgctgagaacttcccatgtgggttgatcctcgcaatcctctgacacagtactgttatggtttacactttgcccaaggcttgtgggaattaagggggcagtaaagtgtagagcaaagcagtgtgcaaagagactgagaggctgggctcaggagctgatggccagttttgaattctggctctgacactcactggcctggtgttttctggcatgttgcgtgagcttcattaatttgtaaagtgggtgtgatactagtgcctgcctcatgctgtggttgtgaggagtgagtgatttcacaggcatccaggaaggtgcctggagcagagcagtgctctgtaatgtttgctgttgtttgtaataaagtgcctgccgggcagtggggatttgaacccaaagcagattgactctagaatatatatgctgtggcagttatctctggtggcagaacaagaaggctcaggagtgagctgtgtaaaagccggggtgggggtgagttagcagagggagctatggaactagggagaggaagagaatgaggagccctaggcacgtagccacttcaacactccttgtctctgtgaccttgagctggacccagaaggtcagcagcaattgctgagtccccataaccaacgggaacattcagcactgacttcacttatgcttctgacttcaggagggctttagagagggggttagttagaaaaagaaggaaagaaagagagacagagagtgactaagacagaaagagagtgatgaagtcagggggagggtggggagagaactagatataaagacatagaaacccaaggagagaaagagagtgattgacactcaagaagataaacagaagaggcacacacttaaagccacagaaatgaagtagaaagacgggaaagaagggtgaggggaaggatggggattttgcagagacagtgctgagggggctgtgactggctggcctgctctgtggttgaggagcaaacaaacctgttaagtgtgtcagtgctttatctaggaaagcacctttgccaaggcccgggcacactgaggagctttttgagcgtgtagggctgtgacaggagagactctctttatctgaattggagacaggagcactcttctgtgcatttcacactggatgccacagattaggctgcggatatttcacggttggtgataaacatttgtttggagaagccttgagcagagcaacactcctaaggctgggggaaggggttgataacaggcaggtacctggagactggttttacatgagggactggttctatgcaattttacacttgtatattattataggcattgaaagtccctagaaggatacccattaaaactttgacaatagctaacctccctggttggattaatgaggagtctcaccttctaagttatgtatttcagttaggtttacatgttttacagtgtagggattttataatcagagaaacaaaggcttaaggtaataagttaactcctgaaatgaaggaagggaaagcaatggcccctgacataaaacaggttgttggggctcatccgacaaacagacaatgggtggcggaaatggcagtgcatttgaaaatatttctccttgatatttccaagttactttgaaaatctgatgatcacaatctttcctctgattcttgcagaagggtgaaattattaatgtctcctcagctcagacaaatttccttcctttggggtttccttggggtttaaaaaaatacggcagaaggtgtatgccctgttagttggtgggtttctgttgggtatggtggatatgaggcttttcccttgagagaatgatgcacgcagcatctgcagaatcctctcctccttgaagtccccacctcccactcctttttgttttaaattttaaatgaagtttgtgcctagtacacacttttaaaagtattgtctgttagcttgagaaatgacccagatgtatcttgtttcaggctttatgaaggcaaagaacagatggagtttgaagaatccatgagacggctctttgaatccatcaacaatctgatgaaaagtcaatacaaaactaccatccttttgcaggttggtttatgctacaataaaatctatcttctccttggccatccagtaaataacagcatgctaagataatatcttcttttacttaaatatgcaaacttgtatccagtgaaggcctgggctggccactaggttaaagaccaagggctcctcaggacaagagaaaacgtatttattgtttgttacccatgaagctagcagtgccttcttttaaaatagctctgaaatttttgttacctagaaggaaattagtcaaaccggatccacttccaatggagagaacagttcatggtagcagtctcttaaactgagtttaattctcgacaacataaagtcagggacccttttgggattaaagagggctcctcaataaacaagaggtgctttggagagaatgagtcctctcatgtgtggtccacgatgctaatctgtgaagactgcaaatctttgagaaactgtgaggcctatccctgtgtttgggaaggagttgagcagctaagagtctgaatgaagaggctgtttcagggagacttcagaactttcacagaatgcacttgcaggcactgggggtgcgggtgggggaagctgggagtgcctgatgtgctgtgaataaacgaagcccaaacacatttatctaaatcaatgagttaatgcagattgctgctgctttttttttttaaatcaatattattcttttagatgctaatttaaagatccattatgcctgagatgcccaggcactggttagaattaatgacgtactagtgtttagctagaatgaaggtgaggaagcagaggtggaagtcagcctggggaatgtttgcttctcatgctatgggtccagactgtgcacgttagaattgtgtggggatctttaataaattctgatgcctggttacaaccacccgactttctaatttaattggtatggagtgtgacccaggccaggggatttaaaaaattccccaggtgattttactgtgaagcaaagtttgagaaccactctgctgatggcttcctttaatttaacaaacagtggaaacctgtgtgttggggaaggcaactatcttattcatatgtgtcttcaacactcagaataatcctgataattctaaaatttattctcctcagaatgtgtatctgtatttcttgatctaactgaataactgaaggtcctaacactatttggtcttatgtaacaaggttaggaacataaataccctcctctagaatccactagtaaaatacccaaaaagcttctgttttatgatgagatagaggaggaagaggtataaatgattaaaaatgatttaaaccaaactatgtaacaggctttatatttcatgcttcacatatattactttatttcaccctctcaaaaatcctctaaattacacattaggcctgccatgttataaaaggataaactgaggctcagaaagctgaaacgatgtgcctaaggctacatgcccacatctctctggtcaaaagccaaagctccttctcctgcagcaaatctcaaagtctatagaagagtccttgtgtgggatttgctgacatcacatgggcttcacccctctgccctcatcactaagttctcttcacatggtactgctttccatatttgaacataactttaaattcttctttgataacttttcaacagccatacacataggtggaaagcatcattggttttatgaaaatccctgaggctaaatttggcccttagagcaaattgaaaaagagatgaagcccctttctatgtctctgaggtggaaatctatgggaagaaaccagcataatctggcccaaatcacaaggaaaacaaggcatttctaacacagctacccggacaagaagaacctgggtaaaaagacttatgccaaaaccataataatcatatgagttctctaatcctaatattaggattattctgagtgttgaaaacacaatgattagtgtgtcttcaactaataatcatttattagttgatgcttaatagatatctgttgaattaattaatgtataacactagggatacgtcttaaggtttctattttattgatgagggaattgaagctcagacagttgaaacagcttcctccaggcaccattgctgagaagtgggatggctcagattcatatctgttcctgcctggctctaaagaccatactcactaccacggcattagcctgttctttatactgtttctttagtccctgctggggatggatgtcttcctatggattagttgggactgcagtcttctagtttttatttttcccttaccccctcctggttaaaaagcaaacaaacaaaaaatgtattcctcatattcctaaccccttcatcattctctgactaaggggataacaggagcaggggacagcatgaggagatgcggcaggagccccagccagccactgcatctgtatcacactggaagcaactgagcttctagtgagtagccacacagtgttgggatatctggagagagccaaggatgaccaattgccatgagagaggctatagggttgaatcaggtgtgaaatcagctccaaggaagctgaagtgtgaaagagcagaaatgatgagccaatagataaagccagtttctcatcccagaggagaaaggcgctgatgccccaaagaagttgaggtgccatggagagaagaatggaagagggaataggtaattttggagctactctttctaatttcagcacctgtttccctacgatgggctacacatatatttggggaaggaacaaagggagagagacagtaagaaggcagggaaagaaagaaggagaaaaaaaggaagcaaagaggaacaagtgagcatttgccgctctcaagacacctggtcaataggaatgcccttctttatcagctgcatgaccttacattggtcacttaacttctcaatgcctcagtttcctcatctataagatttcattgtgtgggtgaggatcaaataaacattgtctgcaaaagaacaaattataaaatgctatgcaaatgcagtgaactaatatgattattatggttttggcataagtctttttacccaggtggttcttgtctgggtagctgtgttagaaataccttgctttccttataatttgggccaggtttgttggtttgttctcatagatttccactccagagacatagaaaggggcttcatctctttttcaatttgctctaagggtcaaatttagcctcagggattttcataaaaccaatgatgctttccacctatttacatagctattgaaaagttatcgaagaagaatttaaagttacattctaatatggagagcagtaccatatgaagagaacttaatgatgagggcagaggtgtcaagcccatgtgatgtcagcaaatcccacacaaggactcttctatagactttgagatttgctgcaggagagggagctttggcttttgaccagagagatgtggacatgtagccttaggcacatcgtttcagctttctcggcctcagtttatcctctgtaacatggaaggccaaatgtgtaatttaggggattattgagggggtgaaataaagtaatatatgtgaaacctgaagtataaagcctgttacatagtttggtttaaatcattttttaatcatttatacctcttcctcctttacttcatcataaaacagaagctttttgggtattttactagtgaggattcagaaggcgggcatttgtgttcctaattttgttacacaagactaaatagtgttaggatgttcagttattcagttagatcaagaaatataaatatacattcttaagagaataaacccacaagaagtgactgtatgaaaacatgcatgggaaagtttcagctagtgaaatagtacgaggtgaccggagtcttgattctgagcctgcatggggtgtgagctattagtaacatcagccataagtgctggctgggtgcagaggatatgaatgcccgtggttgatgttcctggttcaaacttttcacatccagctgggtagcggcttatgttggaaaccctcttttgtgaccaatttaattgtgagtagagcagatctggttcaaatctcagctgtgtccactgttaactctgaaacctaagcaagttattgcccatctctaatgctcacccagcttttgtgagttgctttctgtggtttttcttattgttctgagtcggcgtggcagcagctcaccaagaccacggagaattgaaagccagtagttcagaggaaaggagcaataaaaacactttctgctgatcaggtacctaccatgttccagacatggaactgggatcttcatatacagtgttttaaatcccaccagagatcttcaaggaaccactatcctcagtgttcataggaggctcataaagttaaatagttcatcccaaattacatgtattcatagtgctggagctaggatttgaatccatccaggtcatctgcctccaaagcactattctctatgccacaggtaaggtttaggccagggattcccatgtgttttcaacaatggaccacatgctcagaagtccttgtgtgtgccagccctgtgagcgtggttgataaaactgatggcagattcagagggtcaacaccacacacatgtaaattagatagagctcaaaagttagtaaaagacatatggcgatgttgtgcaggccaatttgccccactctccttacgatccatggtatttcataatgctccaatttgatggcacaagtggaattaaatgaacagcttgtattgaatgacatgctctcttggccactgtgaatgccacttatgctaatgaagcccctggagtgtccaggagggcaggggactctgccatttatatccccaatgtctggaacaatggctgccacacagaaagtgctcaaatatctactgtctgaatgaatgaatgaatgaatatggctgggtgcaatggtgcatgcctgtaatcccagcactttaggaggctgaggtgagaggatctctcaagcctaggagttcaagaccaggctggggaacatagtgagaccctgtctcgacaaaaaattaaaaaaaaaaaaattagctaggcatgggggcctgcccatgcctagtggtgtatgcttgtggtcacagctactcaggaagctgaggcaggaagatcacttgagcctaggggatcaaggctgcagtgagctgtgataatgccactgcatttcagcttgggtgacaaagcaagaccctgtctcttaaaataaataaataaatactgccgggcgccgtgactcacgcctgtaatcccagcactttgggagaccgaggagggtggatcacaaggtctggagtttgagatcagcctggccaacatggtgaaatctcgcctctactaaaaatacaaaaattagctgggcgtggtggcgggtgcctgtaatcccaggtattcgggaggctgaggtaggagaattgcttgaacctgggaggtggaggttgcagtgagccgagattgcgccattgcactccagcctggcgacagagcaagactctatctaaaaataaaataattacttctatcattttgtttagtttgatgtttcagtgtttattaagtgtcaagtgttgagctaaaagctttacatatattgttagctcaattgatctttgtaacaacaaccttataagacaaatagtctttttaagttccatgacatacctgcacagaatgtgcaggtttgttacatagatatacatgtgccatggtggtttgctgcacctatcaacctgtcatctaggttttaagccctgcgtgcatcagctatttgtcccgatgttctccctgccctcacccccccccaccccctgacagctcccctgtgtgttgttccccaccctgtgttcttattcttgctctcccacttatgagcgagaacatttggtataaagcggagataaagactatatgcaaagacaaatgggctttatctctgctttccaaatgaggaaaatgaggcttaaagaggttaagtaacttaccttggctgaaaattagtatatcttggatttaaattttggctgtgtaagtccagagtttgagttcttaatcaccaccaaacaatagcgcaatttcattaagactaaagtcttctggcaaaaccccaggtggataagactcaggggaccccataaagttgagttacagaaaggatggaaacacacatattctggaacctgttggttcctttcccttcactttgcctgagagattagtgatgagactgaatgtcctgagagagctgcatttattttcctcggggacaactcagcatctcaaaggaaactgccttcttatggtcatgctatggggaattcctgtgacatcgtttttccagtttctatggaccttgatcatccactgcttggctaaaataaaaggattaaaaattgaggggaatagtacttgttttgaatgcctgtggctcttgaatgaggaagctatctggtagcattcttgcataactgtgtatcatttcaagacatgttcattttggccagaagtctgagtgtactggcaccaacactggtcactctgtttgaaagagagagaaagggaggagagagagagagaaagagtgaaagagagaacaggaaagcctgaaagcactcagcagacaagtccctctgagtttggaggcatcctagtctggttttgatttttgttgttatgtttaaacacttgccgttttctaattctggtgaagtccatctagatagcaatgatctcaagtgtcctcccttgatttacctctgggacagtaaaaccactcttggttgctttgggtttgattctcttcttgagggatgtacctggcctttggcagaggggttcagagtggacccttaatctaggaaattcactcagtgccacatgatcacctaattagcaagatagcattttcctgttggccattcttgcaaccccctatagatgtggtaatgaggatccttaacttaaggaatgtcagaagaactgcactttattttcaaaaactattcttacaaagggtgggggaagctctttttccacttcctcctccaaattagccttctcgcccctgctgaatcctccccacttgccgagatagaatgcctttcctacagcatgacaggcagtagtggacgtactggataacagccagcaggacagagctgggtacacatccttgctttgcttctcattagctacatggcttctggcaagttatttaacttcttctccatgccatagttttcacattggtaaaatgggattaacattttccactcatagagtagttgaaagaattaaatgagatcatgcatgtaaagtatttggcatgtaaacagtttccaataatggttcctattttttattatttatttatttatttatttatttatttatttttgagacaatgtttctgtctgtcaccctggctggagtgcagtggcaaaagacagaacactgtagcctctagctcctgtgttgaagcaatcctcttgcctcagcctcctgagtagctgggatcacaggcctgtgccaccatgcctgggtattttttttacatatatatattttgtagagattaagtcttgccatgttgcttaggctggtcttgaaaccctgggctcaagtgatcaatcccttggcctcctgaagtgctgggattataggcatgggcaaccatgcccagccatgattcccacttaaaaaccctataattcataatcgtattatatgagtatgtgtgtatatgcatcacatgtatgtttatgtgtataggtatatatatgtatgtgtgttttaagtattatacacaatataggaatatagactatggaatgaaagtaataatgatacaatattattttatgaagaatggtagtaataatgagagtaaaaataatagaacggctgggcacggtggctccagcctgtaatcccagcactttgggaggctgaggcgggtggatcacctgaggtcaggggtttgaacccagactggccaacatagtgaaatcctgtctctactataaatataaaaaactagccgggcgtggtggcgggtgcctataatcccagctactcctgaggttgaggcaggacaattgcttgaacctgggaggtggaggttacagtgagcagagattgtgccactgcactgcatcctgggcgacagagtgagactccgtctcaaaataaataaataaattaaaaacaataataataatagaagagtgaaactcagttcccaggatagaaacatgtaacatatggagtctcccataggtcttatggttgaggtgctctgccttctgggagcgtttggtgctggcacctcctgaacttgcctgttgtcacctgccccagtgtgtcagggcaagaccatagacagaagtcctctgacaaatgctgaccgtgacaacagtcttggcaaacttcagtaggcagagatgggctgtccccattgggaaaaagaaccacaggcctgccacttctctgtgaggccgcctggactagatgcaaatttaatactcccctgtcatgttgctaaaaccctctgagactcaggtgacagctacttgcttcatttgactgtatggcctacctggagtgggaggctgggaagatgggcttcttctgagcagcccctcccgcagcctgtgcagctgcctgctaatagctaaagcatgtaagtgtgcgggctgtggagactcctgataactgcggttccatcgtgtccctccaaagtcctggaatgacatgcagctcttgaaagccagcaactcgcagcagacactgaagtcctgcctttccccacaggggtttgtttctgtgcatgtttctcactttggccttaattatgatgagtacgcgttataatctgtccaggtgtggggtatgatggccagtgcttgagtaatgagatgggaagaaactcagcacacaccatcatgaagaggctgaggctcaaggagtgaacaaatgagcctaggctcatgcggtgctgggtggagagctcagggccctgagggctgtatgttctttggcctaagagtggatgaagaaacagtttgctagaagtgcttgcaccaggccaggcatggtggctcatgcctgtgagcccagcactttgggaggtcaaggcgggtagatcacttgaggtcaggagttcaagaccagcctgaccaacgtggtgaaaccccatctcaactaaaaatacaaaattagctggacgtggtggcacacgcctgtaatcccagctactcaggaggctgaggcaggagaatcgcttgaacctgggaggtggagtttgcagtgagctgagatcaccccattgcactctagcctgggcaacaagagtgaaactctgtctcaaaaaaaaaaaaaaaatgaaatgcttggactagcctcttttcagggcacatgcctcagtatatggtatccctttagacttcagaggttgtaaattagtagcctctgggagaaatgcagcctgcatttgtgtttgatttgtctagcaaatcaaagcgttaaatcaaagtgttaaaacaattgataggaataactgagtctttagggagagaatggaatccacacacctcatcacttcccactgccctgtcctcattccatatcacttctttctgttgcttgtctagccctgcagtcatctgattttgctacatctgcttgatgtttcctgataaagatggtccttgaccaactaggttggaatgtactggatactgtgactgcctggaggaatgtcataatgcttcttagcatattaaaattatgaaaagttctatagttaaaaaaaaactcactggtttatctttgcttaagccaatgctttccaaaattctttgattgcgaacccttttcccctacagaatacctagcaccatcctatgggacaagaggctccaatagaacatagtttcagagacaatggctttggaatgttgttttatcttataatctacatttaaaagaataaagaataaatctctagatacaaaatccaataaccataaagtaaaagtctgacaaatatgacagcctgcaaattaaaatctttctatgcaatggaacaacaggataagtgggagaaaattcttgtaaaatatgttactgtaaaagggttactattaatgatgcatgaaaaattttaaaaaccaataagaaaaaaatacccaaaataagaatagaaaaaggatatgaacatgcaatttagtaaatatagatgttcaataaatatggaaaagatgctcaaccatactagccaccaaaaagttgcaaattacacatcagatcaacaaaaatctacaagattgtatgtccaatggtagcaaggttatggggaaatggtcaattaaaggaaattggttactgtatcttccaaggtaattgacaatctctcctaaaatgtatatgtctatatgttttcatgcactaattcttctttgaacaatctatcctacaaggatctttacagatatacaaacagtattttttttaccacgtatttataataaaaattgacaatagcatggagcctatgatcaggggtgggctgaagaaggtataatgtacccatttgagcagtgctgggcagtggttagaaatgaaaagaatccactctatgagaaggcaggatgccactggtgtgcagttaactacaaaaagcaagttgcagacatgtatatttacatacacacacatgcacatgtaggttcatgcatagaaagcagtctggaaggaaattcatcacaatgttaactaacagtggtcctcccctctctggggaggagagattgggacccagaggaggatgcgatataggactttggaaacaattttcaccctcatgccttatctggtatgaatgtttttacatcaaacatagagtattgactttttaaaatttaaaaattataaacaagattaaaaaagggatgaaggcatagagagagagagggttgctatttgagtaaggtgaccatgtagcttaagggttacgagaaatggctctaagtgcagcctgcctgaatttgaatcctggctctccacttgctaacttttcaaccccaggctagttatttaattgtgatgcaccagagattccttatttatgcaaataatgtttcccttgcagggttgtaactaataagctaatctattagcagtctttggtacagcttctgccctgttgtaaattcttagagaataatcataatcattatttatgttaagaatctcagttgtatatggctaggaggaagattttctttaggaaagtaattttcacgattttttacttgagtctgattgttaaagggtgatacatgttagtaacagaacacctaaaatatacagaaaaataaataaaaaatgcatacttccattagacccttacacattattttccattcatgtgacttacagttctttctactgaaactgtagtctgccctgctgcttagcaagtggtgttgctatgcagggggtgagtgtggctcctatctctggatgcatcagttactttaagagaggaagcaatccactacaatgctcagctttcccaacccagctagtggaccaaaacatacccactattattcacaaagtggccagggagaggaaatatgaataacttgtcaccagcaaagcaattcaagtacaccatcttccattaataatatgtcaccatttattgagcactaaaataggcctggtgctctgttggatgcctcacatatattatttttaatcttcgcaatccttcagaatacatataactttgtctatttcacagataagtaaatgtctgagaggttaagtgttttgtccaaagcctcatggctaataaggtgtggaaacagaatttgcagatctatagaactacaaggtctgtggtcattctagtctatgttattgcctccttgaagacaggagttgtgacttcacttttgtatacaaagaagtccgtgcttatgttttgatgtccatacagaggcttccatcaatattgtaatgtccaggatgcagaatcattctcctctgatctgtgtcatgctgcaaagtaccctctttgccagcacagacttgttgatgtgaggatcacttatatgtattttacattccacctaggtggcggctttgaaatacatcccatctgtcctgcatgatgtagaaatggtctttgatgcgaagttactcaggtgagagctcatgttgtactttcttgggctctgctggcaagctagggattcagagtgggaggagggctcttatggggagctccagatgggcactcagcttggggatggggaagacctgtggcaggggatgttttcagggtttccggtgtggtatttttaccttttggttttcttgtgccagactttggtgaaaaccaactgtataataagcatccctctttgatgatatgaaaattaatcatataggttaaaaaaaattgatgtttgagatgaatgtttccatttcacctgggcctgaaggttattttgggttccactctttgccttgtagaccccacagttgcaaatggagaacagcctaagcatacctaaagagataatggagacagctcccttttgccttctacttcttaactacgttcagctcatagatgaacacgttattttaatgtgattatgctgttggaataggggcatttcaatcagatataccttcttctttttaaaaaatgtattgtagtttacagataacagacttaaaagactttttatatttaaatacttatagatttagaagagagttgcaaagattacatacagagagttatcatatgcccttcacccagcttcccctaatgttaacatttaaataactatggcacatttataaaaactgagaaattaacatggatacagttattttaactgcactctggactttattcagatgttaccagttttttcatggatgtcctttttctgttcatatggaagatttttgctagctccttctcatccttcagaccctcaggctaaatgttatcttggaaaagctactgctggatattgtaaataaattaaatttctcccccagcccctgtgccattattctctgacacagctccctatttatttcctccactgcatacatcgctgtgtattgatttgtttgcttctgtgtcatttgatgacctctattagaatgtaagttccatgccaaatgggacccagtctgttcccattatatccccatttctctgcgctttgcctgtctcatattaagtagatgtttaataagtccttgaaagaataaatgaatacaataagtttattttggaaagccgacaaggactataattttgtttcagggtattttgattctcaccctatttgggaagagctatctcccttttgatgtcccaaactggttctaatccacaatttttcatagttttaaaaaaaattagagattttgattttaagacttatcataaagcattaccaagcataaaacatttgtaagtaaaatggtatggtaatgaagtcagaaccttgttttgaactcttgtttctttaacttcctagctgcataaccttagaaaagttagcctttctaaacctgagctttctaacttataaaattgggataagtattgtatatagcttgtagagttatgaagtctacatggcataatgaatgcaaaatgcaaagtgtgtgcttggtacacggtaactgctcagggctatgggtattttcagatttttacgtctcttttaatgctactaatattctataccaagaacaacttgtacatttttactgaaggcttaccttgcacctcatgctctgccaggacttgggggtttcccagagctagaggtccagggatggactgtaagtgctatgagctgggagacatgggtctgccttgctctaccagctcctatttttcctgccctcagccaactcctgtatgagttctacacctgcatccctcctgtgaaactccagaagcagaaagtacagtctatgaatgagatagtccagagcaacctctttaaaaagcaaggtgagtacacagcacccttgctggggtggggtaaggggccaataaaccccacatcattttggggaagcttggcaggagagggcaacctgtccagtgactataacatctcttttctcacaactcccttggtctgcataaatgcaaaaagtagaaagtagctgacaacttagatatcagaatctaaattgattttaggaaagctgaggttgcattgtttatttctcttgagaaagtttaatgaggtttttttttccccctgtatggtttattattgctgtctttaactcaaagggaaatggataaagttccttttagtagaaagagcctttcacggggaagttctcaaaattttgagtgtgtaagaataaactggagagcttattaaaatgctaattcctgagacctagctcgaagagtctaattgagtaggaattaacattttttaaagtttttagaaaaatgtaaattattttggaaaaggtaacgcatttacatggatgaaaatgaaaaggtatgaaagggtaccatgtggaaatggtccctccagaccctgtgcatggctaatcccagtcccttctctgtggcaaaaggcatatccagtttcttgtgtttgcttctaggcacactctgtggatgtggaatcaattacgtatatgctatatactctttattattatcatgcaaatggtagcatgctatgtaactgttctgcactttgcctttcttcacttaatggtatatatttttgggagatcatggaatgacagtggatttgcacagaagttatgttcagagcttctgcttaccctaaactggtcaccactgggccccactggcagaagacttagagttccctattttcaaggtcagtcaactggatgtcgatagctccatcagatttgatcaggcaggattcagaagctcatattcatcctctacctcatctctaggaatgctctgcatgcctagattttcaaaatggatcatgccttttgctccatgtaaaagaatgacctgttcagaaactgcattccttcactcctttctgtaagggtgaagaaatgacttttcagggtcagtacttttttctgtatcctaagacccagcctctccaattttcaatttctctatccacactggtgtcaataataaaatgcgaagcaaactgtgcaagaaacaaagggtcttagaattcagaggatcagccatcacccaactggaatttattcagggagtgaagcctgaatatttatgcaaattgcctggtaatcacagaaatattcaggaaccacttcactgtaaagatgtttttttccaatgcctggttaacatggtgcatccaaaattgctgtctgtatcctctccccagagttaagggtaggaggaggatgtggggatgaaaatgttcttgtgattttaatatttatgtgtgtggtttcctgaccctttagacagatatgtgacaacagattaatccaataaatatgtagtttgtttgagccaggtggtttttgtgaggttatggagactaattctggtaagtcttgttgcacttcttgtgtcactgtgcctttttaaagtgagacttccatggttttaaagttctgatttccacctccaaataaatttccctcaccccaaaagcattgaaatatgtctgccccttcctgccctggaagcccctctcaggatttcaggtggtgccactgcagaggcaaattgagtcccatcctagagacatgacaaggacgactctagctacgcatatggtgtggcacaggcagcagggagtgggctgcttggctcttcttcattgttcagagctgctgtcattgtcaggggcccggcttggcatcaaggccagatggagtgctagcacgggcctgggctgggcatgtggtgtcaattccagcctcttggaagtcggagtaattccttgactgcagccacatctccagggctgggaggaggcctctgagggttagcatcatggcagggcaggctggacagctgctgcttctcagtcctgctgtgtgtctgggtttcagattcagtagaaaccctctgattaatattaactgacagaaggccagccctggcgttgtacacagttaaaaaagaaagcaaaattcttacctttaaatacatacagagactagaggtagacaaagtatcctttggggacccctttcaaagaggaggcaaagtgtaattagtgtagccacgctcggctcacatgtgaaagtcgtatgaccttattcacagctgaaaggtaactcctctcccaccatctatttgctaagtgagccctgttaccaaaatagtcccaaagggaaacttcagctcatcccctttcttaaatcctcaagttcccaatgaataaaacctgaattcattatgcttactaggtgtccatcgacctcgggtgagcatctctctttatacccttaaataaggtgagtgtgattcctctggccaagtttgagcagtaatgaaattcctcctgttattctccctgtgaagtgtcctgtgcctcggggacgtgatttgctttgagcctgcactcatttaactgccagatgtgcaaattgcctggagtattttcagtgacagttgcttgtactcacagccttgaacatttgtattgacattaagcggagggaccagaaggcttttaagcactttctgggattttggcagactaccctattggcctgtcatcagaaggatcctatggagaaggtggagaagggtttactggttaaggacggtggttcttgggtcacactagacccgagtttacttcctggttcagctttttacatgactgtgtgactatgggtaattttctaaacctctctgattctcagtaagctcatctggaaagtgggaataagaacaataacgtctgtcttagagggtgatagtgtgggctaatgagatggatgatgcatttaaagtacttgacacagcactgggctcagcataatgtttcatactaaacagcaattgttattattggtgttgtggttgtttttcctgctgatcccaatttccgtgctgacctttaaattccttgcaataagggcatcccttaacgtttgatagttgcacacaaccctcaactacatggttttcctcagggtccgagagacacaggacctaatgaataaaagggccttggttggtacatgctctccattctgactttgaacgtgtttgttgttgttgttgttgttgttgttgttttcaatttttattgccctagaatgtttttgtaaaggggccatgttacatatgcctggaagaagtagaggtcaaggtgaaatatttgtgatttctcacttcattgtttgtgttactacaggctccaacatagttacatagttttggacacttgacagctatcctctctgatgatttacccctcagggctcttttagcgcacacacacacacacacacacacacacacacaccccacacacagttttttccttgttttctttatggaggcaattagcctcaactttgatttgacctgtgatattgagtaaattacttaatccttgtaagtcttaatttctgcatctgtaaaatgggaatagtcacagaatgggtccccttgggttgcttgttcatcagtggcacatgtggctagttagcctaggaattgcaggagtaaggagtcatcaccagccaggttcccacatggaatgtcttgctccctgtggatgacttcaggcttcagtgagaggagaactgagaaacttacaaacactaatttgctgtcttctccaacacaagctcagacctgcctggtggtgatgacaggagaaaggacgcacagatatgcccggagaaagctccaagaggagtctagaagaaaagcaaaccctctgtgcctttgaaacagatttgtccctacaagaacctcatctccaagaaatgtgtctttttagtctgatgctaatcagaggcaccatctggttcagtgtaaactgctttaggatccacattgctagagatttctcttcaaatttccaaaacaaacacagagagagattgacagaaagagagagggaagaaggggggagagagggagagagagagacagacacctgacagagatttggaagctctttcaatgtttattttcagctggtgggtttttttcactgggaactttattgagaagctgttttttgagcaaagcatccagtttcccttttattaaagcttagcttccttcttccctctcatctgttgcccacagtatctggagatgctgggtcccccattcacagtgtacaaggggctggacaacggttggggaaaagagggatggaaataattgtgcctatatcttttctaatcaacatatcattgcagcattgggctaggaataaacaaccctctgactctagcagttactaccttttttttcttttcaacttttatttcaggttcatgaggaacatgtgcaggtttgttacatgaattgatttcatgtcaggggtttcatgtgcagataattttgtcacccaggtaatacgcatagacctgataggcagttttttgatccttaccctcctcccaccctctaccctcaagcaggccccagtgtctattgttccgctctttgcatccatgtgaactcaatgtttagctctcacttataagtgagaacatgcggcatttggttttctgctcctgtgttaatttgcttagaataatggcctctggcttcatcagtgctctgcaaaagtatgtgattttaatcttttttatggctgcgtagtatttcatcatgtatatgtaccacattttctttatccagtccaccatcagcgcgtgtttaggttgattccacgtctttgctattgtgaataaagctgtgatgaacatacacaggcatatgtttatgaatgttaatgtctttgtggtagaacgatttatcctcctttgcatacatacccagtaatgggattcctgggtcgaggggtagttctgttttaagtactttgagaaatctccaaactgctttccatgatggctgaactaatttacattccctccagcagtgtatatgcatccccttttcaccaaaacctcaccagaatctgttaatttttgactttttatttatttattttttttgagactgagttttgctcttgtcacccaggctggagtgcaatggtgcggtctcagctcactgaaacccccacctcctgggttcaagagattctcctgcctcagcctcccaagtagctgggaggtgcaccactgtgcctggcttttgtattttagtagagacggggtttcaccatgctggccaggctggtctcaaactcctgtcctctggcgatctgcctgcctcagcctcccaaagtgctgggattatgggcatgggccactgcgcttggccaatttttgactttttcataatagccattttgagtggcgagagatggtatctcactgtggttttgatttgcatatctctaatgactagtgatgctgagcattttttcatatgcttgttggctgcatgtatgtcttcttttaagaagtgtctgttcatgtcctttgtccgctttttaatggggttgttgtttttgcttgttaatttgtttaagttcattagattctggatattagacctttgtgagatgcatcatttgcaaatactttcccctattctgtaggtcgtccatttactctgttgatagttgcttttgctgtttagtttaattaggtcccacttgtcaatttttgattttattctagtggttattactttggtgatcttctttaacatctctgagcctcgggttccatgtcagaaaaatttgaaaaatgtgaataggagtgtcatagaataagagacctttgagtcaggatatccttattttggatcctggcttgattgcatgctagctgtgttcctttgaacaagtaacctctctgagctgtagcttctttagctacagaaatgtgataacttatgaaaagcaactagcagagtgccagagacccagctgctgcttattaaaatgcatctattttgtctgttgtataacagtactaaccataacaatagtaacgacatcaacagcaacttaaagggagagacttaatatttatcaaatgccagctctgtatcaggtattacatacagcataaatatatattaagtttttacaaaaacctaatggcctagaaagttaagtaattttcattccagtgagatcaaatattacacaacgtattagggtattaatattttggactatgtgatgctagggttacaaattaatctccaaatctcagtggtttgataatggaaaggtttatttctctcctgtgcaaagtctgatgaaggtcatatgccttttgtccctcctgaagttgtgccagctggtgcatgtggcctccctgtagcaggaaagataagaagggagggaaggagcacagtggctcttaatgaccttggcctggaagtgacacctgccagttccacccacggtccgttggccagaacacatcacatgtgctctgccagttccacccacagtccattggccagaacacatcacatgtgctaacaccagagaatctgggatgtaaacgaagcacacgcacatgcaatatttgatgagcgctgtctctacggctcacaggtagtaagtgctggagctgattctgagtgcaagtcatttgaataacagaacccacctttttctcactatgctttattcttatgaggactaaaaaggagaaaatagtggtgtattgacttggtaattcttccttctccatgtgagaacaagtgcctcaccattcctcctgaaggatttgtttatttccattccctgctcccaactcctgttccaaatgccaggctatacatgaactctgacaggtgtgcacagggacccttgcctgggagggggatgaggctcttgctgccagcagttgctgtgtcacctgtggcttctcagggcacagcttccctgcagcaagccggggtgttagcaggctgcccaagacttggaatgttgacatgaggctctgcttctgagactgttcagaaggaaaaggcagttaggagaacaaagcctctccctctcaggatgtgctctagcctcatagtggggctgtcatctctctttgtaccttacatgcccttgcaaaattcagttcattgcatatagtgcctggaataccttctactgcctcccattccctacctcaacccctagccatgctcaacaggcaactcctactcatccctttaagaaccaaagtagacctcaagcctgcagtaagtcctccctgatgtctcaggcatttcagctcaattccattcaacatttagtccctggggaagcaatgtggatacaattgtgacgagtttgcaaacttctgcaccgtgatctctgtgcaaagaaaatgaagctgcttctttttgtttttaatctaatttaatcttctttttgagtctctactttgtgctgtggcaacttaaaaatttcaatacatggtatcttatggctctagatttaaccagtttttctgactcaaaacagtccccaccctcctaggaactcaaataggaaggggaagaaaggcacaggttttgacgtttccctcagtttatctaaaatgactccctttgggactttagccccagaggggatgttggtacacacaaattttgtggctttgggtctcaatgccaggtgaaggagcagctgacccttcctctccatcttatcgccttcctttctgaggagtctgtcctcatctctgtccctgggatggtagaaagagaatggctgccagggtacctgatgaatggggaaagatgtgaaagtagagggttgaatacattgcagatattaccctgattcccaaagggggcaaaacaacgcatctaacctcaaagcttagatgtccctgaggagtttgctaaaattgcagaatcctggaccctactccaaagattctgactctgaatatctggggaggaggccagggatgtgcatggtatcagcccgccaaggggctttggatgcaggtggcccttgacctctctcaaatgggagacacagctccaggagcctgaggagggaaaggaaagcagtgtgggcaaggacatggctcccccattgcagagtacaaatttccatcatgacacttgacatatcattctagcattctctgtttatgggactgtctatactgatggaatgaactccttaaggataagggaagttgtaagttttgttttatttacgttcctggtctatacacacgtttatgtgcctggtcttactgataccagctctcagaggctggtctgtggacctcggtagtaaaagcattattcaatggccagtgtccctttaagaaaaggaaaagaacagacctcaattgtacagagctggagcagtcctggccattaattcaaaatacatcttattattgatccacacaagacatgcttttatttatttaaatgttctattcattatttttaataacaaatgaagcatccatgcattcaccacacaaaacagaagctaggaagttaacaatcacttacgtgtaaccacatgactgcctttccccacctaaggtaaccacattcttgagtctttttttttttttttttttttttgagacagggtcttgctttgtcacctaggctgaagcacagtggcacagtcatagcttattgtaaccctgagctcctggactcaagcaatcctcctgcttcagcttctgagtagttaggactacagggacataccaccatgtctggtgaagttttttaaaaaaaactttgtagagatagggtctccctatattccccaggctggtctcagacccctgggcttaagtgatccttctgccttggcctctcaaagcactgagattacaagcatgagccattgcacccagcctcttgaatcttttgttaatcattccactgctttccttttcatgcagttgtattgcatttatatatattcccagtattttagttatttgaactttacgaaaagtgtattgaactgttgataatttgaaggaatttattttttttacttaatattaaactaggaatcatccatattactgattgctggagttcattgttttgatgacggtaggaaattccattgtgtgaataagccataatttgttcattcatgctttcaatttcaggcattgggttgtgtcagtgtttcttctattgaaagcactgctgctaagaacattcttgtacatgtctcttgttgtaaatgttcaagagtctcctttggggatagaactactagtagatttgcttggccataagggatcagaatctttaggagatagtgaacactcttttccaaaggtggttgtaccaatttacactcccaccagcaatgccgaagtggacctgtgtagccacagtctctttaatgctggatattgccctacttcttaacctttgccactaaaatgggcttagactacatcatcactgtcttcagttgcatttccttgatcaccagtaatgctgaaaatcctttgttctgttttctttgccactcgtgttttgtttctttgctatgtcttttcatgtcttttgactgtttttcttttttctttttgagacggagtctcgctctgtcgcccaggctggtggagtgcagtggcgtgatctcggctcactgcaacctctgcctcccaggttcaagcgattctcctgcctcagtttcctgagtagctgggattacaggtgtgtgccaccacgcctggctaatttttgtatttttagtagagacaggtttcaccgtgttggtcaggctggtcttgaactcctgaccttgtgatccctctgcctcggcctcccaaagtgctgagattacaggtgtgagccaccgcacccggccttttgtctttctgtcagattggttgtatttttcttattgatctataggatatttaatatattctttctacttatcttttgctgattttatgtattgtgaatatcttctcccagtttataccttgtctttttatttaagatgcattttcatgagcaaaagttcttaattttaacacaatcaaatcaatgtttttttagtcaaatttttgtgtgtgccttaagaaatctttctcagtcctgaagtctaaaagatgttcattatttttactaagaattctataattttagttttgatacataaatcctttatctacagagtttatgttttatatatagtgtgagtaggaatctgatttttgtctttcatttttgtttttttcccatttgaccacacctctttcccagcttcatctgctggacagtttctcctttctccatgccagtgtcattttgcattttcaggacattgctctttcctacaggctgtgggctgagttgctatagcctagattcaatctccggtgctgaggacagggttgctgtagactggattcagtctctggtccacaacatgcaggttctctgtgctatcgctcactgagagctgaaggattaggaaaaaggagtagcctctcctcctccagtcaagcccctgaattagtcttcagtgtgatgttagcatcctgggaattatgtgccaaggcatagcacttaccttctctcggcttgcactttctcaattatgaaagaaataattttccttatggtaagaaattgcttgggctcataaagctaccttcctgtagtttctttttgtatttgataataacagcactgaactgggagtgaggagacctgaatcatagtaaaaacaacatcagcagttgcaacagcaactgacgtttattgactgcttattatgcactggcactgtgctaaacagttaggtatattatctcatttagtgcacagttgtgagatcttgggcatgtcccttaacctctgtagaacaactgtaaatgatgacactgaacaagattttgtagtgttccaccaacaatgaaaatctatgttttaaaaaagtcatcctctgcttcacagtgataataattctgaatctttttcacataataccatttagtgccttaaaaaccctcctcttcccattgaaaaatattctcccaatactgtgttgagaagtattgagaagcattcccccagtacgtctcagcatcctgcctcagctgggggcaagggatgaggccattttatagaaccttaagtgaatggagggcaattacatgatgcattcgaggttacacagctggtcatttaacagtgcctcatgtgctggagcgtttcatttcttcaagaaagtaccatcgattttgaggacaagttttttctcatcagagcatttagaggcatcaaagttcttcaagtgaggagcccactttgcccgtttcaactgcagtgtcacaaagccatagccagcaccaaaacgtcccttccacactctggagatctgagaaggggttctccctcaaatcctctcttcctgttctgatgtgacagattgcagacttcattctcagagagaaaccttcagatccagaatcagagaagacagtgatttaatgtgctgcagaacaagtccaagagagatttatgaaagtgtctgttgggggtgagggtgcactgaagttaaaaaaaattggcatacaatcaaggaaaaaaatctgtcttaaacttccaaaaatacttagaatagcagctttcaatggccttatgaactacaatttaattaggggagaaaaaaattcccgatcacttctttaatagcaatgtaaataaactcaataaactcttcgtgtgtgtgtgtgtgtgtgtaatttacctcattaaaaatagagaacaacaaaatcactctgttctcatatctttcaaactatattccatgggattcttatctagttttggaatgattctttgcattaatggaagcatacataatgagggcatttatataaatctttataaggttatgcatttactccaaaattttgttttcactgtgaaattgcaatcatgaatgattcccattatgctgaggtggggttttagaatgtttgtatggtttggctgtgtccccacccaaatctcatcttgaattggagctcccataattcccacgtgttgtgggtgtgacctggtgggagataattgaatcatgggggcagtttcccttatactgttctcatggtagtgaataagtctcacgagatctgatggttttataaggggaaaccccgttcgcttgcttctcattccctcttgcctgctgccatgtaagacgtgccttttgccccctgccattattgtgagacctccctagccacatagaactgagtccattaaacctctttttctttataaattacccagtcttgggtatgtctttatcagcagcgtgaaaatgggctaatacaagcatcctgagacttttatgttgatctgttgaaatttgattttgctaggttatttttccccaacatcttagaatagaaggaaatttcctgaagacgacaatacagttgaattgaaaatttgctgcagattcatttcagttcaagtaatatttattaaaaatctaaaactgtggcagcactgtactgtggggactattaacaaaatacagtaataagtaatgtatggccaccacttatttaaccatgattttgtgccaggccccaaataattaactagtttaattatcatgacatccatgtaaagtgtaggtatcactattcctatttaacaggtgaggaaactgataaggaggtttaaaaacttgccagttaaggaggttttaaaacttgccaatagttacacaccaagtaacagcagagacaccattccaactggggtctgtctgattccccagcacacactgaactgccatgctggatgacttctggaacagaagagtttctgtccccaggagcttacgattggagaagaaaagatttacccaaagatctctttaaatttgagctcacacatgctgggcaggtaatacaaatgagtgaaggggcagggtcatagttattatgagatttgctaagataatcattcctttccgagtagatagtcctaatgtcaccttcacttgtatttttacaactcagattttctacttgcctattaaacatgtgggaaccttctttacttcacagagaaatctgatttctttaattttcctccctaaaacacagtgccatctggttagtcatccatatccccatgactgttttttgttgttgttgttgttgttgttgttttcttttgagacagagtctcattctgtcacccaggctggagtgtggtggcacaatcttggctcaccgcagcctccgcttcccaggttcaagcgattctcttgcctcagcccccggagtagctgggataacaggcatgagccaccatgcctggctaattttttgtatttctagtggagacagtgtttcaccctgttgaccaagctggtctcgaacttctgacctcaggtgatctgcccacctcggcctcccaaagtgttgggattacaggcatgagccaccacacccagccatatgcctatgtgtgacagagacaagtgtatggtgaaatgtttctttgctactaaggaagcaagagtgacagaaatcaatggccagtcagctctgggaggagagactatagggattggtgaggactggggcagagtctgtgccatgggtaaacaggacagcagtgaggcagggccatgtcaatatgcagacacagtgctgcttgatagtctgtctctctttcttttttcttttttttgagataagtctcccaagtggagacctgctgatttattttcaaatgatatagaaaacagacaaaacctacagatggacccagaatagcagtctctggtgcaaatataatgtttatagagttttaataaatttataaggttttcattaatttattataaataaattttataataaagttttatacaattataaatatgataacttataagttattatgtttataaataaccctataagaatgactattgccagaattcagtggaaacagggctgttggaacattggggacagttttatggagaaggcaggatgtcagccgaacatgaaaggccagtgtatgtgacacaggccctctctggatgacagcctgtgggagatcttggagtgtctgagctgagagatgcctgcttctcaacctcagcagcccttgggattcctccttgcctgatatgcttccttgctaaggggggccttggaccacaccgagacctctgctaggcatgcttctgaagatgttggcccagagatgggaaaaatggcatttattctttatgtaagttaggattatcaaaatattgtgagttgattgtaagacatttggaaatgtataaaatgtccatgatctcacgatttagaggaaaccattgtttattcttcctctcttttgtatcatatatatgatatgatatgaatcatattatatttatataaatatatatatttatataaatatatatatataggtctcactctgttgcccagtctagagtgcagtggcatgatcatagctcactgcaaccttgacctcctgggctcaagcaatcttcccacctcagcctcctaagtagctaggaatgcaggcacacatcaccatggctagctaatttcaaaatattttttgtagggacagggtctcactacattgcccaggctggtcttgaattcctagcctcaagtgattcttccacttcagcctcccaaagtgctgggataacaagtgtgagccaccacacttggcctgtatcatatattttatataattgggatcttgttttgcatgctgtgtaatctgatttctgaaaattattaggaacattttcccattctatttttaagggcttcacaggactctttgaaggacactggctatagtcaattttatggcttggctctgcgcccctgaccaaatctgaccttgaattataataacccccacgtgtcaagggtggaaccaggtgaagataactgaatcatggcagcagttttccccatgctgttctcatgagatctgatagttttataagaggcttccccctttgctcgccacgcattctcacttcgtcctgctgccctgtgaaaaaggtgcttgcttctcctttgccttccgccatgattgtaagttttctgaggcctccctagcaatgcggaactgtgagtcagttaaatctctttcctttataaattacccagtctcaggtatttctttatagcagcataagaatggactaatacaaccaattgtaatattttcttctttaaggacatttaggttcatttcattgtatgctagaaaaacttcctggaattcatacccttaatagacaaatcattgtcctctttgcttattatttgtttaccattggatgtgagtctcacccaaacttaccagtgtttgtccaggttttgactctcccttttccctacttttcaaacacaaaggtgcatgcacacacacacagaggattttgcttcctccctgtgtgatagactcagcatggagcagactgtgttgtccttgagttaaggagttggagtaacatgatccaattcgggagggacatgttttcacaactccgccgttatccttgatggcagggggtgtgtctgtgtgtggacgttccctgcaataccaagcacttaaatgcgaccacactgagagccctcattagtcctaggcagccaaagtagatttgctgagcatgccaccatccaggctggagagactgcccacatggaaccagacgccacagtggagaggggagccaattatccaaaggcaaatgagactctaattacagctttagctaaagagtgggaaattatttgaggagagacttcccatttctggtgtaggcacaacacaggacagttgttcagaataaggggctggatcaattcctgattttgctaccttacccgggatacttcacctctgtaagcatctgattcttcacctgtgaaaggaaaacaatatagacggttgacctcactggtttcccgtgagcattgaatgtgatgttgccggtgagaggcatagagaggcctggtccttagtaaggactcataagccaagtttcatcattaataactattactagtgctactattatttgcagtcatctggtagcatcatagaaggtacaactggaagtcaggagagctggagtctcagctctgcagtttcctgtgcattccaacttagagaatgaattcatccctccgtcttcattttcctcatttctcaaatgagaagcttgaatgaggggatacgtgagcacacattccctcctgaggtttgtggtcctaagctaactgtaacctagggttcagggtttgagttactctgtgcagcagcactcagcaccttccactgccacaagtgctcctggatggtgggaacctggctcctcagttactatttctggagttcttactaacacacagaggtgcattgtgctgagaaccatatatcattaccttcatgaatcctcccatcaacactgtcttacaagggctgttatgatcacctctttgcaggtgctaaagctgagatttatataggaagctgggatttaaacataggctcctaacacccatactaaatggtctctgtgtccacagtgttcagtagtgagtagtaatatttttgttcttataaatattggttgggctgcactcgaggatttggaagaactgggatggagaggacactcagcagtgtgctcttattgcactcttctctcttttactcagtcctttcaaaattgtaggcacaaaagtcaggaaggcaacacctgtaagactttgggggcagctcctgctaccttagccctgtctaactttctctctctgtaaaatgagactgataaacagttgctctgccctacttgcctggtagagtcattttgagctacacgaaggattgtatatgcgtgtgtgcattaaagaatttgcacattgggcatatcgagtgtttgagctgaaaggaatgttagcaaccagctgcccagagatagtcaaattcagcaattgagagaaaccctgaaggggcttcaccttgggtgtataacaagcaggcccacttctccctgcttcttagaatagctcactgtatctatgtctctgtcagtctactgatctaccaatctatctatctatatatccaagaaaattttcagcaaaaaaattctaagtctaaagaagtatgtggtattcgtttttctgtgcctggcttatttcagttagcatcacgtgaaaaattgatctggctctgatgagggatgttgatagtggggaaggccacgtgtgggtggggacaggggatatatgggaactgtgtacttttgactcaattttgctgtgaacctaaagctgctctttaaacaaaactactccaaaaataaaaaacaaatacagtacaaacattgacctgaattaccaccacccctgatccattttacagaggaggaaaaaaggccctgaaagaggaagtggctcttctaaggctactgagtagaagagttaagatagaacccctggttcagctttttctgcccacataccaatttacttaccaattgttagcactgaaagtgtggccctgtccctccctggcttaaagggtacacttcagtgacttagggagggggtggtggggcttcagtttcactgcctgtgctcatggtggtgcctgtggttggggggaggggacatctctgccattgctggctccctggcatcactgtgcctgcgattgtgagctgttggtggtggtgtccaatggctcacactggctcattgctgggacagtgggataatttcctagggccagctctagaggaactcacaagatgattaggtggtggctgaggttcagatgggttcaggctttctgccccaccagcttctagctatgcaggtccagccatctccctgtccgtctctgtctgtctctcatttgttctgtccccaccccacccccgcatcatcccatgcagccccttttctaaaatcttctgcttcaccccatccctagaggaactccccctttccccttgctctcttcttaagcctgaacaactcgcatcagcttagacaccagccagttcctagggaggcagttctccactcagtcccctcaggttccaggtgtggaggaggtgtggtgactgactgtggccccgtagagagtgtaggctgcaggaattcatcccgttgcatttgccctcccagagagagctctaaccagttttctttctgggtcaccgaagcagtaaggcacaccttgccaaggtgagcattatttttttctcagacccagcgtcttctaatctactttgggggtcatgtatttccccttccaccatggctttggccttgatccttttggatctagcaaccctggcattgctgtgctaagaagcatgtggctcttgcccatccagcgtgagcccagtttgccctggtgattgccaccttcccctagctgtaaactctgctctatgactgaggagggacggagtcagctctggttagatttgtaagttttaaggctcccccaacccaataaatgtgtgtgtgtgtgtgtgtgtgtgtgtgtgtgtgtgtgtgtgtgttgaatcgttctaacacaccttccaaaatgcatgggaaagttgtcaacttcttttctcatggtgtgttaaaagaatttggcatccaataaagtacctctgggccttgtgtgctggcagcttctgggcaggttgacggtttcctccctgttcgtatttgtttcatcataagccaaacaaaagcactgagaatccatgtattcgggatctcaggggcctctcctccttctcgtgcttctctaagattttccttgtgcttacgtaacaccagcttcctgacttcaggtaaagagtgtgtgttttctctctgtattcccagtaactggcactgggataggtgtttgaaggtgaaaggaccagttgccttcattgaaagatggtaatatcgtctattgaagaaaacactacacagtacgtcttcacttattgtcatccataggttcttgggaaccgtaactttaagtgaaatgatgtataacaaaaccaattttgccataggctaattgatataaacaagagttaagttcctaacttaaaatatcaccataaaatatcgccatacttctaaataaagaccaaaacacttctaatattatacattaaaataaatgtgagctatacatacatttaagaataataaaaacaagtaagatcatgacttacccacttattccagttcagggtcctggtggctagagcccatgctggcatctcagggtgccgggcggaaaccagccttggacaggatgccattccgtcacgaggtgcactcacacacctatgctcactcacacagtggccatgtggacatgctaaatgaacctgatgcacatgtctttggaatgtgggaggaaattggagtacctggagaaaatccacatagaaatggggagaacgtgcaaactccacagacagtggccccagctgggaattgattttttttctcatcaaggttataacaaaacaacattgaatgaaacgatgttattcaagacctgctgtgctaagagctggaaaatttaaactctagtccaggaaagctactaacaagcagtgtgaccttggacaaaccacttaacctctctgggcttcatttcacattgtataatcagaatgttggatctctgagatcctgttcatctctgacagtcagccagtctctgttgccaggacagcatagaacaagagacagcagcttcaagtactatttaaactgcctgaaaggcattctgttatcctggggttttgtgggcactagtgtcagcctgacatgaaagacacagaaggactcactgtgtttggatgtacccagattagggtattgtccacacaggccgtggtgtgtgaatccagtgtgtcattgagaggcttgttagaactagttctgtgtttcttggcatgggacctggaactctaccactttctgcccttctccacgccccctctcccgcccccacagagaggggcagcagtcaggacattgcccccttttgcaggtggatgtttctctccatgcaagtgtttgtgtgggtctcaaaaatttgcttttcatcaggctcatccctgccgatgtcccagatttgccagaacccccgtctgcagcaggatgctttgttttgtttgttggtttatggggattctgggctctgtctctgggtgcagtggcaggttttaaaatcaattacaatccaggtaacaggaggttcaccacagcactctgctgtctgttcaaggcctgtgctgagaaattaagtaggtcccagttacctctcagaaaatttgtggtatttcaggggactacagcgagttgcaaatcttgataggtagtgggacctgtcagcaaacagcagactggcttatgttgtggttcagcaggaaaaggagagaataattccctgagcataagatgtgttgctccctcttctagtttatcaggagatagccacatacatcaagagacagaccctgggtttggggtacaagcaggagagctggttatttcttgctctgtttccaagaagacgggaaactgtggttgtagtctccttattcgtgatcaggttccttgcagctgtttcatctccaggcctaaagctgaccagttactcctttctctgtctcctgccaacctagggggagaacactaggcagcttcctccttagttttttttttttttttttaatttcttgattcatcctgggaaatgggtacatccacagaatgcctgctgtgtgattgcaggtctccaggtccttctttctacgccttagggtcagaaatagggggaacacagagagcaggactacctaactgttttggagaaattcaacagccatgtaggtcttcggttctcaactgcattcgaggtttgctttacccatccttgcctagaggggatttcatccactctgctggctcaatgccatcctgctgcctacagctgcaaaacttaatttttagtctacgtcttcaccttcatcccaagacctgtatcgttaactggctctctgacatatcaaattccacatgtgatagttggagccacatttttgatgaagagaggcaatgtttagaacaggttttccaattcaaaaaatgtttattgattctctggcataaacaaaacattttgtagccatttagaaaatacaaagatgatgaaaatatggtgatgtcctcaaggagcttgcctttatttgcaaaatgaggcattctttattataatgcagaatgaatattttatagtagagataataagcaaagcgccatgagacttcagaggagagagccagaggatgttaaagtcattcttgtagtttaaaacctccaaaagattatttaaaatgaacaagaaacaccaaagaacttcagaaattggaaatattcaacttttattatattagatttggtaacctctgattttttcatgatcttgactttggccccaaatgtacaaagagtgtttgttggatgatctccttaccaaagtctagagttccagagagccatttcagggttttccatttggtttcatagttgaattgtattcatcggtgactttggaaaagtcatgtcagttttttggttcttggcttcttgatctgtaaaatctggattatagtggggttaaatgtgaatattaaataacaatgctcaacacagtccctgaatggcaataaatgctagataaatgatagtttgaaattagtatgattattatttccattttaattattcattaataattattatacccatttttattatcagtttgaagttagagacactgtagagcattaaaaataaaaagttgcttaaattgactttttagaatatcaagatagaaaaaaagctatgggagaaagggtgttcatatatactataataattacgatactagttacttttaataatttttataaaaacttacaaagtaggttgttatcactattttacagatggataaacctgcttaaatgtgccagttctttccaataagcaagcttgcagatacttaactaatttttaactattgatgtatttgttttttcccctcacaatctactgtctcctaggaaggcggagataaacctgatagtttgaaattagcaccctcttttactcaaccagcataaaggactgtttgacccaggcaagtgatgaggtgatttgtaaggccaatttaaatcagtgtcttgcccactggctttcaaagtccagggatgtgcaggtatatattttgggcagtcaggttctgttgtgcgtggattgtggtcaatttcattgatttttttttttttctcaacacaacagtttcaaaatgctcttttgctccccaaatagctgatcttttcaaaccttttgctattttttcctggtaagactttcaggtaacagtgtaaatgcaatcaacaaccacacatttcagacgatgatgatgatatttttgaacatgtttaatgatttcacaaaacacagacgggaaaagttgagtggctccttggagaaactgcctaatccaacctcttcattttcagcccaggaaagtgtggttctgaggggacatgacctgcccaaggtcacaccacaagttggtggcagaattgggattaaaagttaggaatccagattttagtttctttctttcatttgcagagtaagcaaaactattttccttggcatgaaagataatttcaggtgtgtacaaatagagtactgtatccagaagggaagttcattcattcaattccttttcaatctttctgattatgtcaacgattgtgtatctttgctgttttgtttttatctttctctaataatctcctttgataacaaagatggagcagacatcaggctcaagcttctcttagtatttaatataagtgtttatttttattgtattgattgttatgatatcttccatttatggcaaaggatactggttttctggttgaggtagcaaagttttctttcaaaataaacttaagcagattcaaatgaatttactttatgaaaaatattaagtaaacaatagtgcaggtggaaattatgatgaatacatagcaggtttcccactgaaaaacataatgataaactaaagcttggaaaatacttgactggattttgccctttagaaagctctaagctctatgaagatagatatggctaaatcccagtttccttcttattcatgtcatgtcctttttatggagcagtcagaaaaacaatcattagatctaaaagaagatcataaaaactacccgtataagagatgaactcgtatgttgataacctcattatgggtagcttccctacaagccaaaaagttggatcagcagccaatctaatttcagtatggaggtagttttgtttatattttacgttataaacagtatgtgaatgcatttgaaaacagaaactagtttcatttttcaggaactgatgctgtattttaagatattttataccttattcttgcctttttatccttcctaagaagttctctactttctgatcatcttgctcttccatcagagagtgtgaatgaagaaaaagatggcaaaatgcaatttatcaaatattttcccactattaacacattttagagattagcatatatagaacaaatggaataggaatattaaagttattcattaaaatggagagtagaactctccacatatttctttcatctataatttaccaatatcaaatgaatacctggaaagaaagatgtactagattgcagtatttgagtgtttttcccattatctttaatagcaattcttccagtattgcttaatttgtttccctgctccctaaagcagaagtttcttcttagctatgatttagttatccagggatcctggagctctgaagacccattatggtttggctaagatgagcttgcctttcctaaatgccacacacaactcattcatgccccctcttcctgtgggcttcttctgctggccattagtgtttttttgtggaatgctccttcattggaaaatttattctcatttagaggaatctggtgacaaaaaaaagaaggcggagtcaacttctggtgacttatgggcagttagagtcaaacgtttgaaaaatgggcttctgaatcagcagagattttacaaagtgactggtggaactgcatacaaatgggtagagtacagagatgccaagaaataatgctacttctattaccactaataaaaagactgcatttcccagttcagggctagaaaggttaatgatgatacattcttttttagtatcaaagattaacatgataacttgcatattaaagttaattcagacctactgctaatggaaggggcatacaaaattaatttctacagcacctcataaattatgatcactcactcttctttggctggtgttctttgtcttggcaggggctgcatgtgtacttaaagtgggcacacttcagttagtaggggggcatctttggcccctgaggaatttgggaagcttggggtgtgtgccttgtagctcttaatcactgcctgtctgccggtgttttcctgctggaatgtgtgtactccattaccagccagcttgttgactggcgtggatcttggttttaatatttaatgagatgatgaaaccgagctgaaatgagaagaatgtggaaggtgggagaaagaatgggaaagataagaaaagagctgccctctcttgatggcaggagattctccaagaagagttcagcacagcatcttcaggcaactatttgctgtcctgttgagtaccaaggcccagctgacatagaaacatagccagcccaatctttaagagcaccggctctggagtccaagtacttgactacaagttccagtataatcccttgggtaatttacttgactttttcaagacttactgtctgttttaaacaggaaaaataatatggactctatgtatacatgtacacacacacgtatttatattttatataaaattaaatacaactttagtataatttacatatagaaaaatgcacacatcttaagtatatagtaaatctattagccacgacccttatcaagatacagtatattttcattacccagaaagttacatataaatattttaaaaactaaataacagtagcttatacttttataatgctttccatgggccaggtatgctgatctaagtgctttatgttatcttgtttcattctcaccaagagaggtgctgttattatttccactttacagatacagaaacaaagatacagagaggttaagtgatttctccaagatcacacagacaataaccgatattccacttccgcactctgctcaccgttgtctatatagcacttaccatgtggtctattactgactaagtacattagaggaatgagaatggagcctccttgatggccgacatttccttccattcctcttcttcatagtccagtttatcattccaccttgtcttgggctgacgggctgtgcatggtactctagcagagtctttgagggaaaagatggttccatccctaccttcaacactcagatgcatgataggtgctctagaagaagtcattgactgttactcccagaaaatcctgtcccccagctcccacccaactgtcactacttgaaattttgacaaacttacaggtgggctcactgggccccctgccagtttgggctgcttagccacctttgggctcagtcttaaccttgtccttttgatagtctaaaaatttcaagtgaaaatccctcctgtttctgggcctgttgtggctcccttgtcccagcttcccatactcatttctcctcagtcagtcctcattcttgcccagttgctatgcttttcctcctccacttttgctttttttttttttttgcctcctcttctgtgtctgtcttctctttctttgcctcctctttcttctttttctccgtctttttttcctcttttacctcttcttttttctttttctcttcattcttcctctcttttttctgctccttttcattttatcatggtcttcatgagcaccaccaaataaaattaagaagccactctctgctaaatgcattgtaattgcccatgggaaattattttttttgtagggggcagccgcatccactgtatctctcatatggttaaactgatgcttacccatttgtactagattattttcagacatatttagccaatcattcctttgacatctcgttttgagtgtcttatagatactcaaactcattatttccaaaactttactcattcttttcaagaaaaccttctgctcttccatgatttttctgcctttgaacctttctcatatatgccttgaatctggtcacatctctctctttatcacttgcatgctggtcctgtacacccgtgtgtcatatggaatgcttggcatttggcagacgcttgacacatactttttcacatgaatagagaaacggaagtgccatggagggacaagcacacgctcatgaaacctcctccctttattttttttatgtttcacaagagcactaaacacagtcaagtgacttgaaaccattagcttctctccagttcttttcagagctaagatttcacaatttgagtcaaaagcagcaaatgactactaaactcagtgtagaacattaacattaaaacacaatatgaaaaatttctttaagaatttcgtgccagaaaaagctatggttcctgcaaggaatttgtcctcttctatcctaatgatcaacaaactctagaacttggagggctgcccttatggccccagtaagggcagttggagctcatgttgtcttttccattgggatgtcatctttcttctttcattctttttggactaaggtaatgtataaagaaatacttataactaataataaacacatgaacaaataatgtgcaaaattacttgcaatttcataggagtacaattgtagattcatgttgggggcactgagcataatttgaaatatggtatgtttctttttttaacttttatttgaagttcaggggtccatgtgcgggtttgttatatgggtaaacttgtgtcatggggatttgttatgcagattattttgtcacccaggtattaagcctaatacccattagctatttttcctgatcctctccctccttctactctccaccctccgatagaccccagtgagggttgttcccctctgagtgtccatgtgttctcatcatttagctcccacttataagtgagaacatgtagtatctggttttctgttcctgcattagtttgctaaggataatggcctccagctccatccatgtccctgtctccactcatacctttggacatgatcttgttcttttttatggccacatagtattccatggtgtatatgtaccacattttgtttatccagtcttttattaataggcatttaggttaattccatgtctttgcaattgtgaatagtgctgcaatgaatgtacgtgtgcatgtgtctttataatagaacgaattatatttatttgggtcaatacccagtaatgggattgctggatcaaatggtagttctgtgaaatgtaatatgtttcattgtacatatgttttcttactgctcccatcaattgactgcttctttcctttagtacacatggactgttcaaaggtaaggagcatatgttgtcatctgtttgcacagagagctcattacatgtctttaactgatatttattatctttatttcctcccatctcatactttccccagttcctcttttattgctgtagagtccaagcaaaatctctttgatcctcttatttaaatattgggcctaagtttatgatacatttcttaaatcactctttgctttgggccttttagggaagggctccccttggctctttttcacaagtgaagaaataaagcaggcaagagcccctgcctcaagtctgtctcatctctctatcttcttagctgagtgcttttagaaaagaaaaccaggccagcggataaattcttcccatttccatttttatttatagggagaaaaatggctgtggttttttcctttcctctttgaagtttgcttccagttcttcagtttatttgaaatatagtatacttcttggttttccttttgtaataaacaacactaggttttaaatctgtggagctgtaaatgagaggagcttcagcctcctcttcttcagagctgatatggggaaggtaagggaagaggagaatcagatgatgattggaaacaattacacaaccattccattttgctaatgcttgaatccaggataattttctcatttaattctctgaaatgaagggcccctctgttagccttaaaatgtaaacaagaggcttttaatgcatgattttcccagaaatggaatgctagctgctcatattgattcaaaacattgctgttggcttttgttctttttggtatttgtaagttttgtgatgggggcaatataggattgttcatgtgtggcttgaggattgtcagtacgtggtattattattctaagttgcaaacagaaattaaaaaggacattcagagaacgcttgcctgagccctccattagtctgtccacatacaaaagggaaaatggaaatctgaggcatatatcccaattatttcaatttatacccacctcttggaactcaattctctgagtttggtattcagaccaaagtgtagtttgtttgaatgatgcagataatagctttaagtccactttattccagcctgtctggaccaggcatttgtaaaatttataagttagcaacagtggaaggaaactgaagctttaacatgctctcctttggactgaaaaacttctgcatagcattggatcccaatgcctcattgcacttaataactgcaactgaatttgtatcatgttttactttgatcttcttatgaaagagtcattctcatctccatttttggagggagagaagtgaaatggctcatccaaggttacacacagcctggtggtagtaaggctgggattcaaacccaggtctcccaacctttaacccaaagctctacttactatgccatgccttcctctatgattaggtaaaacggctcaggggaggtggtgaaggtaaagaaacacacatgcagttctccttctacacctcccatcccacccccagctgctaccacctagtttcctcaaggataacactgaataatgagtattgatcaatccaacactaaacagggttctgattctgtgagttgccctaaatacgggccccttatttgccttcagcaaacactcactcattcatctaacacttactaagatcctactggataacaggcattgtgctaggaactgtaggagacatgacttgattgagattggatatctcaccccaggctctcactgtctgatgaggaaaaggtagcgaatggcttgaagtcatgattgctgtttgctagccaactgcaatgcgatggggaagcccaaccgactatagttgaataaaaaaatgaaagaagtgaatgattggactaaagactcaaccactgagttgactaatgctcattattgtttaattctgaggttctaggactgagatttcttttcagtcccctgggactgtaacttataaaaccacaacaaacatcaatcaatcattaaacagaccaagctatccaggtcttggattttctatttaaggccaacttaagggagttaacaaactcagagggtggctgcctcaagctagcagaatctagaaattggtaataattgccctgcactcatgagccggagtgagtggggctggaataacactggcgttggagtcagacaggtccatgctggggccttgcctctgttggagacacactagctgggtgagctacatggagctcctattttctcatctgtaaaatggggacaatgcaatccattgaataggttttggtaaggattaaataaattctcagtatgatgcctaggatctagcaggagttcaatgtacattgcatatctctcacaattaatattccactctctcactccccttcacaccaataatttctgtccctttaaaaaaatatgttatagtgaccctggctgctgagaagactctatttgagtatgtgaccatggactagctaataaagagataaaagtgtaggagttcctggttaagtagagattgagagtcatgaaaccatggaattctatgagtctctagaggagactggcatgagggaataagggattctgtatggtgtgatgtaaatgagagacagtgggtcagggatgatagccctggaagggtgtgggaggtgctgaccaatctgataggtgtcctgagcacttataaatccatgtgaattcagatgtcatcgaattggaaatggtgtcaaaggatgtgagacacagatcttcatagtcacaacgttactggactcatttttcctcttgcatgaatttgaagtagagcactttcctaaaaatcttgctttatttatgtaatgtgtgtgtgtgtatatatatattttatatatgtatacatgtatatgtgtatatatattttatatatgtatacatgtatatgtgtacatatattttatatatgtgtgtgtgtgtgtgtgtgcatatatacgtaaatattttttaaagatgagcgtcttgttatgttgcccaggctggccttgaactcctgggctgaagcagtccttccatctcagtgtcccgagtagctgggactgcaggtgcatgcccagcacccagctaggaatccttctttaaagactgtcaagattatccagtacagaggcagcttcgtcagccagaagcttttttatttgctgctcctttcatcaccaggatgaagaggtgggtgcacagtcttccaacagcccaaactgcattcatctggtgtggcactgcaaatgtaatcattctaagcattaggaaacaaatcaaattttgggtcccaattcaattggccatatatgcatttttatttttctaaaagcactttctaaggagctggattggctttttatttttcccaaagcatttctaaggagctggatttaatgagcaagctagcaatgaggaggccagccagcagctgcaggcaagtgcagtggggtaactaagggtgcaagtacctttcagaacacactatttatgtcctagtagctttcagaaggcgtgatgataggctatctcagtggccatttcctgccatcggagagatgttgatgggagtctttcattacttgccagttgaggccaggaaatggtctctatgattacaccctaatttgataaaccctaaaatgaatctattgctgtctcactcaaatgctccaaaatgcatatgcttacacaggtatgtagcacatctaatccatcagcaggtcatgtcgactctgccttcaaaaaataacccatgttcatcgacttccctctgtacttgcacccttgtctctactgctgcaaatgaatcaagcttttgtcttctctcccctgcactgttatagtaaggaagcaggatagtttaataggtatgaatatgggctctggaatcatatttcctgagtttaatgcagctctgcttactagctgtgtgattttaggcaagttactgaacctctctaggcttcagttccctcatctgtaaaataggtataatgatatacttcatagagagaatgcctggtagacagtcagggtgcaataagtacaagaccccttctttacctctacagaaagcctcctcagtgttttcccaccttcctctctaggtccgccattaaaaacacaaaaatgaaaagtgtttatcactacccaggaatcaaactttttaccatgggccccagggcctgatgagacctggccctggcaacttctccaaatttatcatctcacattaaacccctgtttcctgcaatccagccacatttgtgtccacatcattcctccaagttctgcagatttccaccccagagcctttccatgccctttcctctccaagtgtgcctccctgaaatcagtgcatgcagctgccttctccccgttcaggtctcagcttaagtgtgcccggctcagcgaggccttcgttgactgcactgtatgaagtggtcttcacaggcccctagattctcttcatcctgtcacctggttaatttccttgctggtagttatcagcgcccattgttgtaacatcagctctcatggcccccaactccagcacctgcctcccagggctgccctcgggctgcaggaccctacttttcccgggaactggaaccaccgaaagcgcagtccacccgccgggtctgaacattccaggttcatcacccctggagtctacactgtctccagaactcctcataggattgagttcaaaagttaccttttgtgaggcttgcttgatttttgtactcggcttggcctccttccctccacttccccactcctcttgcatatttttctggaacatctcctaataagtcctcttcatccaaacttcatgttagagtttgcttctggagtatctaacctaagacaactattatcttgtttatttaattatttatagcactttagcactttactagaatataatatccatgagaacagtgagtattgactatgtgtgtatgcatatatatgtatatatatttaaacatacatgtttaaggatataaatatattgcatgtcgactctcagagctttcaaattatatttataatcagtgtgactttttgggatacaaacatattcacatcctgttaaaagttatttactttagctgggcacagtggctcatatctgtaatcccagcactctgggaggccgaggcgggcggatcacgaggtcaggagatcgagaccatcctggctaacacggtgaaacccgtctctactaaaaatacaaaaaattagctgggtgtggtggcaggcgcctgtagtcccagctacttgggaggctgaggcagcagaatggcatgaacctgggaggcgaagcttgcagtgagcagagatcgcgccactgcactccagcctgggtgacagtgcgagactctgtctcaaacaaacacacaaaaaagttctttactttgggaggccaaggtgtgtggattgcttaagcccaggagtttgagaccagcctgcaacataccaagaccccatccctacacacacatatacagtaacagttccatcagttacatgtcagtccaccctccctgctgtctctgtgtttctaaatggcatgagccaacttatagggtatttgcttattaggtttagtgcaaaatcactttttacgttcaatataaaggatatatggtaaaagcaagagcttggtttggactttcgatggatatctagtataaagttctggaagtacatttttccttaaggatttaccgcctaactatattttctcccttctaagatacctggagagaattttaaccaggtgctgagttctaacatttctaaataggccgggtttgtttagctgggagatacattttggtccccgaggggttcataaagtggagacgtagatggcgccggaggctcgccagagggctgcaggtgatgattctgggtgttgtaatgaggcatgtttctgggggtgaggcaagtgactcatggggagctgctgaagaatgcgttgggggaaaatgctagtgaagttgtaaaaggcttgtaacctgatctggaatatgaaatttgtgggtagttattgatttcccagtgggcggaattagttttcttcgtgatatgctggctggaggagggaggttgtgagaacaaattgctaactgtcagactagaatcatgtctatggagatctccctttgtgtccagttgatccaaccaagtggctttcaacatctgcaaatgctcgcaaaccgaacagaagaaaagcagcctggcagagcagagctggatttacactggtcagccctgcctgggagaattttgggtttcaattacacagggagggcagggtgagctgtgatatctatagcatcccccgccccttccccattgccagtcctccgagagagttgagctgaggagaattcgactttcagtcaataggaacttggccaaagccgaatgaatttcaccttaaagtctgtgaaaaatggaacaggattgaagagtcgattaacccgtgctggtgacaaagtctggggctggttatgagtggaatgagattccaagtgcaggctgccacagtcaggcttagaaacgtgggcactcatgctgaggatgtgactgagccctgacacagatgcattgcttgtgtttaaccctcttccccaacactaagagaggggctagagaagtaccgtgcactacactccagaatgtcctaaaatctgtattctgatggtgggaccaggatgtacctgggttcacagattggcaagcatttccctagcagggatatagtgtccatcttgtcttatgttttatgagtgattctttgggttctccttctctcaacatgagtttcatggaggagaggggtaatggcatatcccatggaaattgcattatatcaaaaggccactgctgaccttctattatttctgggtgagtgcatgtggattggtgtagggctggtcctgaactggtacctctcaaaaaacctggagggatgatggtgtaccccaactacagcttgggccttactttcatttatgggatgacagcaagaatctcactggttttcctgttacatagacaatgaccatatcgtgtgataaatagtaagatggaaatatatcgaaatatattctgggtgctataggaatgaagaagagtcacccaaggcaaaggcggggtgtcaggaaaatcatcctagaggatttgacatctaagttaacagctagaagggaaggagtcaggagaagatggctgggacaagagtattctaggcaaagaaaataacatgcaaaaattcaggagaaggagagagtttgtggttggaacagagagagggaggtggaggagtggaaagtggtgagcgcccacgatgagttaagggaagagcttgctcacagatggcctccagccatgccagagagttgaaaaaactcattctgagggcaataggaagttactgaagaatttcctgaccacaagggactcctgtgcagggagcaggtagggtggttaggagacttgacacagaacatgaaggaagttggcttgagggtagaatggacataacttcatgatggattagatgctgatgtaaagagaagaactgaaagatgatttctttgcttggttgactgtgtgactgggggtgtcctcactcttgagagacagcaaaggagaaagaacagacttgtggggaagagggtcaattcagatatggtttttagaagtgttttctgctggagctggattgtggctgtgattgcagatgtgattttggctggatgcacctcaaggtggttttccaaagtgacaaagaattttcatttagttcttccaatggagctgatactggcaaggagcaggtgaaaaaagggtcctcttatttgaagtgtccctgagccatcaaataattgcaaaagcacaccacacttcaagagggctttgcattcaggtaggtagcactgaccgccacatgacaaaactttcctaagggaggacccagaacccagaaataccgcattttcctctctgcagtcacttggacaaagaaaaccctttcaattaaaacccaaagagttgagtagttctgcagattcccccatggctggtctgaattataatttggacttgtcactcggtggtaagtctcccagcctttgtcagacattggatacctaaggcaggaacccagcctgggtgtgcaggtctctgacattcattacctctgcctatgaagatttatttcagggtgtgaactatttatcttcaaaaccatttgtgtttgttggcttgacaatcaagcagcaatttggaaatgctgcttcctgaagctttacgactaatataatttcacagctccaattacaaatgagaaaaattatttcatctacaaacaggagccagacatttctgagaaatcatggttaaagagaagacagagtaccttctgaaaaacaggccatgttattaatggtctcttcagtgaaaatcttgctgactctccacaccatgagcctccatcttatggggatgctggttttgagaatctgtaaagcagctgcctttcaggttgataaaccattgcttctcctagtgcctggtctgcagctcccacagcctcagtactctgtgagcaaggcaaacacccactgtctttccacctagcaaatatatccttcctcctgcaacttcctcggaacctatgttttgtagaatcctagaattttgcatgtggccttaataatcattcagttcatcccttcatctgatactttacctcttccttgtgcctatctatagacagcaacctactacttgtatacttctaggaatggagaacttactgccagactttcccgtgaaaaatctactagcttagttcaattttaagtgggatttaaagtctggtgacttaccaaggagatctttcatatctaaaatctcctaagtggctttttccttggattcatatcttagtaatgggatttatgtgcggtatctcaactagagtgctaacagaatgaccttttaaggaaaaccctgacctcagttattccacagctctgttttatgaccactcctaataggttgccactcctaagatgtaaaggtactaagtgtttttcctgtctactcaagtctgcttcttatctctgttggctccgtgcagtgctgggtagttaacccttggtcattcctttccaccctagaatagtgactggcacatagtaagccttccataaatgtgtagaatgactgactgaaagagtcagttaaatgtgtgaatgggttagctcttgatctgcctttacatagttccttcctgtaggtccaactgacctcattttacaggtggagaaagttttaaataatttttaatcttgagccacaaaaagctattttaagccttaaaacattgtcatcttgtactttaagctcaaggcaattgaccacgcttgatttgtttcttactaccttgcttcaagagtttatcaaatctttagcttcagcagaatccaaatacgttatgtcagaagctgggaatctaggggacaacctgcgcactcttatactcattgtcatcacctggattgtcatcaccatggcatcttcactgcagtgacacagatttcctgaaggcacatcttttggtgactcccttttacccagaggactgtggaaaaacaagactttctgttgtattttaaatctccttttttagaatctcttattttacttttcaaagaggaagactttaccactttatctaacttagtaagataatgcacaatttttatcttctggttgggcttaattatcacatcaatgaaggcataattgggaagctaagtatcattaagttagggaagttattcgtatcccaatgacaaagcatttaccacttcagatgaactcacctggtttttctacaacaagaatttcaacacctaatttccctctagcaaacaaaagattgcaaaattacaagttcacatccttttgaagataacttttagccaggcaaaagaaaaaagagaagataacttttaaaataaactttttaatgaatattgtaagacatttttttaccctgcttaataaatacatctggatgaaaatctcaactttatgatggcaagatatggactaaatatttaacttaagtaatagggtaattgataaagtaatagatatattttctccaactttcttccttatctttctaaacaaagggtagtggctaatcaatgtattgtactctcaaaagtccttaggccaacgagttggtttttttttcttttgagacagggtctcactctgtcgcccaggctggtgtgtagcggtgtgatcatggctaactgcagcctttacttcctgggctctgatcttctcacttcagcctcctgagtagctgggactacaggcatccatcactatgcccagctaatttttaaatttttggtagagatggggtcttcctatgttgcccaggctggtcttgaactcctgggctcaagttatcctactgcctccacctcccaaagtgctgcaattataggagtgagctaccatgctcagccccaacaatatcttcagtccaaatttctcataaagtgtcattaaagctgtggcctatgattctatctacaattttaagcaaagcagaatcaaaatttttgtcatctataattttctgtttccatagaactgacacttccattgcaattaagaacacttcttttaagtgttatctttcattattctccttccaagagaatataaccctagatttatattctctaaaccaccagtgttccctaaatcctcactcttcctattgcaatattatccacttgtcacggactgtctcaaatgccacctcctccattcattcagccaagatttactgactcactgctatgaaccaggtactgtatcaggcacttgaatattagttcagctctcatggagcttaatctttagtgggatgaatggacattaattacgtttattggaatttaattaaaaactgagatttggctctgagagaagggatatactcttattagatcctataaagtcttctatgaaccttctgaccagagctcatgagagggcttctgaagcattcaatttgttttgtgactctgtaaattgggactctttggtttcaagcaacagaatcctactctggtaaatttaagtaaaaacaaatgtatttagaagaaagggaataatccatagaatcagaggaaatgctgaggaactagttatcggagaggagagactcagaatcttggagggagaggggactcagcatgtgcccctgggcagcctccttggggcacttctgggatgaaagcggagcctgagagactacatatttcttttttctttttcttttttcttttctttctttctttttttttttttttttttttttttttttgagatggagtctagctctgttgcccaggctggagtgcagttgtgtgaccttggctcactgcaatttctgcctccctggtttaagcttctgcctggcttaagctattctcctgcctcagcctcctgagtcgctgggattacaggtgcctgccaccatgcccagatagttttgggtttttttttttttttttttttttttttttttttttagtagacttggggtttcaccatattggccaggctggtctgacactcctgacctcaagtgatccacctgccttagcctcccaaagtgctgagattacaggcgtaggccaccatgcccagccaagactgcacatttcatgtagtgcttaagagcacagtctctgcagtcgggctggatttaccacttactagctgtgtacacatgacaagtccctttgtttcctcatcagcaaaacggggaaataatagtgtctacctcccttagtcactaggagaatttactgagatgattcatgcacgacacttgcaacagtgcctagcacattgtaagcactcaaaatactgtgtattagtaccgttggcagttatcattatgaacgttccctcaagattcagatttcaggaggccatcctaattggggccaggtgtccagcccttctccaggggaaggcagggagcctatgacagcttctcaggattatagcccatgacagtatgactcccccacgtacagtcagggtgctgtgccagaaggagtgggtgtagctcttgggctgacagaataagagatgtcctctacctcttctgacctttgtcttattctaatttctgccattgttcattggttttgctttttttttttttttcctgtaatcacctctgtcagtttttaagtacctaatgggcagaaccacatcttatctctgtaccttgataaggagagtatcttcacattaaagatgtccaacatctatttgttagatttaaaatgatatcctggtgtgtatgattcatattgcagctcaagcagcatctgagtcggggcagcttgacacatgtttggattttttttttttcctcaaggttttctgttttcaagggaaatatggagacaaagctgcgaagggcttcagaaccttccagaaatttccctgaaacagcaatgtcaagagacatacccttctctgcaaaagttttaatttctttctttctttttttgagatgcagtctcactctgttacccaggctggagtgcagtggcaccatctcagctcactgcaacctccatttcctgggttcaagtgattctcctgcctcagcctcccaaagagctgggattacaggcgcatgtcaccatgcccaactaattttagtatttctagtagagacaggttttcgccacgttggccatgctggtaaatgaaagcaatgtgcagaaggatgcaagtggaaggttgttcattttgtactgtctgtaccagagaagaatgttcagtagtacaggtatggctgaatagaaaaatacatccatgataaggagtactataaaacagttaaaaataactaagttggtccctaaatgtgataatacagaaagtgctccaagaaatattagtgagtgaaaaaaaatcaaggttcagagtaatatatacatcatggtccccttgtataaaatggaaacaaagccaaaataactatatgttttatactgataaacacataagtaaaattgtataaaagggtcttggaagtttatagtgacagtaatagacttaaatgaaatgcaaagttaaaataacactagatatttcatatggcacatttttatatgtatgtgtatatataaaatatatagaacatactagaatatacagaataaaataactggttgcctctgggtaggaagggttagaaaagggactagaattgtgaatgatgttctcaggaaatcttaacctaatctttaatattttaattttttacaaggagaatgtcttcatgaactatttatttaatgaaacattgtatgcatatatgaaagaaaagaaactaaaaaatgaggaattctacactactctgaactgtctttattccagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggtgagtcctcctgatgatgtagatatcctggactcagactagggctaagttgattacattgtgaaatattgatactgatggatagcagctggagtctaaagataaaagtcaacggcttgctcagcaggcctacttttcctgtgactaacccccattgctgtgaaggatggctaggggactggagttaatcatgttagcattttgtctctgtgtgtcttgttggccaggctttctcagaatgtgggtatagacattattgcagccttttaagatggcttgtccacgtactcacgccctagtttgcaggggtgggaggaggagtttcctatgcctagacagcaagaaaactctcgtgtctgctttcttagctgatttacttcggttttgtttcttcagttaccttctgaaatgacaaaaatgattaagcctcttcctggatgagcagattgctggggctcagattccagagatagggtgtggagtaggatggtggtagggagatgcctgtggccgtgaagttactgtgtattttgtagacgtcattcagagattagctggggacggaaaccaaaggaaagtctcagtgggagtaagtggagggcttccaaagggctgaatctgcagaagataagccagatggggtggtgaagactgagaggtagtgattagacccaggcctggaattcttaagcattggaagatggaaggagggtgctggatctgacccaggttcctctggcagctcctctttgtccttgagtaatgtccaggaggtattcagtccttagatgggactggcttcagaggactacatagacccaaacaaccaatacatttttttctaagcatttgtgtgagcattgcccctttctctctcctccctagaacatcctcagagaagagctttctgaatgaactgtgtctattattgactgtaattcgaaaactctgcagagcaatgttcctttactggtcagatccatagtcaaccattatgatcaatttccttgcatactgtcttctcctgtctcttcctttctacacttaccatcccaattaagccgcttcttgtcttattactacatatgcatagcttgcttcattcattcatgcagaaatattaatacatatgacatacccggtgtgcgctaggcactgggaacaagaaaacctatccccaatatataacgactaaaatctagatgcatatttggggtacaagagctacaaagtgtgtgtgtgtgtgtgtgtgtgtgtgtgtgtgtgtgtgtgtgtgtgtgcgcgcgcgcgtgcgcgtaagcatttttgtcaaggaagcctacacaaaggaggtgaagcttcagctagtgttcagtggtgaataattaatgatcatatctctatttgttggtttctaggcactgtgctaaatgcaatctgcgcattctctctgctcaccctgatcctagatactaaggcttattattcccattttagagatgaaaaacctgaaattcatagacttcattagcattcaaggccaaataaatagagcaaataaatgtcagggtcaaaattcaaacacaggtcagtctgattcagactctgtgtaatcacaggcataggggatacaaaggcatggtctttttctttctactcctacctcatttaatggaaagacagtataataaccaaaagcttagatattctagattcattcagatgatgatgttagggtgatgatgtttctataaggacattcagtagccagctgttgagctggttccagtcttagctatttgatctttttaaaaattgtttttttaaagggagatttcagtcttactcatagtgtagaaacatgagggtttgtctattatttctgtggtaacatcctatataatgttgcctcagccagggaggttgatcatgcctgtgatcccagcattttgggtagcccagggaggaggattacttgaggccaggagtttgagaccagcctgggcaacattgcaagacctctgtctctacaaaaaaaaaaaaaaaaaggaaagaaaagaaaagaaatttgccgggtgtggtggcatgtacctatagtcctagctgcttgagaggctgaggtgaggggattccttgagcccaggagttcaaggtttccatgagctatgatcttgccactgcacttcagcccaggtgacagaacagaccctgactctctgtcttaaaaaaaaatttgcctctttctgttgaaaagccaatccacagtgttttttacattttagtaatgctcagatccctttaaatggggaaaaaaatgtgggtccttgggaatatgccagtggcccccagtttgggggatccagttataatgtgctaattgtcaagttcctggtttggtggaaagatggccccagttcacagttatttgtgaagtaggatgctgaggctctgcccatcccaggggagtggccccctagagctctaccctgacaggctgtcacccttttgcacattccctgacatcagacactggtgagaagaggctgcttgctgtcttacacaccctcgatacttagggcttcaaagccaagaagtgagtgggaggctctgagctccccgtgggggattgtggcatctggacttgaggtgtgtgggaggtgcgtgtcactctttaccgcctctgagtgcagtgctcttataatgaattctgactgtggggactaacccacccctttctccgggtgagcaactgtctttgctggatgagttattaaatactgttatcaccattgaatttggtagaaattttgatgcttttggtgagcttcacatctcacctctcctgctcatgaagatggaaatctctcttcttttctcaaaagcttcttcaatgaataggaggcattcagtagccatgattactttgagctaaactgaaaatgagaggcccaaaagtacctaaatttctcatgttctaatatatagcggctctcaacattgcctcattgcctgcatagtcatatcacctcgagagtttttttttttttttttttgagccaggtttctgcttctgcctcctgagtagatacaactataggtaccagccaccacacttggttaattagttaattaattaattaatttgtagagatggggtttcactatattgcccaggctggtctcaaacccctggcctcaagtgatcctcctgccttggcctcccaaagtgctgggattacaagccacccggggagctttttaaaagtcaaactagcaggagtcagccaaatgggtaggaagatggggtgggtccccggtgaaaccccatctccaagccgaagagtttaaaacctgaaagtcaagctgtatgttaaatcctcagactggattgagaacttgtcctaccatttggcacactttcctctgattgatccccacccttcgcttattttacataaacttaccttttcctaattggttttctacactgtcatgcccacctttgagtggtgtcttccctttaacctttttttgcgtactaacaaacaaatcggcagtccccattctgagtctataaaaggccccagacccagtcacacaaggtgtggggagggacggggaggggacaactttccaatcttggggtaggggaaccagtgccccacctccaccccccaccatccccccgcccccccactgaaagccgttttcactgctcaagaaaattattctccgccctcctcacccttcaatgccccacgtatcctcattcttcttgggtgcggcacaagagatccggaaccgctgaatatgggtacaagctataacatagttggtgagctggatgggctgagtgagacctgggcagggcgtcactggctgggggtccccggcttgcaaagcgactgagaagaaaaatcttgcatcaaaagcagtaatacctaggcccctgtcccaagtattctgactgaattggtctggggtgggtggggcactgcaatgaaaaggtgatgattaccaggtgatgctaactgtcagccagcatgaagagccacaggtgttgagcaggtctcaaacctgagcaggcacccccagtaacctggaggagctgttaaaacacgtttctgatcattagtctggacggtggggtcctggcgtccagtaacttatttttctagcaagttcccaggtgctgttgatgctaccaatgtagaggccatgctcagaaaccattgctctaatatgacctgtctttttttttcctttagtattcactggaaatagaggaatagctgggctcattctcagttctttaccttcttaatttaagaaccctgtccagtctataaaatctagcatcttccggctgggtgcatgtggctcacgcctgtaatcccagcactttgggaggccgaggcgggcggatcacgaggtcaggagatcgagaccatcctggctaatacggtgaaaccccgtctctactaaaaaaatacaaaaaattagctgggcgtggtggtgggcgcctgtagtcccagctactctggaggctgaggcaggagaatggcgtgaatctgggaggtggagcttgcagtgagccgagatcatggcactgcaatccagcctgggagacagagcaagactctgtctcaaaaaaaaaaaaaaaaaaaaaaaaaatctagcatcttccaatatgcatttaataaaccacaaaatggcaaatatttcaaacacattaatttgtactcatgaattcatcttcatgggatagaagggacatggaatatgcaaagatccaactttgaaaatccagactgtagaatgtgctgtttgctttctacaggcaccaacttctcaaaattgaacacttagatgaaaactaataaaaaaggcccccagagcaaatgttctggatttttctcctggttgtttggaccttctctgctgacaagagcatagccatttttactggcttttagttggcatcatggaacaacccattgatgttccatggaacatccaagaatagagactatgtccacctactggaggcattgcccagggtagaaccacgtgtggaaatttagcaattacagtgcaggatgccaagcttccatttggggggcgctgtgtgtttggggaatgggacaggatgcttgtcttcaatagattgtcattgtttgggtaattacagcccagagcagcaagccaaccttattctttgaaaccctgggtgtcatggtaggactcagggggagatgtctgccttagcctggctgttgatttttttttaatcatagtgttgaattccctcacccagcttgctcctggtctcttagcatatgaaagggaccagctcaggtgaaggataaaaggcctgacttcttcctctattaactccttttctcccccctcactgagcaagtttagttgtcaactccagttactttgaagggcggtttcacactgcttcgttctgtgctttgctggctgccgagtaactgataaaatttaatattgctccagacccagagagagttggtttttcccctcttaagacagggtttttgtttttatgtttcattcctcaagaaaaaggagagtcgttgtttgctactctgcttagcagtcttaaagtgggtaaagatgactcctaattctcaagaagaaaaggtgttggctgcatctgaatcgtggacataaggaattctcagaatcatctttttttaaaaaagtatttgagtctattggctaaacctgggtggggggctaccaaggtactctcagtcatgaatggtttaagggttctgattttttttttttctttgagataaggtctcactctgttgcccaggctggagtgcagtggcgcaatctcagctgactgcaacctccacctcctggctcaagcaattcttgtgcctcagctggctgagtagctgagattacaggtgccagccactgctcccagctaatttttgtatttttagtagagacggcattttaccatgttggccaggctggtcccgaactcctgaccttaagtgatctgcccacctccacctcccaaagtgctgggattacaggcatgagccactgcgcccggccaggttttgatgtttttgttcacaacttagacatcagttgggaggcttttgcttttgcttagtgcagtgtctcttgcttggaatgctcttccaatttctcatctttctctgcaggtagaatcctaaactcgtttggagttcagctcagataacacttcctttctgagattttctcaattccattcccacttccttctcctccgctctgcccccaggcagaattagggacttccttgtctgtgttttcagaaccatgtgtgcaccctgatatcccagcgccagtcattttgtgttactctctcctgtgtaacaggaggctttgagtgtggaagctcagggagcttccctgagccacaggtgtagagcaggtctcaaacctgagcttccacactgacttcgcagagtttacgctttcagcttcagtctctcccatcccacttgaactgtctattctctggttccattaaaatcctttcagttcctcacttgtgcagcaccctctcacttctcactgcggcggagtgccgttcacactgcctgaatgcatcacctctgctcttagcctagctaaatcctaccttcccctcagaaatcaggttaaatgtgactctcctgagaagccttctctaatcctcttctccatgtctcttgtggtccaaggagcagcttgtgcttgctccattgtggcacctgtgttgtcaccctctgtggacttttctgtctgcctgcagaaaccagagtgctatgaggagagagatcttgctgctctaccccccgcccaccccagcacaatgcctggctcttgaagctatctgaaggaaggaataaatgaatgaatatgtctcgctccaattaatggcagggcctgatttctccctggggtcttgtgcgctgagtgctagcagggtattcttctttttgccttcttttcttgtgcgctgagtgctagcagggtattcttctttttgccttctttagatgtcaggtgcagagggttgaattaatcacactcctgagttcataacacatcatcttcattggtctgtgcaagatcctcccctgttctgtgtgtgtatatgcgtgtgcattttgtcataaaacaaaattgtatcaaattgattttagtgttctaattgactcttactagtgattcatgagtcaggcattcgtatctaaaagacagaaggagctctcttgggcgcagcaaagcagttggttattgtaaggtagcttgagtaggaaaaaggaaatgggatgatacaaaaaggtgggttggttaacatcaggttacttcaggttactttccttgtaagagttaaagcagggggacttccttatcatgccagctcaaatgaccatgccctttccaactggttgctgtgaaccttctgtttttaagaaagactggtctctttgggggattttcctgcttccttaaagttcccattttagtatgtcgcacttagcgcaagcgactccatcttggtttgatctgggcctagtgcaggagctcagtccaaaacaatggactcctatgattttattgaacaatttcttaccctttatccccgtcttctactcccattccacatgccccccaccccccatgaatgatttgtctaatgcgttgaatatgcacgtgtggttttgggtgcatgtatgtttacacacacacacacagactctctctctctctctctcacacacacacacacacacacacacacacacacactcatgcctctcctttgaagaggatcagatatggacagcaaagggcattagcatcttagctgtgttagaatcccgatgggaggggaggggactgcggcatgagcatgaatcctccagactagagggcattcttggtggagtcctgcccctgacctgcgtgtgggaaagcagtccaccctgcctgtctacgcttgggcgccttcttctgaagtgcatcccctgtggccactctgagctctgggttctctgataaacctaggcagtttgcctgctgcagggtggaagggaggctgccactgcctctttgcattactgtttaattcccaggaatcaataccaccctgcaagagcagcagggttttcttctaacctatctgctccctcatatttgaaataaaaggcagggagacaaggcttgctgaaattcttttgtctatggtgcatgccagagagcagctaattaagccccaaacctgaggttgaaatacatgagatcactgcaccttctgctgtgaccaaggctgctttgttttcaccccttgcttttcctctggcttccgtggagttagaaatgccctcctgaggccaatggcacaacttctatggatgactgtataccacacacttccccagcaccttctaactggcagtgtgtgttcttatacgacacagttgtttgtttctggtgccaaagtggcaaggtagatcttactatccccatttaactggcgaggaggctgagtctcagagaggctaggtgacattcccaactcaacagcctctcaggcaccacgttacctccccccactctgcatctacacatcgccagttaacagcactttcacctgcaccatttccctggaggagcctctacaggctttaagtcagactgcatcttgtatccattccacaaatatttagaaattgcctaacatgtgctctattctgtatgctggggctacggctgtgagcagagcaggggataaattctagctctgctgttattagctgtgggacattgagaagtcatctaacttcccaaccccagaatgggtcctcaaccctgggtccatggcctgttaggaaccaggcttcacagcaggaggtgagcagctggagagcgagtaaaacttcatctgtatttacagtcactccgcatggcttgcattactgcctgagctccgcctccttcagatcagcgacggcattaaattctcataggaacgcgaaccctattgtgaactgcacatgagaggagtctagggtgcatgctccttatgagaatctaatgcctaatgatctgtcactgtctcctatccccctgagacgggactgtctagttgcaggaatacaagctcagggctcccactgattccacattatgttgagttgtgtaattatttcattatgtattacaaggtaatataataatagaaataaagtgcacggtaaatgtaatgcacttgaattatccaaaaaccacctgccccaccatccgttttgtgaaaaaattgtcttccatgaaactggtccctggtgccaaaaaggctagggatggctgctctaacctgtctgtatgatgaggatactcttttcccaggtgtgtcagaattacagtaaacaagaacacctgtgaaaacatccagccttatgcctggcaaataatctgcactctatgcacgtggctttccttcttccctcactgttccgattcactcatatgctctttctgctgttccaggctgcttctaaaacatccctataattcttttaaggacagtacagggtaaagtggcttcctgggagaatgcaaggcaggcactgagcctggagagaactctgtagccccattagtattgagggcaacccccaagccagccctggtggcagccagatggtttggagccctcgcagtctccacagaaggcttgccgggaagcggcagatgctgctgctggaggcaggccttccctgcagggcatctggacctcataggaattcctggagcgactggagaaaggtgtcttcctgtcctttcaggggctcctgcggggaattccagaacttcagggctcctgatcaccactgtacagggcagtgagctggagctggctctttccagctcacaagaaccgagtattaaatgtttaggaattttgtgaggcaattgttaaataaccgttatcatcaaaaattgttataaatctataattaaataaactatattaaaatctaaggtaataagatctcaaaactcaaaaacttcccgatgagctggctccattttatttttatctaccctcttgaggttatttacatctattgtgtctgtgtggtggaaatactgtctccagctctgctgctgtgccttgaaatcaaccagaaagggggtgttaatgccacagaaattggaaaacgttgcatatatccaggactttatttttttctttctggaaaaacaatggacaaacatctaccagcacacccctgccagggactcaaaacaatggccccaaacaagaaaaatccagagacccaagggagatgcctgtgcaattctcttcccctagtggaccctaaatctgccaccctttaagggttctcaagggacttggcaaagccagtatgctccagggatgtagtgtttttaagaaaaactaaacacccaacatagaccaaggaggggagatatgtttcatttctcatgatagttctcattgatctgctgtggcttctttcctaatagcattgagaatgtcgaggtctcctgcagggcagtgagaaagacagccttggttcctgcagtaggtgaggggtggggacaatgagttgggtaccatggatttgctatgcttaaactagatggccaatcccaaaatgtggggaaggtcactgtgacagggagattgtcgtctttcacctggtaggttttggccttaagtaggacataaaaattaggaaaagttgatttttgatttgacaaacaccaccagatttattgttacaaggaagaaccatcgatggttactaaaagtcatggacaaaaatctgataggaaacaggatatttgcataatctcaaagtgtcttcccaaagtatccactgattaatggcacagggaaagcagtagctttacagtggagacaactgatagaccttatcctaaccaaatgagcaaagggaaaccaccagcagggaaacatactgacgtcatgtgcctcctgacacgatgcactgagaaggactctacatctcttctatgggaatcttaccaaaaatgtacagcctcgatctgatgatgagaagacattagacaaaccctaactgaggattgaaaaataccagtctagtcctcttcaacagttaaggtcatgaaagactgtggcactctcacagatttggaaatgtgacaactggattcaatgtgggatcctgaattgaatcatggacgagaaaatggatgttagaaggaaaactggcaaaattagaataaaggttacagtgtagttaatagcattggaccaatgtgaatttcctggtttgattattctactctggtaatgtaagaggttaacattaaccagtgctgggtgaagggtgcataggaactctctgtaccatctatgcaactcgctaggaattcaacattatttcaaaatttaaaatgtttttaagaagcttatttttgaagtatttaagggatgattactcacttatgaagaatgagggttgaaggtgaacagttctgtcaagtatacttatttctatgtgaagggaaattacacatagaaattagtgtaaaaacctgatagatacaggtttttctgatttatgagttaagacaaaaaaatccagaaaggactagccttactagaaggttccatttgcaaaattcctaactgtctcaaccaatcagaaggccaatgtaacctcctaccaaatgaataattaggtaattgcatgactaaaccaacatttagcatgccataacccaggactaggctctggggaggtggaacatggaggagcataggagcctgtcctgttctcagggaccttgcagcctatagtatttcacgtgggctatttgacatccctagccatgtggtaagtcctaggccagggtataggacttgagtgtcacctgatctttgcctggcgggcatggaaaatggttggtttggcattgcttagggatggtctttgggttgtgtattcttggggaatccatctggaaaataagaagacagcttttgctcacagttgactagacctccccctagtaaagttaatgatccaccaggttctgttccatcagcatcagctagaaatacttcttaaggtattctttaatattgcattatctgccattaccaaagtttaaagaagtttgcctacagccaaatgcacgatggcctcacacactccctccttcctatcctcaatctcatacccttcttcactgcctctcagagccaggatgaggtgaggcatggcctgggaggaagggcagaatgtaatggggcaccaaaaattcagtaatcaaatcaaataatactttcacatgacattttaaaaactcagtattttgttattttgtttaccatgagtttttgcattaattttttaaacaaaaaaattgcattaagtgttaattttcttgattactgagttttttgggacccccttcaattttgccccctaggttagtgtctaacttgtatcactccttccccctagtcctggcccctgcacagtcctcttatcaacactggctgcctgcagtaacaaagctgggctctgacccataaatggcgtggcggcttggaggaatggagaaggtacccttctattcaccctccaagactgtagaggggctgcggaagatttctgtctgctgggaacccttgcataaaagcactagttgaaaggaacagccatttacactctaaaccttcactggggcagccacttggtttccaaaaagcatttcttgcatagtgtttgaattaaatctccccttcgaagttgggagacatgagttaaaagccctctcagcagcagataaatatagctatgtttggtccaggttacagttgctgagggaactataactttgatttgctctcctggtataaatgtaaatccttaagtgaaatgagttaagtgagggaggaggcgccctgtttttaaggatgcatttgatcagcagctgtctgtggtgcctcacctgccatgtacaatctgaggggcagcagccaaagactgcagcaaggaagcttccagcaaatgatctaagagttctagaatggacattttctcagggaggttttcagatcagttttgtcttagagataaacacaattggtttaacagtctgggttggaaaataaagtttaatttcagcacagtttctgcaagcaacctagcatgctaaagtcatctttgccctctatttattaccttgcctttggcctgaaatccaaactcagcttaattttcctctccaaccacatttccaactgttttctgcctgcagtttacattctagcacagccagactctcactctcccaccaaaccttcatgctctttcttctttctttgtcatttaccctattccttcactctggaagggattcttttttccctccttttcttttttttaatttttaatttttgtaggtacatagtaggtgtatgtatttatggggtacgtgagatgttttgatacaggcatggactgcgtaatcacagcatggaaaatggggtatccatgtcctcaagcaaccatcctttgtgttacagtcaatgcggttatattcttttagttatgttaaatgtgacaattaaattattgactatagtcaccctgtttttctcccttctgtctgtcctgaaagcctccaactggtggtttacaacctgaatctagcccacagatgtattgtgtttggcttgcagaattatttcctaaaacccacagtcccactcgttcctattgctttctagatgactgggttcacacttttatattatccatcctgcctatgtagacatctgaattgtgacctctgagagccagaccctgcctttcctaataggcccaattcttcctcgattaagaaatcaccccaggttcttttagctccgtctcactcaccacctcttctgcattctgaaaacttttggctttattgtagaatttagcacttaattatatgcagcttgacatttgctcttgtcatggtaggcctttctggcacatgttgagacaagcctaacactttttgttatttctcttttcaactgaagtaatatctttctatccaacagctcactaaacattagctaagcacctatgatttgtcaggtaccatgctaggcctttgggatgcaaaggtgttgaagacaagctcctctcttattagaaactaacttcggaccttatttcccagcacttggcctcagtggtctattcattatttcagaacacatctagtccttcctaagcctcactccctggttaacactcctcccactgctacaataaactttctttgaatagttaaatcatatttgtcttttgaagcctgggtcaatttcccttatatttgccttgccttgtctgtttcacagacatgtgtccacccctgtctcttggaaatttgacataggccatcatttacagaaagtgctcttctgtgggtgtcctgtttgttatttacagactctccaaggacagggctgatccagtcttacgtttctcccgtatttccacactgcctgggcatagtgccgaactccgagcagatactcaataattaatgtccgtggtttgactgatcctcccatcttcaattagtctactttcaagaaatacatgctgacactaattttattttttatactcagtggaatccagtgagaaaggtaaatcttctgcttttgcattaaaacatcgcataaaaagcaggtaccaactttgagtactgctgggctcccaaagttgtttatacatcagtttagaattcagcctgcattttcccacagaaataatgccttggggttggtcacaccccaaggccagcctacgtgaacatgcgtaacccataatgttttgaactctggggcagagattagagctcacatgtacttctcattgcctgaagagtgtggaggttatatgcacttcaccttacctgacaatcaccacactgtgcccagctttacgatgtctgttttctcatctggatagtaacccctatgagcacaaaggccgtatcggtcttgttcactgccatatcctagcacagtgcccagcacatttattgagcagtcaataagtatttgttgatttggattgagttaaattctagttgaaagatgatggactttggagacacataggcatggatttgaattccaatgccatcactaactagccgggtggtactggggcctctctgagcctcagcttatctctccatgttttgttaattcataaaaccaagttgctgagtatgtggttaataccaaaatgttttttctttccttccttactgccttaatccctcaaaagcatctgattaattaattaatgatgtctctttttagccttctctggtggtgacagagaaggcaatatttgatgccagggcctttccgcagcttttgggaagtgttgggttctatttccagctctaattctaacagactgtgtgacctgagataggtcacgcaaacatatctttgagacagcaatgagagatttcagttatttccaggcttttccacataaatattaataatttcaggtgagtgaatataaatgctcaatgttctggggggcagagtccaaaggttgaatttatttgaattcagtcttatgtttcatcttaattattcatgcatactttatatttgtccaaatataaactttttgcttatacttcatcaaagggtacgtaaaaacagagacttcccacacctaatacagtcgtcaaatgtattagtagaaatgccttcgcttttatatctggggacaaggaatgacatgattcagtgaaggtaagtgtagttaacctttccagaaatacccgcaggagaccaattatttatctgcttaaaaactacccttggccaggcccgttggctcatgcctgtactcccagctactcaggacgttgaggaaggagaatcacttgaacctgggaggcagaggttgtagtgagccaagatcacgccattgcactccagcctgggcaacaagagcaaaactccatctcaaacaacaacaacaacaaaactttcctttgctggccagagtggctcacgcctttaataccagcactttgggaagccaaagctaggggattgcttgagctgaggaggttgaagctggtctgagaaacatggcaagaccctacacctacaaaaaattaaaaaattagctggtcatggtagcatgcacctgtagtcccggctactcaggaagctgaggtgggaggatcactggggcccagaagctagtggatgcagtgagctgtgatcacaccactgcactccagcctgggtgacagagcaagaccctgtctcgaaaaaaacaaaacagattgggttccaagatagccgaataggaacagctccagtctacatctcccagcgtgagcgacacagaagacgggtgatttctgcctttccaactgaggtaccgggttcatctcactgggacttgtcggacagtgagtgcaggacagtgggggcagcacaccgagcgtgcgctgaggcggggtgaggcatcacctcatccaggaaacgcaaggggtcagggaattccctttcctagccaagtaaagctgtgacagaaggcacctggaaaatcaggtcactcccaccctaatactgcacttttccaatgctcttagcaaacggcacaccaggagactatatcccgtgcctggcttggagggtcccatgcccatggagcctcgctcgttgctagcacagcagtctgagatcgaactgcaaggcaacagcgagactggtggaggggcgcccgccatagctgaggcttgagtaggtaaacaaagcagccaggaagctcaaactgggtggagcccaacgcagctcaaggaggcctgcatgcctctgtagactgcacctctgggggcaaggcatagccgaacaaaaggcagcagaaacctctgcagacttaagtgtccctgtctgacagctttgaagagagtagtggttctcccagcatggagtttgagatctgagaatggacagactgcctcctcaagtgggtccctgacccccaagtagcctaactgggaggcaccccccagtaggggcagactgacacctcacacagctgggtacccctctgagacaaaacttccagaggaacgatcaggcagcaacatttgctgttcagcaatattcactgttctgcagcctctgctgctggtacccaggcaaacaggtctggagtggacctccagcaaactccaacagacctgcagctgagggtcctgactgttaaaaggaaaactaacaaacagaatggacatccacatcaaaaccccatctgtacgtcaccatcatcaaagatcaaaggtagataaaaccacaaagatggggaaaaaacagagcagaaaaactgaaaattctaaaaatcagagcacctcttctcctccaaaggaaagcagctcctcaccagcaaaggaacaaagctggacagagaatgactttgacgagctgagagaagaaggcttcagacgatcaaactactctgagctaaaggaggaagttcgaaccaatggcaaagaagttaaaaaccttgaaaaaagattagatgaatggctaactagaataaccaatgcagagaagtccttaaaggacctgatggagctgaaaaccacggcacgagaactacgtgacgaatgcacaagcttcagtagccgattcaatcaactggaagaacgggtatctgtgatggaagatcaaatgaatgaaatgaagcgagcagagaagtttagagaaaaaagaataaaaagaaacaaacaaaccttcaaagaaatatgggactatgtgaaaagaccaaatctacgtctgattggtgtacctgaaagtgacgtagagaatgaaaccaagttggaaaacactctgcaggatattatccaggagaacttccccaacctagcaaggcaggccaacactcaaattccagaaatacagagaacgccacaaagatactcctcgagaagagcaactccaagacacataattgtcacattcaccaaagttgaaatgaaggaaaaaaatgttaagggcagccagagagaaaggtcgggttacccacaaagggaagcccatcagactaacagctgatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctaagagattttgtcactgccaggcctgccctaaaagagctcctgaagtaagcactaaacatggaaaggaacaaccagtaccagccactgcaaaaacatgtcaaattgtaaagcccatcgatgctaggaagaaactgtgtcaactaatgagcaaaaaccagctaacatcataatgacaggattaaattcacacataacaatattaaccttaaatgtaaatgggctaaatgctccaattaaaagacacagactggcaaattggataaagagtcaagacccatcagtgtgctgtattcaggaaacccatctcacgtgcagagacacgcataggcttaaaataaagggatggaggaagatcaaccaagcaaatggaaaacaaaaaaaggcagaggttgcaatcctagtctctgataaaacagactttaagccaataaagatcaaaagagacaaagaaagccattacataatggtaaagggatcaattcaataagaagagctaactatcctaaatatatatgcacccaatacaggagcacccagatcataaagcaagtccttagagacctacaaagagacttagactcccacacaataataatgggagactttaacaccccactgtcaatattcgacagatccaccagacagaaagttaacaaggatatccaggaattgaactcagctctgcacgaagcagacctaatagacatctacagaactctccaccccaaatcaacagaatatacattcttttcagcaccacaccacacctgttccaaaattgaccacataggtggaagtaaagcactcctcaacaaatgtaaaagaacagcaattataacaaactgtctctcagaccacagtgcaatcaaactagaactctggattaagaaacttactcaaaaccgctcaactgcatggaaactgaacaacctgctcctgaatgactactgggtacgtaatgaaatgaaggcagaaataaagatgttctttgaaaccaacgagaacaaagacacaacacgccagaatctctgggacacctttaaagcagtgtgtagagggaaaattatagcactaaatgcccacaagagaaagcaggaaagatctaaaattgacaccctaacatcacaattaaaagaactagagaagcaagaacaaacacattcaaaagctagcagaaggcaagaaataactaagatcagagcagaactgaaggagatagagacacaaaaaaacccttcaaaaaatcaacgaatccaggagctggttttttgaaaagatcaacaaaattgatagaccactagcaagactaataaagaggaaaggagggaagaatccaatagacacaataaaaaatgataaaggggatatcaccaccgatcccacagaaattcaaactaccatcagagaatactataaccacctctatgcaaataaactagaaaatctagaagaaatggataaattcctccatacatacaccctcccaagactaaaccaagaagaagttgaatgtctgaatagaccaataacaggctctgaaattgaggcaataatcaatagcttaccagccaaaaaaagtccaggaccagacggagtcacagccaaattctaccagaggtacaaggaggagctgataccattccttctgaaactattccaatcaatagaaaaagagagaatcctccctaactcattttacgaggtcagcatcatcctggtaccaaagcctggcagagacacaaccaaaaaagaaaattttaaaccaatatccctgatgaacatcaatgcaaaaatcctcaataaaatactggcaaactgaatccagcagcacatcaaaaagcttatccaccgtgatcaagtgggcttcatccctgggatgcaaggctggttcaatatacgcaagtcaataaatgtaatccagcatataaacagaaccaaagacaaaaaccacatgactgtctcaatagatgcagaaaaggcctttgacaaaattcagcagcccttcctgctaaaaactctcaataaattaggtattgatgggacgtacctcaaaataatgagagctatttatgacaaacccacagccaatatcatactgaatggacaaaaactagaagcattccctttgaaaactggcacaagacagggacgccctctctcaccactcctattcaacatagtgttggaatttctggccagggcaatcagacaggagaaagaaataaagggtattcaattaggaaaagaggaagtcaaattgtccctgtttgcagatgacatgattgtatatctagaaaaccccattgtctcagcccaaaatctccttaagctgataaacaacttcagcaaagtctcaggatacaaaatcaatgtgcaaaaatcacaagcattcttatactccaataacagacaaacagagagccaaatcatgagtgaattctctttcataattgcttcaaagagaataaaatacctaggaatccaacttacaagggatgtgaaggacctcttcaaggagaactacaaaccactgctcaatgaaataaaagaggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaaactactttaaagttcatgtggaaacaaaaaagagcctgcatttccaagatattcctaagccaaaagaagaaagctggaggcatcatgctacctgacttcaaactatactacaaggctacagtaaccaaaacagcatggtactgataccaaaacagagatatagaccaatagaacagaacagagccctcagaaataataccacacatctacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggtttgaagacttaaatgttagacctaaaaccataaaaaccctagaagaaaacctaggcaataccattcaggacataggcatgggcgaagacttcatgcctaaaacaccaaaagcaatggcaacgaaagccaaaattgacaaatgcaatctaaataaactaaagagcttctgcacagcaaaagaaactaccatcagaatgaacaggcaacctacagaatgggagaaaatttttgcaatctactcatctgacaaagggctaatatctagaatctacaaagaactcaaacaaatttacaagaaaaaaacaaccccatcaacaagtgggcaaaggatatgaacagatacttttcaaaagaagacatttatgcagccaaaaaacacatgaaaaaatgctcatcatcactggccatcagagaaatgcaaatcaaaaccacaatgagataccatctcacaccagttagaatggtgatcattaaaaagtcaggaaacaacaggtgctggggaggatgtggagaaataggaacacttttacactgttggtgggactgtaaactagttcaaccattgtggaagacattttggcgattcctcagggatctagaactagaaataccatttgacccagccatcccattactgggtatatacccaaaggattataaatcatgctgctataaagacacatgtacatgtatgtttattgtggcactattcacaatagcaaagacttggaaccaacccaaatatccaacagtgatagactggattaagaaaatgtggcacatatacaccgtggaatactatgcagccatagaaaatgatgagttcatgtcctttgtagggacatggatgaagctggaaaccatcattctgagcaaactatcgcaaggacaaaaaaccaaacaccgcatgttctcattcataggtgggaattgaacaatgagaacacttggacgcagggcggggaacatcacacactggggcctgttgtggggtggggggaggggggagagatagcattaggagaaatacctaatgtaaatgatgagttaacaggtgcagcacaccaacatgtcacatgtatacatatgtaacaaacctgcacgttgtgcacatgtaccctagaacttaaagtataataaaaaatatatctatatatatatataaagaaaatattgaaacgtttgcataacattaaaaaaaaaagaaaaaaacaaaacaaaaaaatctctcctggaagacgagtcacaacactacaccctcttggttatatggtgaaaagtgaagaaaggagaggagatggtacatacagggggaataagtaaagaagttgccagcgtctttgttttttgagaagagatgacgtagcacatctattgtttttcatcaaattctgaagtgataagatgtaaagtagtttagacaatgttactcacccatccattcattctttcatccaaccatccatccatccctccactgacatgttcattttgtgtatttatacatgtacttagtgcttactctgtgtcaagcatgatggtatactttggactttcaaaatggaaaggtgtgatctaaagaaatatgaacaaagttttgtgggtactcaaaaagaacaagcaactttgcctggggtaaggtggaagtttggagtggttgagctcccaaagatgatgactgggctcagtttttccctggtgaacaggatattagcagataatcaaagggagaaggacatctcagacacagagaaaaacatgctctcatctctggtggctctcatctctgggggggacgagctgaccaagactggttggggtagggcctgggagaaatgaaacctctccagaccccaaggactgaattctctgaagaagatgcctgtagtccaaggtaaaggtatggtgaattctgttacccatcatgattgtgggaagatcataatcagaattccagggagaaggtaggaatccaagagtggttggtctgactcactgcgagtgagacttgatacagtttcaaggaaaggggttggcagcaagaatatataagagttagttatgtattattaggctacactcttaatatggagaggcagtgttattataaagccttatttactacattgcaaagaactatgttgcatgtttctcccagctggctctgcagcacctccctcaggacaccgtctcacattttcctagattgggtgacgactttttttctgaggtttctcagctccctgtaataacactgtcaggatccttcctttactatgtggttcttccctagtcctatgctgctaatacactgtggtctcttaaaagcaggggctagattttctgtctctgaatcctcagaatccaggacagagcgtggcacgtagtgagtcggtaccactccgtattgaaatttatgtagagagcttttgtagaataacaatacttgagtctcatcaccagagacttagaatttgtcttgggtggaacctgggcatgaatatatttatatatatggaaaatcccccgcttgttttaaaaatgcagctatggttatagaccactgaagcagatgcttagataatgcttcttgaggtattggactataacagatattatcctggccatctcattttttggtagggcagggggttggagaggagctgcaacctgctgtttaggcagcttctcaaggatctcagttcacttcaggctgcagaaacctgggagcagatgactgcttctagatgctgcatacttatctgaaagaaaaccttaatgtgctcccaggaatacgtgcacagatttgcttcaagatgacttggttataataaccagctaagctaggctgtcactggtgagaacggaaagtgactgagcattcatagaaatggctttcctgctcaccagcttgttggggaaggatcagggctatggattaaaggtgggggcactgagtgtgttacagaaactggaaaatgaggtgcccatctttctaccatccagaaaagccaccagaaactatagatcggaattcggaataaatcaaggaaaataaatgagttctccctcgcccaaatttactgtagttgtataggtggatctgggagatttagtggaggaaaagggagcacacagcctaagctttccagaaagagctggggatgatggtgttagaaatgtgatagaactttaaaaatgttgaaatcattggtgacaattagaaaacattaaaaacacacacacacacacacatggtttttcaacattaaaaccgaggcacacactctgttggcgggggtgggtgttgacagagagagtgagtgagtccatatttcccaagatgaggagaaatgcccttgtcctaggaggcagtgattttgccagcaccatggagaagggcacacattgtctcttgcttattttttatttatacagataggtttctggggagggtttttactgtatccaatctgaactgacaaaggcaatcctgatgtctgtgtaactgcatgcgtagatcagaggatacaaattcactccttagatctactggtcttttctggccaattctgttgcattttagatcgacatactccctctgtcatttcttagcaaaggaaaagaggttcaagggtgagattttaaaacctccctttgctagtagtttttctaaagtttctggtagaattaatccctaagcagagcggtcagtgagagtgggctctgaattctggctgaggcataggctgctgtatgtttcatgagatcggcctcccagcttggttttgggcctgcctgacttggaagggatttgtgggagaagtccattttgaaaaatgaggatagtagacctttgatttggggaaaccctgctgaggaaactgtattagtcatcactgaatgagcttctgatgtctatgttctctctctggagggtggtgggatgattaagggtattttcactgtaggaaggaggatagaacgttgtatgtattttttggtttctcccatttcctgtcaaataaccccttagtcttttgtatgtggtcaagctgtgttgtcaggacagttgaagaaatctgtgcccagaagcgtccagatcctctattctagctccacgcctcatctgagaatctctcctttctctctgcaacagttacgtgacatctcctattcgaacttaaatccgcttaataaaatcatggcgattacttattttgtgacaggtacttgtgctaggtgttgagcccaaagtagtggcacagacctaatccctgtcctcaagtaacttaccaatgattcacaatctatttgtttaacagtgtaagagggggcagctccgagtggattactttatgactccctacctcagagaagattatagtccagaattttaatgctctcattcagggctgatgatgatgcagaggcataaataaaaggaaacactagtttgcgattggatgggggagaaaagggaggaaagtcatgtgaggagggagggagcttgttgtgaagctgggaaatggaagggtggaaaccatatctaggatggctttctggaaaaatagttgcaaaaattttcatcaccacggagtcctgttcttattcctatgcccatggatgcatgttttgaaatacattgtctctcaaaaaagcggcatgcattaaacattcagtaattttctgaccaacagagttaaacaggttgcctatttagagtttatcttgtcctcattcaaacaaggaatcttggcgttttcattagcccatgcagtaatactgaagatgaatgagtgtacaatttctgttaagctttttgaaatattgcaaatagctcatgtacccccatttctgcaatgaaaaccttacctgagacgattgctgcagggccatttgttcatgtagttcaattttcacttaagctttgaaagtttacacgttaggaccgtgtaggtacagaacccagggcctatgactttattggctcaggatatttgttaattgacattaaagtattaagtatcaaaattgaaataattgcttaagtatttagaaaatgaacagtatattagctagtcaactacaactcaacagttttgcagttgtatttacgttgtatttatttggggaggttttttctttttaatatctttgacacatgatatgaaatggggccttcaaaagtcaccttgtttagagcctgcttttttgtctaaagagctccaagaaaggagattgagtggtataatttaagatctaaaagcagatgaccctgttcttcctggaaagtagactggagatgcaggtcccttgggcaagacatatctgctatctcctattctattgtgtggataagccatcatttatataataggatccctgatgtggggatatttatcttgcttgttacatttgggtattatacgtaatacaatattgctataaatagctgcacacagtgcaagaaccttgcaaccaaaaagacatgggagcagatccagctccattgcctacagttctgtggctctggacaagttgcataaagctttagatttcctcatttgtaacatgggaagaaccagcgtagcagatctataaggttattctgtgaattaaatgaggtggctcatgtaaagcacttatcataatggctggcatatattaagtgctcaataaatattgaatgataataatcattagaatgaatcttattttgtatcttaaaatggggtaatacttatccccggggttcttgtcaagactcattgagatattgaacacaaagcacacagcccattgcccagcacatagtaagaattcaacaaatttagttttgttttttatctatttttttgcacctcataaatttttcctgttttgaagaacaaaatactaaagtggagcctatctgaggcacatcttcataagtgtctccaaccagcctttattcattggcattaagatattgaacatgcagactttaggaggcttaattttttctgctctggcctgcaggttggaggtttcactacattttaataaaaacccttgcaaagcaacttacagatctaaataaaaacaatgttttgcttatttagctggtttcatagttgtgccttttaaaagaatgttagcccatgttactttgcagtgcttttctgtccatttagtaatgttggcaacagtgatccagcttgcgagccccaaggttacatctatagccccagcatgggacgggagacctgctgggtgtggggaagaaggagagccattcccacagtagcctgacacccctgaacacagggcttcctgggtgtacatccctgggatgtatccactcagtcccctgtggacatgattctttaggattgcagcctgactttcatttctttccaatggagaaagagttctattttcattgttacatatgtgattatgaacatttccaacaaaacatagcaaataaaattatccctttaacctcacatctgtccctcctccctcccactcagtgatatcattgttaatggtttgccatgcattttttccagactttctggacatagaaaataaattttcaaaaaaaaaaggtgtatattacatatggtactctgtagtctctttttttctgaacatatttaggatatttttccaggtcaagatctatctaccttctcctccattgtgtgaataaactgtcatgtacataataggattcctgatttgaccacatttatcttgcttgctgcgtttaggtattataaacaatgcaatatgctacaagcagctgtgcacacaactgtttgtcttatgatgttctttggacagatttacagaatgatttaccatctgcaaagtgctgccacatccattcatttatgtgatccaaagaggtggaggcagaggcagtcacaagcctggacttgagtcaggcaggcctgggctggaacttggattagcagaccacagccaagcacttcactcatctctaaatctggaattgtagaagtctttctcccattttatatgtgcttgcaggattccttaagttaatgtctgtaaaatacttagaaaagtacatgccacatattaaaaactcaaaagatattagctctcagtgttggaattagctatggttcctcaaaacaattctgatattgtggatgccaatgcatccaaaatacagatgaagaaacttgaggctcagaggggcaagatgtgtcaaggtcaatgaccaacaaggaaagagaatagttaatggcaacttcattagtctctgtgcaaggagagacttttgcagagagtttttcataatattgaaagaagttgccagagaagttggagagggcctaaagcaccattccgttgtgccatcgacaccacacttctgatcatggaaggagcatgcaattaggcagaaatgagcttaggttcaggttgggccatctgtgaatggaacattcttgggcaagttactaaatctctctaattcgtgtgttgtgtatctgggatttcagtggagttttataaacagttaaatgagattatgtcaagtctatatgcacagttgctggcatataataagaccttgaaacttgtgttaacagcagtgtcagaattagaacccacatcttcttttcctttttattgcatccttctgccaccaactccaacccttgtcttctagtgaaggctaatacaaagtgcaagacatgtgtgacaacatgaaagcattgcccaagtcccgcctggcacatggggtggggacactcacccagtgggtggggagaagcagagatgatgggatagagcagtgccacccaccctgccttgtttaccctgcctccccttcgctgagctgtctctgtccctggctgcctctgaagcttgcttcacgcaatgagatgtcaatgcagtaaaatctttcaggatggaaaccagttcaaacaggaagaaagaagacagcactaaacctagaactcatgcaaaaatcacattccctctaagggccagagagagagagggtgactgtactgtagatgatatctgttactatttttcaaagttagatattttctttctaggtgtttgtggtagtttcaagataagaaagaaatggaaaagacctcttccatagaacacagaatggacaaaacagtagcagccatagattgctgctgttttcactgtaagaatatacattctttctcttttgcttaaaaaaaaaatgtaggcctttggatttcactctgtagctgtgaccttgtgatcttcatcttagcactgaaaaggcctaaagacaaagcaggcagaggaggtgagattgtccttggcataaacacagggccaaggctgcctgtgtgctggactggaggaagcagtggccccctcaatgttcagcagaataggtccttcattctagctctgatgacatttcctgtcacacaacactggtcatattaccttgtgcaaaccccatcctaaagctgaagtttttctttctgtaaaatggattgcactgtcactatttttgaaaccttagacatttacatgacacaatcatatttttaaaagtgtatcactatcaggtatatgtttaatatatttaacaaaatcacctcacttctaaatattcaaacatgaaaagtttagggcagaattccctgtaaagatggtaaattaaaataggtacatatttttcctccctcttgaaaacctcctgaaaaaatagaatttctttgaaagaaaggtaggaatcatacggaaagttagtacatgacatagcagacctgagaaaagtatttcataagccagcagtggaggaccctgaggactcatccaatctaaaacaaagtttccggaaatggtagtaccaggtgcccctgcaagtcagggtgaaggaaaggaaggagctcaaataaggaggatcagctgagagcctgttccagaagcagtctgactccatggggctgagttattgaaggtgtattcaataaagaagaaaaaaacagaagacatctggcctaggagatgccagacgaaagtgtgggcagtgataccttactcaaaagcaggtttcaatcaaagtgtgcatcctggaggctaaaacctccagcactttcctcccgttcatctcctagcgcactggtggccaggccttcacacatcatgcagggatcagacaattcttatttgtgaaatcctagcagtccaagaagaaagacttgcatatattgatattggcatctctccaactaaatgtcccaaccagattaccctgcagtaagctcacaggccacaagccctactcacatgctcagtcagtgctctccagctaaatgtcccaaccaggtcaccctgcagtaagctcacagaccacaagccctactcacatgctcagtcagtgctctccagctaaatgtcccaaccagatcaccctgcaataagctcacagaccacaagtcctactcacatgctcagtcagtgctctccagctaaatgtcccaaccaggtcaccctgcagtaagctcacagaccacaagccctactcacatgctcagtcagtgctctccagctaaatgtcccaaccaggtcaccctgcagtaagctcacagaccacaagtcctactcacatgctcagtcagtgctctccagctaaatgtcccaaccagatcaccctgtagtaagctcacagaccacaagtcctactcacatgctcagtcagtgctctccagctaaatgtcccaaccaggtcaccctgcagtaagctcacagaccacaagccctactcacatgctcagtcagtgctctccagctaaatgtcccaaccagatcaccctgtagtaagctcacagaccacaagtcctactcacatgctcagtcagtgctctccagctaaatgtcccaaccaggtcaccctgcagtaagctcacagaccacaagccctactcacatgctcagtcagtgctctccagctaaatgtcccaaccagatcaccctgtagtaagctcacagaccacaagtcctactcacatgttcagtcagtgctctccagctaaatgtcccaaccagatcaccctgcaataagctcacagaccacaagccctactcacatgctcagtcggtgatcaccttagcatcacacacaatgaaatgagaacatagccccaaggattaaagagaactaaggaacaatgctcacatagaagagagagtgaaaacaagcaaacagaagcaaatctacttggaggacacagactctgtgaggcaaagcaaactttagaaaagaggcagagagaacttagaaaaatagcagaagagaccattgtaaattgggagatagtacttaaaaaaactaaacattcagagaatgaaaaggaatcttggatttttccaaattgctttttttttggtgggggggtggcatgaaatgaggagtgtgcaagaaatgggaatccatcatagtttacaacttggatgagaatggcatttgcatattcaaaatattttaagtaataaatattgatcaaagcaaaattataccgtaagtgtatgggagggaggagaaatgggaaggatgcatgtgcctcatgggacagtgggaggaaagagtgaaatgcctggtttttttttttttttttttgagactgctctgttgcctaggctggagtgcaatagtgcaatctcgactcactgcaacctctgcctcctgggatctacctattctcctgcctcagccttccaagtagctgggactacaggcatgcgccatcatgcctggctaatttttatatttttagtagagacggggtttcaccatgttggccaggctggtctcgaactcctgagctcagatgatctgcccgcctcagcctcccaaagtgctgggattacaggcatgagtcagcgggcctggccaaaatgcttgttttctatggtggacagttaatagacaatgccaaaagtgaaaagaaatgtttaaaaaagaagtaccaaagcatattattggcatcatgttcataaatgccaaaataacaattacaacagcttaaagaggtacaaaagttcctctggcaaggggatcatgagagactgctgtatttcgtttgtttgggggtttggatttttttttttcttttttgagacagggtctcactccctgttgcccaggctggagtgcagtggtataatcacagctcactgcaacctcaactttctgggctcaagcctgcctcagcctccccgatagctgggactacaagtgtgcaccaccatgccaggctaatttttgatatttttagtagagatgggatttcgccctgttgcccaggctgatcttgaactcatgggctcatgcaatcttcccgcctgggtctcccaaagtgctggggttataggcatgagccactgtgcccagcttgttttgtttttaaatgaagcttgaagaattttttgaactatatacacttataactttgataaaaataaaatttcatatcaaaactgtaagtagcatcatttgtgtaaaagtagatttctcaaattattaaaaatattatcctatgcaattagacactgagcacatcaaagtttcatttaactggtaaaccagggaacaagctgaacaacaacaacctggttcaaaagtattcaggcttcttgatattttgtgagagaagagatacttgtataaaattatcattaggtataaaacaggtaaattttctccagagtaataaaactatgagttttaacaaagcagcaaacatcacattttatcatttttctgcaagttaactactaactctgcaaggttataacatttctagtttctaatcagttgtggatggttaatccaaacaaagttatattcctgagagggtaaaaggaccttccgtgtggtttttccaaatgttctattaaaaatgtcatgccatcctcattttgctttatttccaagttttggagctttttcttgcacacttgccataaatatgaccaacttcaaaaaataaacacaataaaaacaaaacaatgtcattaagttctaagtagatactgtttgctgcctgctctgacctgaagattttcctctttgttagaaaaggtgtttttacaagaactagagaggtattaaagacatataatcaccaaaacgagatttctctacttggtatcatgaaaagtgttgaaagaaaaatgaaaaaaaaaggccacattttttatataatttggtttagtgttatgaaatgctttgtctattgttacttaaaatattctcatatttggtgtgctttcttattctagaaaccctacaggagatcagtagttttgcactgcattctgaaaagtcctaggagtggcctagggtcaagagtgagtcaggaagagagggcttggctcccttagccccgaccctgcctagtccccatccactcccagctcaccttctgctgtgttatgtagtgagctctgcataagacttcatttgaagtcccttccagataccagagcctataattattaaaagaaaaaaaaatcactacaatttgcagtgtgtttaggttggatggattaatttctttgccaaggccataatgggaagactgattttgtcatttcaattacaagctaccgtttagtttgagcccagaagtcactttcctagagtctccctccacttgcctggcactggagcaattaacagtgggtgatttgtggctgcacttttactgcttagcacaggtttatcatcttgaaagttttccatttgcatatatgctatacattctttgggtgacatttagatatcacccagagtttagattatgcattgccttgtactgcactttctgctacgtgctggcaatctgcaagcccaaccagagagctgatgcaaaccaaggggaacgtgagttgcagccaccacttactgagggcttactatataccaacccccagtatcaaagactttacctgcattaccttgtttattcctcaaaccagtaactttgaggttactattatttgccacattttataaacaaagaaacagaaactcagagaggaaaagcaatttgcccaaggtcacccagctcaaatgagcagaattgggattcaaactcaagtatctctaatctcaaaacactctgctatgcaacctcccaatactgggagctttcagagtgaaatgaattgaatttgacagttttctacttttaaataccaaacttcctgagcagtctaattgctgctctttggaacaagaagaaatggctatttaaaagaagcaaggggcaggaggtcaagaaagtgggttttaatatctctattcacaagggaagagatgtaatcctggaaaaaaaatagcatcaaaatgaaaaccattatataaatttgatgaaattgcaaaggaatgcagaaaatataagggagggggaatacatagcattgaagattttataaaaggcagagaaaagatcaaaagtcactgaaggaggtagaagttggtccaattgaaggcagggtctatccatcttgacagatggaaggtggatgatgaaaccccccaagcagccaccagaaatctctgatcgtgttccagtctgcatgggtgagtttggataaggagaatactctggagacaggctgctgggttgaatcctttctcccttcctcactgggtgaccctggatgaattacttaaccactctggcttcagtttcttcatctgaacaatggagagagtaatgttgctcgtcttgatgtgagacgatataaagtgcttagcagagtaccgggcatttaggaagcactaaagactgtcagctgtggttgttgctataaccatgaacatcatgttcacgtagtacaagaaataggagactgtaagtcagcaaaatggcttggagaaataaaggagaaggaaatcaggagagaggttcatctttgggccagaaatatggggagatctgtcttccctggccttgagtgtcaggagtagaaagggctggttggtggggagagaccagcaagtctccagcagagactgaagtctggctgcgcttgatgaagcaggggaacttgtttctgtaaaataaatgctctaacaaaagctccagtggcagaggttctgttggtggctccacagggctagagagtctgggagtagccaaagtaacaaataagtgagtctaaggcagagaaagaaagctctgggttattcatctccggatgccaaaagccactgaaagtcattggggcagggggaggacattttttagtaagcacatcttctttctttttctggccctaccccaactgcaaatctacttctctctcactgtataaccaactccctgcaattccttacattaagtgacaaaaccacacttaagtttaatgcggtaaagcttgctggagtacttgtaaatgagcatgggtggtcatccacgttttcagccactatcgatttagcactttctttgtgtcaggctctggctaggttctggagacacaaggctgttcccaaacccccatctccagagctaaacagcatgtcacatcatggttcttagccatcagaataacacacctaaaattcagaaattgctgacgctcaggctctgtttcagactacaaaatctccagcagaggacccaggcatgtaagttcttccagaattgcacatgtcatttttaggtccacatcgaccttgagagaaccttctacatttttgtagatgagagaattgaggctcagagaagtgataagtgaggttgcacacctggcaaatacagcattgaacttcagacccagagcttctgaagttaagattcctaggcctttccacttggccatggccaccctcgcgtatgcatggtgtgcaactctgtgcctaaatgctatgctggtaaaatgctccaagatatagatgaatatgcttgaaacccttgccgactacaacaaaagctcaaaaaggatcggcaaatcctacagaaagtttagggacctgtatttaaagtagccagaacccaatacctgttacaacctgactcactgtaaatttccacccaaggtgggtaatgtggcttctattatacaagcaccatgtggttaccattatgtaaccctagtttccattatataaccctagtcccggggctccagaaacactgcctcctcaatttgtccctccagcctccaagtgacagtggcttcctgctgtggctgactctaggttaccttgtttggtgtgttggcatttccgttacctgtataaccaattccctgcattaaatttcctccttattccagctcagatcctgactattagatgaagaaaccaaggattagaaaagttaatataactgtattggtctgttcttgcgctgctataaagaaatacctgagactgggtaatttttaaagaaaaaaggtttaattggttcctgattccacaggctgtacaggaagtgtgatgctggcatctgctaggcttctggggaggcctcgggacacttttactcacggtagaaggcaaggcacgagcaggcgtcttcacgtagccagagctggaggaagagaaagaggggagaagttgccacacacttttaaacaaacagatctcatgagaactcactatcgtgatgacagcaccaagggagatggtgttaaaccatgagaatccactcccatgatccaattgccttctacgaggccccacctccaacactggggattatgatttgacctgagatttcgccggggacacagatccaaaccatataataacttaaccaatgcagtactaattattgtcagagctagtattctagctccaaagttcctgattccaaagcctaagttaagccatcttaacttatatttcaggtgactagtggaattttttatgcccagtgtaggtggtaatgacgatggagatatggcgatgatgatgatgatgatgatgatgatgatgatgatgatggcagtagtggtggtggtgttggtgatggtgttgaagatcaccatgtctgaccactgttgtctgtgtcctttgtacaattgttcagatgcagtgtcctggttgtcacatagatgtctctgactgttttacaggccttcacctaccaccatatccaggagatcatggtccagctgctgcggacagtgaaccggacagtcatcaccatgggccgggatcacattctgattgtgagtggattatttcttcttgtcaaatgttgcaagctcttcagcatctaaaaatggattttctgaaaaggcagatcacattgaactcccagcattgatcattgctttgttttggagtagggtgaccagatttttcctgtctgagttgggaggacttgagaattaactcaagttgttgaaataaaacagggcttaggacttgtctagttgagtgtaccagcgctaaattgagcataccagcaagggtggactatcactgctgaagacagagaagggagagcagcttttgtaagtaaacaaggtggaacattccagatgcatgtccactaggaaccttttcctctggcctacagtcacatggtgcccagtctcagggtcctgtgagcttggtttcctaaggggcttcattgcgtgttaattctgcccatagatgctggttattcaaggtcattactacatattgagctattcttctgcataaacagtatgttctgaagatcaggaaatttctgccccgtcatctgattatttttcttctcccgacacagaacccagctcgaaccctttaacctctgcccatcgtgctttaaaccaaggacccaaaattcaaatgctttcaggggccagtcaccaacataaatgagtatgcccaaccatgtcactcctctgctgaaacctgccaatggttgtccatctcactcagaataaaatccaaacattgccaggcctgaaatgcctttgccccatgcttatttatttatgtgttcctcccacatataaaacatgatagatgtgctgtttccctttttttgagtctgatatcacctaagcatagaggcttgccttctctgatcaccctgtctacaattcccagtacctctccatccactaaaagtcataccttacttctttatttttctaattacgtataatcggaaatatacattatcttatttggttattgtctagctatcctcatgagaatatgagctccaggaaagtaagcatgtttttctgttttgtcattgctgtgtctctaggtcgtataacagcacttggcatatagcaggtgctcagtaaatacgtttgaatgaataaatgcatgacatgtgccaggcagggactctaatgtttaaaaaaggatgagggctactcagccttgactgattgataccatgtgggattggaccatatagttgctaggattcccaatatttcaagagaaactgaaaatttccatgttttgtatgaaattttctgatatttcagtgttggcagtttattttaaaaaataatgtttataaacactttgtgactcccaaacagctggattcccttcagaaagccaccctgacattcctgctttacacagtggtgacatccgtggagagcatcagtggtgccagatactcttgcttttttgggccagagagccatgtaaactggtctttgtcatttgtcttacttaccatccttccacctttgaagtatcacatttttcttttttgttttgttttgtttgagagacagagtctcactctgtcgcccaggctggagtacagtggtgtgatctcggctcactgcaacctccacctcctgggttcaagtgattgtctggcctcagcttcccaagtagctgggactaccagcgtgtgccaccatgcccagctaatttttgtatttttagtagaggcagggttttactacatgttgaccaggctggtcttgaactcctgacctcaagtgaagcattttataacctcctttatctttattccttctctttagagtaaacctaaagatgatcatcagtccatttggctcattctgtacgtagcaggcttttaactccctttcctgtagaacagtgattcttttaaatggggcctgtgtcataagaagcactaaataagtgctgtatattattattttgctttctatctggtagagtgaggctctctgtcttttgcattatcaacataggcaagtaactactcagtactgccagtcctatgagccttttgtttgatggcttttgtggctggctcttctaacacacatccctcactgttgccccatcaatctttaccaggacactcccctactctggaatggtcagtagctccctgctgcctaccaaatgaagtcataaatgcattagcccaatcattttcagcttctgtgatctgatctggtcacaaccacatttttcagtcttttcatcaacttttttccatccaaatatccagccaaaatggatgtctggatattgcccaaacatgctggcactgtcttacatgcaggcttagcctctgcctctttctttgcctgaaattccttcttgtacctttcaacatgttgaaatcctacctagttttccaggtccagcacaaatgtacgaagctgctctagctgtgaccgctccctcttctaaatcaccaagctctctttaccttttttttaaaagcagtttttcctggctaacacggtgaaaccccgtctctactaaaatacaaaaaattagccaggtgtggtggcaggtgcctgtagtcccagctactcgggaggctgaggcaggagaatggcatgaacccgggaggcagaggttgcagtgaaccaagatcgcgccactgcactccagcctgggtgatagagtgagactccgtctcaaaataaacaaataaacaaataaataaaaacagttttattgaagtatagtttatacactttaaaatttaaccattgaaagtgttcagtttgacgagttttagaaaatttatagttatgcaaccatcaccgtaattcagtttagagtatttcttttactctccaaagttccatttgcagtcactttctttccctcctctcaccaaccctaagcaaccattaatctacttttcatctccatagattaccttttctggaaaattttatataaatgaaatcatacaattcaaggtcatttgtgtctgtcttctttccttagcataatgtttttgaggtttgtccatattttaggatatatcagtacttcatttcttttcattgctgaataatagtgcattatatgagcatgccaacttttgtttatccagtcactagtggatggatatttggattgtttttaacatttgactattataaataatactgctttgaacattcacaaacaagtgttgtatgaatgtgttttgacttctcttgggtagaaatctaggagtggaattgctggggcatatgggaactgtatgtttaactttagaagaaactgccaaactattttccatagtagccataatgagaaaaacctggaattatatatttttaaaagcattccctgaaactaggagggagcaaagagattaaacaatgacttggatgagtccagcttgaccagtagatgagtttattatgacttacatacgaagtactcctggatgctggcaggacagctttagagatcagcacaacctcccatccctaagctgcttttaagctaattttctggtgctttgcctactgtgtgtgcgtgatggggctgttttccttggtagattctcagctaccctctgggatgttcaggttatcagggacacctgcttctaagctgggcaccttggccttggctcaccgcccagcctttaaagacaagcagcggacatgcactcctaagtaacccggtgggtgacccatcacactacgtggctgtaccacttcacattccccccagcaatgtttgaggttttgtttacccacatccccaccaagtcttattattgtcagccctttggattataactgtcctagtggtatttcactgtggttttaattttcctttccccaatgatgaatgatattgatcacattttcatgtgctctgcctcttttttttttttgagtcatttttatctatgaacttgtcacagctcctctcttagactgtaagagtttaaggcttgtgcctatttgtgaaataaatggagtaataatagatcttcctcatagagatcctgtgtgaattaaatcgtataatacaggataagcatttgtacatgtgcttcttatgcactgtattcatttatttattcctttagcagtttatgagaacctcttagatactcagcacaaagactcagaaatgagttaggcatggtctgtgccctggagaaaatcagacctcttctgatgtgatgtctctcaggaatctcaaatgcactgcaccccaaactcaactcattgccaggtccctgaagcccactccacactccacctgaattcgggatctcagtttatgggactgccatcctagatctcaagctgcccttgcccctccctctctgtcacctgcctgccacttccattcacccaccaagtcctgctgcttttggcccacctgtccccactccctccccacttgggctggacaagctaccctgcctctgtcccttgccctgtgttctccgaggccctgtgcatacttaggtcactgtgcccattgtgcttatgacattgtaaggcaattctctatttgtaggctctccccacatttagtggaccccccgaggtcaggcaccctgttttactcttttatcctcaacacccagcagggtgcctggcgtgcagtgggtacccaagtttgttgagcaaatgaaggcactaatgaaatgaagtgagtgaataagtgaaataatccctgaaaatgctgtcatttcttaccttcatattcttgaatgtgctttcccctcagattgctcttccttattcaacaaatgtgttttctaaatgtgggaatccacatttcagggagtaaggaattgcctgttcagactttctggctcatccctgaagccttgcaaaggttgtaagttgcaagctgtgtcattagtctcaatgactttggagtttgctagtgtaattacaatgctaagagtgctgagaggggagagccagaggcctgcggcaagcatacttcactaggagcagaaatgtacctgaaatagaaggaagcaacaaacagggttttcttaagatatagtttcattttcataaaatgagcctttccagcaattcctagaatagaaatatctcctccaaattaaagaaaatgatgttggaaagtagttactcaggggtcaagggtccctgtcttagcactgaaggccccaatctaattttgaattgaaatttgacaaggaggagagatccccattccacctgtcacttttaattttccagatgtgatttttttggttagtttccattgcttgggaatattaatcaatatttgtggtaaacaccataaatgtcaagtacttttgaaatcccaggagggccccaagtgggtataggatggctggttgcaactctcattcttatacgggattagtgacagtttttttcttcttttcagggataggaacattgcagtaaaaggttttagccactaaaatcacaggaaccatggggctaggatggatttcttgttgggcttagggctttgcgatgaccattcctgatttttctatagatcaattccctgagcaatgaattgttggtgacaaatgagcaaaagggaattttgcaaaaataaaaagcaaatgacttttacatgactagtaccctttcatcctctctttgccacagtctaatttgtcaggtaacttcttgtttacttaagtcctaaggaatttagcttttgtggtgagaaagggagcatggtttgatagaaagtgtatatatatatatacacacacatatacacacacacacacatatatacacacatatatgtacatatatacacacacatatatatatatacacacacacatatatatacatacagatatatgcttttatttcaatacgtttggagtacaagtggttttttgttacatggatgaattatatagtggtgaattctgagattttagtgcacccatcacatgagtagtgtgcattgtacctaatatgttgtttttttattcctagccccccttccaccctcccccttctgagtctccaaggtccattacgttactctgtatgcctttgcatactcatggcttagctcccacttataagtaagaacatgctgtttttggttttccactcctgtgttacttcacttagaataatggcctccagctccatccaagttgtggcaaaagacattatttcattccttttaatggctgagtagtgttccatggtgcatatatcccacattatctactcattagctgatgggcacttaggttggttccacatgttggcaattgcgatttgtgctgctataaacatacatgtgcgagtgtctttttcacataatgacttctttccctttgggtagatacccagtattgagattgctagattgaatggtagatctacttttggctctgtaaggaattcctatactgtttgccacagagattgtactaatttgcattcccaccagcagtgtataaatgttctcttttcccaacattcatgccaacatcgattgttttttaactttttaataatggccattcttgcaggagtaaggtggtatcttattgtggttttaatttgcattttcctgatgattagtgatgttgataatttagatagaatattctcccttatctgggagaacaggaaaaaaattctacattctttctgcagataattggctagtgactttatgccaatttaatctctctagaccttgtttttttaatgcaataaactataccatatttgaaatcttcttcttatatctgagtttcctgacttggctgacaattcctattctctttttctatctcccaagctcctgaatcagagacctaaaatagattttgctcaagtgccagccctggctgattggggatggctgcctgtagaactgtgttgaggaggatgcagaagctacacattggctcagtgggaagaacttgggaattgattagtgctgtctgtcatggcatgagattggagaacagtgatgtatgcaagatacttgcaaatattatgtatttactgcaaccgttggtgtttttctggcccagtccaaaaactcttgtataaacaagattctcttgcacatattcttgcttcctttaaaaaagctgtggtataaaagcagaagagtaatggaaaaaaccgtcttggagagcctgcctttcctggggaacaatttcctcaggctacatgccgtattttatcaaatttaagatactccatgattttatgtgcccataagaaagaaaacttgctgccaattataatgtgacacagattgtaatcttcagagaggttaaaatatattttttgaaaagtttgactcaaaatgcctactgtgtaatggattgcaccttgagccctcacacacaggtaggcaatattgctatctcctgttgtttgggggaacagattgagcagcagaggatgaaagcatcatgcctaaagttacactgctggtaggaataagcaggatgtgaaccagggacaccagagtgcgtatgtctccagtcatctgtgctcccttccaggaagatattgtcctgtctcacaggtcttggagcagcttgaggaaaaatgtccaggcttgtttgtgcgtggtgagggtgtgcctcaagaaccctccctggctgatgcatcctgttactgactgctctagagagggctgtcccgtctcctgccaccccagtgatggggatgaacaatcccatagggagaatcaaccagggaacttgaacactgccagaagttcttggaaggaaaacaatctggtgattttgttgaaattgggatctagcctttattttgggtagttaaaataagcctctgggtgatatattttgggcctaattaccccggttttcacagaggaggctattgagtgattaagtaaaggtaaatgcttggcatcatagcagctccagaaattcagagcagtttgttcaaaaagaaaaaagaaggaaattggaagtcaccttttcctctgctgcttcacctcataatagtgctggagactccaggaggcatctgtgtcatcagagactgggcttcaaagctctgacttcacttttcactcctgggacaccaaattggaaatgacccatctaagcaactactctgagccagaccatgagcccagagactgagtcaaggactgcagcaggacagtagcaactcctcccaaccccagtccgtggcaagcaggagggaggacagtctaggatacgaggaggtgtggttctcagccaggagtggttagttggctcttggccttcactcagcacccctgtaccttgttgaaaagtaatatttataataaagctatcatttaatggcacaggcaccctgtatgctaggcaaatagctaagcacctggtgtgttttaccttacttcacctgcatcaggtgctcatattttactgagataactgagacacagggaggtcatgcaactggcccataaccacacagcttgttagtggaagaactaggatctgaacccagggagtactgttttggagtcgctgcccttaaatagtgtattgtacactcctaagcgatgaataactaaggttagtctttaggaatcaaacattttaaggataataattgagcactttgaactcagttgccgccttgcctagatcatggaatctaatgagatcacctatgtggcaactttcagaaacataaaatggcacagaatttttggtggttttatgatgacaatgatatgtttaggattgatctcctaaattctggtaattaaaccacaaaaactctaaacttagaaagagaactttttctttatgtgagtgttggtacttatgaaatagcaggcttaacagaagaggacaaggctggcatggagtttgcaaagggttctggaggcaaagtgtccttctccttctccttctgcctttagctcatctccaggcacggttcatcttggtccctaaagacctttcaactctaaatgcttccttcccattgagatcgctagcctgagtctagccacaaccacctcttacggttgtccttggcctgcaggacagtgtcaatgaacacctgctaaatgaatgaaagatgtttactgtctacttttatttccacacaaaccatcattctttttctcaatatgcaagtgttattactgttagctttatgtcatgattagatgccgagagtaagggttgttgcagaataactggattgagtggaagacaagactgggggtggggagcggaagcatcccctccacagaatgcactgtcggtattaacagttcacatttatggaccgtttatgtgaccaagatggtaccaagcactttaagggcattctctaatttagtcagtgaggttggcaataattactgtctcatctcaaagaggaaatggccattagagagcttgaacgccttcccagcattgcaagcctgggaaggaggaagctaggatttgtatcccatccgagtctgccagggctcaaagcccatcttcttaagcagctcactgtatgtgtctaggaacttgttttcctgaggtaaaattaatttaattgagaaaattcctgaaagtgtatgtgcaagggtatgtttgtgtcatatatatgtgtacctgtttgtgtgtatgtgtatgtgtgttaaggggagatcagggaaagaatcaagttaagaaagaaaatagtaaaaaaaattagacaagagacttgaaatgacagtttgtagccaaaaggtggcattgtgagcttggggtagcttggttgcagcttaatatggtaatatggatggtgtgcaagttttctggaggcggaagcattgccttaataaggactttggtgaacacatatcagggcatactaggcctaaaatatatatacaaaacatagattcatatctcaattttcaaaggacctgtagcatgtctggacggaagtcatttatcaaggtagacttcacggaactggaactgggtcttgaatgccacgaaaaactttaatggctggagaggaaggcttggtgcattttaagtgggaggagcatttcttgccctatgccttcttgcagtctgcgaaactctcgtcattctgctaggccatctttccggttgttcgttgtccttgtttcagttacaacattaccacatgtattggaattttctctttacctatctgtgctccacagtaaagtgagacccatgtgggaagggaccacttccttttatctttccattcatccttccatccgtggtgtgtagcaggcactcaattcaagctatggcagtaaattaatggaaagaacaaactaattgaaggaacaaattaatgacaagctttacaaagttcaatttaaaaaataatgtgaataaagttttgtttcatgccaatctttcctgtaaagattttttaaaatataaaattcccaaataccttactagctctgggtgacagaattttttcaggcaaactaaaatatgacagctggagcataaaagagcatgcttcattctccaaatctttcttccatcccatgattagctgctgcagaaatgagaattaagagggaatatgaggttccttgatttgttaagatagctactgcattctccctgctgtgtccaatggagcagacctttgctatgggtagggagtgctcctagataatgatgatgatgtcactgctgccattgctgttgctgctgctgctgttgccatgaaagtttcacttgactcagtacatatgtgtattagtctgttttcacactgctataaagaactgcccaagattgagtaatttataaaggaaagagatttaattgactcacagtttctcatggctggggagagcttaggaaacttacaatcatggtggaaggggaagcagggaggttttacacggtggcaggagagagggagagagagaagggggaagagcccctttataaaaccatcagatctcatgagaagtcactcactagcatgagaacagcctggggaaaactacccccatgatccaatcacctcccaccaggtccctccctcaacacatggggattatggggattacaattcgagatgagatttgggtggggacacagcaaaaccatatcaccatgcctcgtgtttctgcagagtaggtaaattcaggccctggggaagctggtgccaaagctggggccttcattggccacatagggactgcagctgtcagcacagagagagagagggaaagagagagaaatagagtttggaaattgttcagcaagagctgggaaatgcagtcacacagaagaatgactggtccatcatcaaatcctaatgaaattacctccaaatatctcggtgcctttcagcttctgttagtggagctggacaaatctgatttgagacaagtaattttaagcgtgttcttaaaggtaagactccactgtatctcttgtcctatttcctggcagtggaagaggggccagctttttcttgtccttggagaacttgagaaacagcgtatctgccatttgggcgttggctgagtacctccatccctgacattgctttccaagtgctgtggaactggggacaagctatgtggtttgaaaggagttgacaggctgggagccagtgtcctcctttcctcaagaagggaggaggtctcctcattccacagctagaaagtctcttcacagtgcagatccccattttgcttctctgtaaagtggggctagtaatggtcattacctgccaagcttgtggtgaagactgaataaaaacatgtttgaagctcacttcacaaggcttaacacatagtaggcccttggttaataatagccattattattcctcttgtgggctcctctccctgctttgacacaagtgtcaggaataagattacaaattattttacaggcctgcctttcaatctttcctgcatttgtgaagtaatgttcagctgttgctatggctgggctgtgaagaaagcctctgtgaaatacaataaggcacactgtgtctgctgtgaaggcctggaacacacattggaaggagaaatcctatcatgagtgtccttccctgggggtgttgttgagggtctgacaattcctgatatggtttggctgtgtccccacccaaatctcatcttgaattcccatgtgttgtgggagggacctggtaggaggtaattgaatcagccaggcaggtcttttccatgctgttttcatggtagtgaataagtctcatgagatctgatggctttaaaaaggggagtttccctgcacaagtgctcttttgtctgccaccatgtgagatgtgccttttatcttccaccatgattgggaggactccccagccaagtggaactgtaagtccaataggcctctttgttttgtacattgtccagtctcaggtatgtgtttcttagcagcaggaaaatggactaatccactgcccctgggaaaatcctgttggaacaactgctaatgaaataggctttctcacaaatctcaggcccatcgcccccgtccagggcactggctttaagtgactcaaaggaatcaattctgtcaaatgatccttcaaaatcaaaacccatttttccagatttatgttacattcatgcagtgatgcatttgtgtagccattaaatgatatttatgatgatttttaacaacacaagactattctgtgaattctatgtagagagagggttgcaggaatgaagcagcaacgacaacaacaataataacaataaagtcatcaaggaaactgaagttcaaggaggggaaagaaatatggcccctcaccagagggcttcgatctcccagagctcagaacatgttctaaggctcacattgtgttagcatcttctgcttaaagggaacatgacttgcatatttctggagttttacttttaaaacaatttcactttccttctataatcaggaaaaacaactttttttttttttttttttttttttttttttttttttttttttttgtggtagacagagtctcattctgtcacccaggctggagtgcagtggtgcaatctcggctcactgcaagctctgcctcccgggttcacaccattctcctgcctcagcctcccgagtagctgggactacaggcgcccaccaccatgctgggctaattttttgtgttattagtagagatggggtttcaccatggtctcaatctcctgacctcgtgatccgcccacctcggcctcccaaagtgctgggattacaggtgtgagccactgcacccagccaaaaacaactttgacactatttctttaaaaataggaattaaggggacagtcaaacttactgaaacatttttttttttttttgagacaaagtctcactgtgttgcccaggctggagtgcagtggcatgatctcagttcactgcaacctccacctcccaggttcaagggattcttgagcctcagcctccttagtaagtgggattacaggtacccaccaccatgccctactaatttttgtattttagtagagacggggtttcaccacattggccaggctggccttgaactcctgacctcaagtaatctgcctgcctcagcctcccaagttctgggattacaggtgtgagccaccatgcccagccctgtaacactttcatgtatataatttcacttttcttctgaacagtctgtaaagccagagaggcacagggtttcattttaatgatagaggtgatgtgtggaggtgaagatattattcaaaattatgcagaaagtcaggggcagaagtcaggacccccagcctgtcctggtctgtctctcttcccctggactgcttttccttgaaatgtctccattatcatatattctcccaattcattcaataaacatatacaaagcatttacagcatctcaggcaatttgagaagcccttggagagtcccagagatggaaatgacaattgtgtccccccagaattttctttctggtggagatgagcatgagagattgacaaaagaaatgtcaatataatatgaaaagtggcagcctgcacaatgtgctctgggtacttggaggatggagtgactaattccatggtagcaacgggggatgaccagaaaaagttatagagaggaggtgacatttaaattgcaacttactgtctggcatcggagttaggagcccaggctcccaagcttggcagaccctcaaagaactccagccttcaccacctcctacctgtgtactctgacagattacttatctccccctaagcctccatttgctcttctggaaaatgggggtaatcataaactaccttgtggtaatttttttgaagaataaatgagataatgcaggcaaagcctttagtaacagctcattgtaacttcaagaaactagagtttttattatcactatcagtagtaataatgcgactctccttttctttcctctaaattaaaattatttcctgtggtagataggtaatggaatagtgtccctggtagggaaaacagaatttgcaaagttactgatatgtagcagcctctgactttttggaaagtggcaaggagatggggttgggggaagtagaccagtaggaagttaggctataagcgctagagtggcgttagattataaggagacttatttgtaggggaaggaatttttatgctctaggatggtagtgggatgcaactagagatataaaaaccagggaatgacattgctagatgtgtgtcttagagagaggccccaggcagctgtgagggggtggaaaatggtaagagaacatagatgttgaagaacagtgcaggggtctacatggaagagaccaaggatcccaatggtgaagtctttcaattaaactaaacaacacttcctggatttggacattacaagatgaggaaagctgctcctactcttggagtttaacgtatggtgggaaaaggggaaggtaatgagaaagagccacaagagaatatgtattggtctgttttaacactgtgataaagacatacctgagactggctaatttataaagaaaagaggtttaatttactcacagttccatgtggctggggaggcctcaggaaacttacaatcatggcagaaggcaaagggaaagcaaggaccttcttcacatggcagcaggagagagagagcagtgaggagcgaagggggaagagcctcttataaaaccatcagatctcatgagatctcacttgctatcatgagaacagcctggggaaaactggccccatgatccaatcacctctcaccaggtctctctgtcaacatctggggattacaactcaagatgagatttgggtggggacacaaaacctaaccatatcagaatacaagaatagcatttggatgggttcaaaaggaggcaatgtgacattcaggtggggtgaatcagaaaaagacacctgcttattgtcagaagctgcccaccagcccctgagctctttggtactagggtagtgtctgcactgcattttccgctcagtgtccttggcacctcacctggcagagataaggggcttgatgactgtttactgaaaaaagtgaatacagactgaggttcatctgagatttttggagctgaggggtgcatattagtggagatgaggtagagcttcaatccttgaaacccactccaggtcagcagcctgagtttatgagtgctgatgttttgtgttgctttgattttgttccctttgatccctgactctcagctactgaaggtatattgttttttattttaaaacaaaaaagcacaccaaagacaatgacaccagcaagtaacttctcatcacctccatcacccatccgtgatttctgtttgtagaattgaatttcatcgggcttggtgtgctcagtggaaacactgtgtgaatcactctcaagttcagcagttaacatgactcagcacttggttcatgagcaagaaggcttttctgtcagcataaccagggtatcatagcagtgtgtctgctacctgggaaaccaagatgaagcaccaagtagaggtcaccatgtttaactaatgatttaagaaataaaggtttttgtcaggagcaaacatatgggtttcatttgagtaaaatctaatatagtatacttacggattctaagaatttgtgaaagccatttatgataataaaactcttatttgcttccaagcaaatgatcttttggtgcgattttactgtcttttcattttagttctgctttgagccaaggcaaaatgctttgcccaaaatgttcctttagttagaccttgtctcttaaattgcattttctccagaatggactaggtcacatgtaataaattctggcattttaatagaaacattacagggaaaatagtcaacaatctgctttaatttcaaaagtcatttactctttgatatggtaaggcagtatctggtaaaatgtgcagaatgcattgggatttacttatgatgacaatttattctgaaacaatgtgaaactggaccatcaatattcaggacaaagatcttggcagggggaagggtactgggagcaaacattagtgtctttttattcctgggtcctgaatgccatgtagacctcagggattacaggtgcacgacaccgtacccggcccctctctcacttctcaaatatcttctccacatagcagccaaagcaatcattgcaaaatttggatgggaataacattacactctcacctcaggagagttagaagccttgggcatattaccagtggcagaccctaatttctataaagagctgagactagggcatgatggtgagaagatggaaaaattgctctttctattcctcagggacttaagtctctctttgagaagactggttatttgttctgggaacaaaactaaaaaaaaaaaaaagaaaaaagaaaatcacacgtacataaaccaaaaccacaataatagatcatttaattctaggaattaaataatcaatcattttgggaatatactatgaaataacttgaatgcagatattctcaattaaaaagataagtattctgtttatatacgttggttttatatttgataagtgttaagtttctgaagatccttttggttttggtggggagcagaatgaggatagagagaattgtttctttatgtatagatttataccatatatcattcaggactgtactcactatggtaccatcctaatatgaggactgaaggaccagggataaactggtgtatgcccagtgaatctaatgtactcaataatttatttctgcaatgagtatttaaaccccatggtggtacatgatggagatacaaaggcaagcaagaataagcgagatggcttccttaggaagacttcagtctagatagataccttgatcaaagaatgacgcagatatatgtacaaggacaactgcgccaaggacttcgatggtaaggtcccttgtgccaggcaaatgtctaagaggggtatttggcatggtctgggctgagttggtggtagccatgggaggcatgacctgggaaaccccaacagagctgctgggcagggagggtggtgtaggtggggagtattgaaggcaggaggaacaggagccttcagggactgaaggcgtggtaggtccaagaaagccaagaaggctggctgagactggaagacaaacaccggaagggcctgtggtgggagcttacaggagaggcagggcaggatgtgcagggcttcgggccagagcaacatacctagtcttacttcctaagtatattgggaagccactgaacagttctaagtcagagtgtaatgttattcccatccaaattttgcaatgattgctttggctgctatgtggagaagatatttgagaagtgagagaggggctgggtacggtgtcgtgcacctgtaatcccagcactttgggaggttgaggcaggaggattgcttgagccaggagtttgagaccagcttggacaacatagcaaggctcagtctttacagaaaataattattttaaaaaaaacattagtgggttgtggtggtaagcacctgtaatcccagttactggggaggctgaggtgaaaggattgctggagcctaggagttttaggctgcagtgagctatgatagtgccactgcacttcagcctgggtgacagagtgagaccctgtttcaaaatatatttaaaaaataagtataaaagaagagattgcatgtggggagacctgttggggaggttcctgcagaggccagttgagaaatgaagtgggtttagaacaggatgcccacagtggagaggcacgctgacctgagaacttggcttagtctggcaatgagagaaccaaactctgtgtgttgccaacggatgcatccctgctctttatgggctgagagttctgtaggaggcagagagaaattagacatttgcaaaacctcaggagtaggggtggtatgatatggtccatcgaaatttaggctgtaaattggtgaaaagaagatggggaggaagttgaggtgaaagtactcaaaaatgggattatgttcattaaaccagtcaaatgtggtttgtgctgaatgctgacagtgttggattaggatttgtcccccgcactttttcttgcaagcaatgcttgatgggcgtagtgatcataaaacatctttgtttcttggcatttataaaaagaaatacatttttagcatacagcaagttgccttgagcagcttaaaatgagagccttttcaagtgaaggttatattgaggattcagctcagctaatgaaggtaagaacgggtttcaagtctagccttatgcttcctggaatggccctggcccctcacacattccacccaccaaccacattgctcccaacacctacttccccacaggattgctataagcccttggacaaatcatttagccttccttaattgacttgtgcttaaaatggaagggacctggctcttaaagtctcttttacctctaggatatttgattccacacaacaagaatctttaattcccggagtgctgtgctgtattttatgtgcccatgtgctcttttgaatcatgggcgactttattacttaacattaactgtcgtggtttctggtggatccttctttttttttttttttttcttttttttttttgagacagactattgctccgtcacctaggttggagtgcagtggcatggtcacagctaactccagccctcttgggtttaagctatcctcctgcctcagcctcctgattagtggggaccagaggtgtgagccacactcttgactaattttttaattgtttgacggggtctcactactttgcccaggttggtctcaaactcctgagctcaagcaatcctcctaccttggcttcccaaagtgttggtattacaggtgtgagccatcgtgcccacagaaagtgttcttcccttgccccgagaaaaacctgtttctgaaaaccactgcagcttcacggaggtatcttcctttctctctcccaatttacttcaatccacaaatgactgaatatgtgcttgttgagcacctggcccaatgtgtaccctacattgtgttcttggctgtcactcagttcattgtcaaggcactcttgggaggcagggggtatatcagaggaatcagaggctcacagaaactaagcaacttgctcaagtttatgcagcaaaaataagatagcagactgctgtcaaacccaagacttctgattctatgtccagggtttgtttttgttattgtttctctaaattgatgtttcccaaagtgggagactcactctccaggtgtaaacccaagctggttttagatggttcgtggagaaggcaggaaaaggaatactgaatcacatgacaggaaagttgttttcttttcaattctctctcaaacatcctgtttagtcaagtagaaaatgggcttggtgtgaatgtgcctttcgtatgtgttgaatatttgctaatctcccatcttaacagagagctggtctcaggcttagcagcctcaatagcaacagggtttagcaagaacttaataagatatttttatttcatattctatttttggaacatgatattgtttttcttcacattggcgatataaatttgccttttaaggaaaaaaattaagggggaaataaagaaaagtactggataaattagagttcaggtgtctgagtataatgatacaaatcatgcctgtacatccatggaatgaggctgggagcagctctccatttattcatgctgcctccctcactcacgggacacgcggggcttcatgtgatcatcgtgacactaagttctgaatctgctctttatttatttcccttagaaatatatagaagcaattataatgaaagccatacttgcccttaggaccattgaggtgtccttcttaagcatacattttataactgaaatcaacccaagctagtaatggagtcttaaaacctagaaaaaatatgtaagtttattgcaaaagataatatcccgtttaaaacagtttagaaatttacaaaaccttacatcagtacatcgtctttaagaaggtgctctatagatgagctggtattaagttccaaggatagtgagtatgcatttatgcattgctttttaaactacagagaaagcagctacataaactcctgcaatttaagttgatgtattggtctttttcctttcaattttataaaagtaatttttgctaagttaatatctctccagcaaaccagataacctcaagtacagcatttctgtagaatatcatggtagatgttacgtaatattttacaaagaagcagtgattttcacatgaataagtgagtatgcagttttggtatatgtgtgtgtggtgttttaaacatagagacgaccatttttgttcatcaggaaaatgtttatggaatcctatttcctcataatgattttaaatatcaatttttcagaagagaactccttcccagtttcaggtcagtggcccaagcaatgcggtgttgtgctttggtgtagaatcagtacagccttgtttggctgtatttctagaaatgtcaacattttatttatttttttcttttcttttcttttcttttttttttgttggggaagtgcagaaaatgtcaacattttctagtcccagttttatttaattcagttaagggttcatgtgagggcctcaactggaaacatatctatgaccacatcagcttattaattttgtgtgaggtacctcaaacatctctttatcttcccaggctaactttggccagtaatccagctcagctctgagtcactcagctcacataatgtggaacgtgctaagagtttataaagtaggaaagcatatgttcttatctgtattcaagaatggacaaacaggccgggaaatttaagccatttgccaaaggctagtggtatagactgcttggttgcctggatctcttaattctgggaacagggttatttacattctagcatgatgcccgagaatataaattcacatgaaattagcgtaagcaaagcaaattaagatggaagctctactacaagataaaattacataagaggtcccaaatgatttcactttattggattatcctctattctgttcttttccattgctggggccaactgacagttgatcgtatggatacaggaaaaaaaaaatctgtggcttttagccagtggtagcatatcttattgaaatgtggcttcttaagtatgacaagtgtatttatcttaattctaacatgacgttatatattccggtctgattctgtgggcttaaacattacactagaaacagaacaagaacatcttgaatgacattccaagacttaaatagtgcaagctgatattccttgccaaatttccctttcattctcactgaaatagctttgttcactgcatcactatgacaggggaaggtgaaaccatcggagtggtttgctcaattaggctcaatttgcagtggggtaggtacatcccacgaacacacaggattctgtgctctgcaaagattctagcttagacactggatcttcagccaagggaattacaaaataccttcttcgtttaatgtatgtttagtttcaggctccctttctagcaatgtcaatctaaccacatgctgatagagattttaattcaaccagaaggaatctgagcctttccatcctacccctcatccacaagagtatatagcaattacttaattatattactttagtagtttgttcagccatgcaagtttgactggatccacatgtatgtaggtcttgtcaacagaatgagccagaccttgaataactcagactttgggatggaaagatatttaaacctcaaatagaaaaaactatatcctcatccatagtcctgctagtttttcaatcaggtgaccattgtctggtcaccaggaagggagactgtgtcgattaatatatgtttgaacctatctacacggctgtttctgggatgaagggatgagaaacagtgttgtgttttatcttagccttatctatgttactcataagatgtaactgatggacaggttgctggatctcatgattttaaatattgcaggtaagttaactatggagtcttaaagttcacaccaaaaacagattccacccatttgccaggtggtctcaggccctaggcagagaagaagcatgatggtttagggtgggccctggaacagctacagctgctgaaatcctctttgaattacacttatccagcacagccacaccaacaagtttataccctggggtggcctgactctgccacaggcagaaaggtgcatgcaccatgagatgacagagccttaatttgggatcaaggggctaattaaaaaggaaaacaacccaacacaccagggtgatcttgcataagcattttatgccctgcccacttctcttgtgcttattatgtatgctgatatcttagaaaactgccagtttatctcatttttttctatggtacctgcttataacctataacctccctctaccttccgggtctgcacaacactatttttttcttttgggtttatgaacccaggatgggaaggaagtgcttggcatcttggaggtgttggaaggtgtagtgtggggttttgctcgtggtgggaatctggtcttaaaactcagcatgagttctggctgagtgtgacagggaacttggcaagcggtcactctagtgtccgtgaagccctcagcaagcagtcgcacgcactcaggtaaggatcgtggtcaggtgtccagcagcggctacatcagctccaaggctcttctgtttcacaggccaaggggctcacagcccagggcctttgcaaagaagcagggcaggccttaagtgcagtggatttcccatctcagggaagtgcgtggagttggggggctgggggatggtcccaaccagctcagatccaccagaagcatttctttttcaccttcttggttttccgccttaagtcctgcttttccggggctgggggttctgctggggactttggtgggggcgatgcctcctcaactggctctgcttcctccagactctgcaaaacttcatggaacctgccttcctgctgccgaaaatcatactctacactgaaaaacacagagaggaaggaaggaaagtgaattcgaatcagcacagactgattaagcatctctcagccccaactaatatggaagagcatgagctttgggatcaaatcctagatccttaggtacctactggctctttgaccttgggaaagtgatgccacctctctgaacctctagttcttcagtgattgaattggcacctgtaatgccttcctcacagggatgttattaagggtcagtgagacctgatggcaagtgttctgtaaatattggctccagtctctctcttaatcattaatggggttttggcatgtgttatgcatgaaaactgtctcattattaaaaaattgagataatgcagaggaacagacaagaaaactgacagctcagtttcattatctgtaaaatgggggtaataagagcacctatctcaaaggctttctttggaattaatgtgtgtaaactgagataatataaatgaaatgctcagagtagtgcctggcgtgcgctaagtcctccgtatgtgttagcttctattaccgctatcatcatcatcattaacataatttctaccaatatattacgtcttgctctttgaattgcatctcaacttcaagatatatcttggagagctttacatgtaagactgccttgtagtattcctcaatacagtgtatttaaatattcctctactgatggatggacattcccaacctctttttcgttgttgttgttgttggctattttacttgtgtgttttggtgtcattaacatacggactgcattgtcccgtgctgattatcacaaacattgaggaggtaaaagtgaacctgtcgcagagcaggggtccctgaggtcaggggaggtgggcgttgaacagaagcctggcctgtagggagtgggtgctgatgctgtctgtgacctctgcatgtctggaagtcaggccagcagacctcagggactctcagcctgcttcctcactctggttcaccctccccagaacccagagagccggggcagaaaaaacgaatcctcttagacatccctgtgggctgagcacgggttccctctgtccttaattgtctttcctccatgaggaggatttacttacagaggagttttcagtgccaagatgcttataagaaagctcttaagctttttgatgtgtttgttacctggtttcataccaggggtctcagaaggcccaaggatgaggagccagcgtgggagtgtgggaagtggaggaaacgtggtcatgaaaacagtgcattctccttgtttagccagaaggaaaatgaaatgttgcatctgggagaccaaagaccccatgttggtttatgatgtggcatgactggccagtgcctttatacccagcaagggctggaaaacagctgtcattaaagggacatctgcccttgcttactctccccatgtcacctcccagggccggggacccgagttcatgctgctgcaaaggcatgttgccgttgccatgcatgacgaatggagccccaaagagtgcctcgtccctgagcattctgagatggaagaggcagggctgaagagtcagaggggcgagggggcctgttttatagcaagactgatgggttgttgcagggctgaagagtcagaggggcgagggggcctgttttatagcaagactgatggggtgttagttcttagggagcactaggaaagggtatctgattgttttgtttctgcatttttcatccaggcttgcttctcctccacttacatgccttctctttctgttctctctggccctctctatggggacataatcctggctggatgacctataggccatcattatattaaattagaattgtattgtggatgaaacataggctgtggtttttaaagcaaagccccacagtttcactgtgagatcttggggaagtcatttcccacttccaggctatggtgtcctcatctgcaaaatgagtagtgcctacgcaaaggacctcagtgaagcttaaatgccatgtgcatatacaacacgcagcatagagtaggcaccaagtatccagtcagtcactcgacaaacatttattgagcatcttctttgtggcaggccctgttctggctgctgaggaaggaatggtaggcagacaatctccctggcctcctggcactgctaatccagtgaatctgtgtcctcagtgctggcatcagtagctgttagagaccttctagccaaagcccagaatttgccaggccagtgggcagaggcatgtgcagactcacatactgactgtctatttcaggagtctctatttcaggaaaaactctgaaaccatgtttttcctctgctctcacaccacaacaaccatcaacacagaagaagacttctatgaccaaatgtgtgggagtttctccccactaccaagcagtggccaccagttgggtgtcttccaattcagttccagtactatctacccagagatagcatcagattccatagattgggggctcaatcccacaagacttccccccacttacaagtccgggaccttggaacttctgactgactagcttcaagttggggttcccaaaaccccttctttgggtttgattaatttgctggagtggttcacagaactcagggaaacacttccttacgtttactggtgtatcataaaggatattgcaaaggatacagatgaagagatgtgtgggggcttcagcccctgtgtagcactcattcctccagggtatgggcaggacccactctggaatcagtctcttgacccacaatcagattagattccggccttaggcaggtgacaggaggacaggagaaggtcagagaaagagactttgtttcctgaggcctgctcctgaggcctaactcacccaacgtgataacaaaagattgtaacaagggctatgggagttatgagccaggaaccatgggtgaaaacctctctgtctgtctgtctgtctgtctgtctgtctatctatctatctgtctgtctatctattgatccatccatctatcatctatctaatctatcatctattatctatttatctatctatcatctatcatctatcatgtatctatcatctatcagtatctattatctatcatctatctgtcatctatcgttatctatccatctatcatgtatcattatctatcatctatctatctatctatctatctacctctagcatctatttgtctctatctattgatccccccacacacatagatcgcacacatacacacatatataatcataacatcacagtctcttcttccaggaggcatcacctggtactgcacccctatttgtctggggtgtggtggagtgggtttctgtctgcaccacctatacttcattctccccagtggaaactggagatggattgagagcctaggcaacccctgcattgcagcaaggaaggactttaacatggtgagttgcaagctctgattctcgcccctctagcaccaggaacacacatagttcacagatagggaacatctatattcacaatgctcctagctcctgaaatagccctgccctccctactgtgacagaaaaacaatcttcatcatagagtaccagatagagccaaagagagtgggtaccccctctaagattttaggagtctaagattttcttgtacaaaacattccatccatcatcagtccatcctgctctgggcctgacactgtaccaggttccaggaacacaacagtaagttagacagatgtggatactgtccccagtgtgtttgagataggtgattaagtaacaattgctttcaaaatgtacttcttatttctctgaactactcctactttccaattcttcatccatatgcttccaccaaattatatgaatacacacatgcaccaactgccttcctctccttatatgtgaagtgtctctgacttcataattcaaataaacaaacaatgacaacaaaccagctgagtttgacaagatttacaagtgtcctaatacctgtttaataaaaataggctgggcgcagtggctcatgcctgtaatcccagcacttcgaaagacccaggtgggaggattccttgaggtcaggagtttgagaccagcctgggcaacatagcgagacaccatctctacaaaaagtaaaaaattagccatgtgtggtggtgtgcaactgtgatcccagctacttgggaggctgaggtgagaggatcacttcagcccaggaaattgtggctgcaattagctatgagtgcaccactgcactccagcccaggtgagagattgagttgtccccatctcaaaaagaaaatgatattaatgctctggatgattctagaatgtgtatggaacttgcaggcctgggtagaaaagaccgggagatggaacggaaactttatctcaccatcacaacttgaagcccagcccaacatagaggatggagtgagggccccagagctgaatgctcttgggtttgaatggaggctgcagcacttcctggctgggtgaccctgggcaagtttcttctcttcccacggctcagttgaacttgggagttacactagcttcctcgctgggtggctgtgcagatgggatgcaatagcagctgaaatcactgcacatggaacactgtcttggcccactccactcttcctcactaggtcctttgccttcccatctcagctcctcgcatcaaccttcagctcttcagtagctgcgcaccttaccagcagcatcactcctcacccctccccaccatctacattcagggaagaacacactctttatgtttctatggaaacacagcagggtttcattataatcactgggatttagggagctccccactcccctcttgtgactgcccccactggtcttgaacaatttaaaggggattgaaagtaactttcttttcaaggccaggcaaatagcagaatatggagaagtgtgtgtgcttcggaaagaaattgattaatgttttttaggccaaagcaatttattaacataaaggaaaattgccacttttctttttattcatccgtttgacacactacagtttggaagggaggagagggagtatattttgctttggtggcagctgccttataaatggggagggacagagccctctcatctgctttttatcttgaggctgggtagaaaagagaagatgcatttctacttcttacttagctactacaccatgcttagcaaccccttgcaaaaaggagtaagttgccaacttggtgaaaattgaagttaattcttagcagagcgttgtttgcagacagtgggagagactctctgctttgggtttcagcccaaggatccaaatagcacaccaataacttttctgacctcacctcgctttcactgcttccacctactctctgtaccctcccatccttaccatcttccaccatccatatttcacatatgctgtatattccatgcaggatcgtaagaaggaagataggtgcagagtgctgagtttgcagaaccctggcttacagtggagggcaaatagtagttaagaaattgttacaatgcaaaattccggacacgagcccttgagatagtccagggcattcatggtatgtgagttggtcttcctgaggatgcatgggacatgggacctgtggtttagggatgctcagttaactgcctgaggtgccttagagcccttcacatccaaggagatgtctgaacacggagccacgttgcatttagagagtgagctatgtgtaaaccagaaatggtaagaactttcaggtttccctcttgggggtacctcactaatctggcttacagatcagtgctccagccatcatgctcgctgaaaagcagaaagatgtttttctaggtaattggaagcagcaagagccccaagtcatgacttggctggaagaagaaacagtgagtaacaaatagcaaaaaatagataagctcatgagcaaacaacagagcgaggttctggatgcaggatcttggctgggtaaactgaagttgggtgagccaaaaggagataaaaattgatgtagaaagaaataacagaagcctctcagttgtatataacttttgaatttgcaaagtattttagatctgtgggtttttttcttctttttttaattttttgattttttaaaattttattattattatactttaagttttagggtacatgtgcacaatgtgcaggtttgttacacatgtaaacatgtgccatgttggtatgctgcacccattaactcatcatttagcattaggtctgtgtttttattttatcctcatgatagcccaggaagataggaaggttgttgcccatttaaacagacaagcaagttggcaaagggaagtcatactgtaagttacaagcagaatctaaaccctatgtcttagtctgcttgggttgctataacaaaatactacagactgggtggcttatacatacatacatacactttatttctcacagttctggaggtgggaagttgaaaatcaaagtgctgttagttgggtgtctggtaagggccctcttcctggtctacagacagctgtattcccttgctgtgtcctcacgtggcagaaaggggagagggacctctctgagttctctttataagggcactaatcccattcacgaggactccaagttcatgacctaatcaccttccaaagtttctacctccaaatatcatcacatggggcattaggaattaatctgaatttgaagggtacacaaacattcagtctattcacctagtttcctgatacctagtcctttgatttttctgcttaaagaaggaccaaatgttttagccatggacctaactctttccagcattttattctaaggagaagaaacaaaaagagagtacctgggccacattagattaggatacatggtaatttaaatgggcaaaaataataattatgataaaaagaatgatggtcatttatggaatgaaatctatgtgctagacactatgctacaagtttacactccttctctcatgaattctcacaatcccatgggataaataatattaccttcattttataaatgagaaaactgaggcaaagagaggttaaatattctgccaagggcatgtaaatataagtgacagagtcagaatccgaaccctgacagtctagccccaaagcttctacactaagatgcactggactgaaataacatagtaatctgcatctgtatgaaattctgattgcaaaatatgtagggtggtgggggtggaggtggtggccaaggcctggtgctcctggatgacctcacagtcccctgtggaaccagacctaaactagggctggggtgcatgggggacgctttatggaccagctgaccagtccaccttggaatactctttctcaatttcagggcagccttgaaagggaggctgcatacccaaaaaaggtgctctccttctaaggaggcagcctattgaagataatatctggggtcagcaatcttgggtctggtatagcctgctgatgtctccagtgagccattttgcacttccttctcagcagtgggtcctgctcttttataaacaggcatgccaacaagccactgccatcaactacactctaagcaagttggccgagaagtgaatgattcatggcgtctccctgaagacaaaccatcttccaaattcccctccacttcttcttcatctcttgttggaacatttctgtggtccctgtttctacagaacccaggtgcaccactgatttactgacctcctgcaactttctcttttaaagaattagctgtaagaatcaatggatgcagcgagagtagtttggttctcgtccatttggataaatcatgacactttggaaggcatctctggggaagaattacagtctcggatcacaggaactttagtttgtatgtttttctctccccagcctggaagggatattgttcctaaaactttctcctaatgacaagtttgctcattttttatagggtttaattttgtgcttcacaacttgcagctatttcaaattggcaagtctaccccttctcctagggcatctatctgctgttgggtcttcagaaaatcacaggttctcttcttggcatgtatataaatgggatcaagctgcagaaatctctgctgatagctatatctgaaagaaatctgtgttttgggttctgtgactctgtgccagtaagatctgcatgtgaaaccctcagaaagggtagatcatctccgagaaagttaacacacttattcactgacgatgcaaggtcacaaggaaagaggggaagggacaggaaagtcttctgaaagtaggacctagttttgagccctggctccctgggatcttgggcagatcacttaacctctctgagcctcagtttcctcatctgtaaaatgggaatgttaatcctatccacattttaggatggttaggagtctggaatgaaacgatagacatatagtgttgggcaaaatgcctagtgcagtggctgattcaacaaatggtaatgattattacactaacttgatggagaaataaagatcggatcactctgtgatcacctgtggcctctgtgccagcagccactcatttgttattcctctgaaatattcaactcgtgtaattttatatttatggcatgtgtcagcctcttttgctattaatgcattaaaataggtttcattttttattacagataaattgctgatgctgtaaatcctacttcttttcctttacactctagggagaaaaagaaaggggtaaagccattcaagagaatcagggaatagagaaaaatgtcttgggaatctcctgttgggactcagagaaattttaccttttacattttacatgtaccccaaacttcatagctgtttcccaaagagacatttaagctgtgtttgctattggttgttttggagatgctcgagggcattgctatgacgttcacggcccagcatttgaaatagtgtggctcagtccatattggaatttgatgagagctgcaaatgcatctgtgattactagaataacagatatgctgtgtgcctttatcattattttttactgtggacttcattgctggccagagggaggactgtggctggaagacaaggttctcaagagttcacctggctccacgctgggacactgtcataagcagatgaaaggaaaatactaaacaatttaagtgaaaagttggctgctaaacccataggactgagtgcatattgcatttctagagaaatgcctttttctctggttaggtaatagctttgagtggcaggcaaggccagagctcagtggccaaatcgcttaaccaagaaggaaactcccagaagcactctcagacctccaaccgtgtgacctcaagcggctcacacagctctctggagcctctctctcctcagtgatgtgaagcccttgcttttctcttgcagggtgcacagctgtgaggctttggcctgcattccagggagcctccttgtcatactctgaatatgaaaactgtgagggggacgtgctaggaacgagaatgctggttgctagatacaaagggaggctcttgcagagaatctcctttacagaatccataagttcttctctgtctggtccagaagaatttatgagtggatgcatcaataatgattaaaataaaaaagcggccgggtgtggtggctcatgcctgtaatcccaacactttgggaggccaaggtcagtggatcacttgaggtcaggggttcaagaccagcctggccaacatggtgaaaccccgtctctactaataatacaaaaattagctgggtgtggtggcgggcacctataatcccagctactcaggaggctgaggcagaaaaatcgcttaaacctgggaggcagaggttgcagtgagccgagattgtgcaactgcactccagcctaggcgacagtgagactctgtctcaaaaaaaaaaaaaaaaaaaaaagcaattggtggtctgtggagtttgagaaaatggaaaatgagcgggtggtggtggcagattctgcgtggcatttagcttcatgcatggtccttggttcccaagcaaggggtgaccatacccctatcctgaagtgggaatgtagtggtaatggtcagcatttggacacccaccttttacacgtgtctgctgttgaccctctagggcccaccagagggccgttcttagcgtttggtcccttggccagggagcagaattaggctttaattactctcaacctttgttggaggaaaaatgtcagcctggattgccaatcagtttctgatctcagatgaggcctgagggactgagagaggtgggaggaaggaacggttacagctgaatctcccaagtattgcataatgtaagcctgggccccagaaaggcctgagagggactccttttctcttctcattggaaacaggaggcatcagaagatatgcctgctccatgagtaatcctctcctctctcttccttccctcgcccttgcctccattctcacctttacccaacatatataattaggtctatatatgatcatctaaccctaaaatcaaagccaagcagaaaggtaattcatctttccaaagatgtagtaagaactaaagctactctctgggctattttacaagcaagtattttttattcatgggctggttgtcacaaaactttctagtaaatcaagtatcttctttcaagaccctgattttttacctaaaaaaatccttctgctttatttgaaccaaccattcccagggagcttgctgcaactgcggattcccatcctccaccccacactctctgattcagtggctttggggctgaaacccagcaacaagtttccatagacacccaggaggttccgatgcagatggtccacgaccacgctttgggagcactgtctagggcctacatcttcaatgtaaaccctcacgatgcccttggctgagtggaactcagtgacaatcgaacattccactgagacctaatatccttcagatgagtctggcatctggaaggcagcatgctgtggaatctggcttgttggaagacagaactgtgttctgctgtggccgttgcaattactatttccagaataattgtgcaagtgcctcgcctctctcagcttcaattgcctaatctgaatgttgagcaagtgcctgacccttcctgagcaacagttccttcatctgtaacatgggggtactttaatcaatctcatcattgtgaggattaagtgtgaaaacaaaaggtacttcaagtgatcagtaaataatggatcctcggtaagtggtagctctcttctttctttcccttaagtttcagcccaacagatctctttcgtcagctgttatcattgtaaaaatcatcagttaaaggcaaataaactggcctccaattatgaggatttattctgagtgtacttatgtccctttgttgaaattaccacaaatttaatggcttaaaacaacatagattttactcttacagttctggagggcagaagtcctccagagctgtaaatcagagtgtcagcagagctgtgctctttctggaggctctaggagagaaaacatcccttgccttctctcacttttggggtctgccatgcctcctggcttgtgaccacggcactctgacctttgcctctggcgtcacatctccttctctgactctgatcctctggcctccctctttctctgcggcccttgtgattacactgggcccaccagacaacccaccctgctctcctcctttgaagtccttcacttcatttcatctgcaaagtcccttttgccaaataaggtcacatatgcagagggtctgtaggatgtggacaccttaggcattattttgcctacaagcctgggttttgatatttagcattagacatttagcaagagaacctgaagatctgatgttctaactcattctcccaaagagatcactgggacaattcagacaccagagaagggagatattttcacctggagggagttttgtggttccccacagtcaaactttgcctttcccactacagtcaggacagaagtcctgggcaataatgtctgatggcctggaagaacaagggtttcaatgtcctatgaaagtgcagcaagctctctgagtcatcaaagaaaggttctctcttgttgaaagtatgtggcattccagttattttgaaactggcaacctacgggcttacattcagcttaaaaagacccattgagaaccagttacatagaagccctccttcctaataagaatatttgcttaatccttcatttcctcacccaggagtggtggtgtacactaatagtaacaatgactttacttctggacaatttaaacagctgtctcaagtccactactggttttccttcctctcctagttaatagagtcatttctttctttaataagaacctactgagcaccaagtatgtatgagacactgatccatgactttgagagactagccatttgctgaaggaaagaaacttataaacaccatattacaatgcaataggatcagtgacctagcagatgagggctcatggcatgggggtccttctggggaaggattggattgtgaggttgtccagataactgacatttaagctgcaagactaagaaatatccacacaaagcagggcagaaaagacgtcccaggaaagcaaaggaacttatgtaaaggcacagaggaatgacagaaccaccagctgagcacctagttccccatggctggagaggagccacagactacctgaatcaggacaagattgtttagcgggggagtgacatggtcagattctatttttcaggtgcaagttagcaatctgcatggaggattacttgagataagggaaaagagacctgtgtcaaaaaggtcaattcacgttcaagtgacaaatgatgagagccttttctgaacctgcggcagaggaattggagtgaaggggttggattgagcagttggaatcagtagcttatttggcatatgaagagaaagtcaagagggattgtgatatctttatggagttgcctcttggtcaatggtgttgaacaaagtaaatatgggaagaaaattaattttgtggtgaaataggtgtgtttggggatatgacaaatttgagttgccttgggatatgaagtggaaatgtctgcatgtagttgcttgaaaattttagatagatagatagatagattgatatagatatcagataaaaggtagcagaaagtggtgccacagaaataaagtccatgagtgcagttgaagtgatgggaagaaactaaggataagacgaggagcagtctgtccaggtggaccctggacaaacaaaacctcttctatttctctcacctctctagcacctttcaaatcctacatggccaatctctctcttcacccaccgaaaaccgtaaggttgcaactctgtctttccaattcctgaacagcatgcttggatgggagatgaaaagttttctgggaaagacctcttattattttcctttaaaacatattggagacattttacaactgaaaccaagcagttttttcctgggagttatgtctagaaaagaaatgcgtgatctctgtaatcaaagacctctaaagaagcactgctgactatttttagcataaacataaagatgaatgctggagatatgactggaaaagtagagaagggagtgagggaaggaggagcaagtggcttagagggacctcgtgcccttgagaaggtgaaaaggagccgattccttagggcaccatttcccaaacttcaatcactcattctccaccttcatggtttttgcaagattccccataccatctacacagttattcacttcactttttttctctaaatccattcgctttttaaatttaaaaacatgttttatgtaaaacaggcaatatcacttttggaaatgcagacctgcatcaattacaaaaagtatttaaaaggactagttttagaagttaaagccttcaataaaaaaagtaaaaatgattgtattctagctagataactattgcttgctcagggctgtgaaactgagacctgctctttctttgcagagaaatgtgataagccagcattaggaaggttttaaagacgttctagtaccaaactcagattttcccctctaggttattggaaggattgaaataaatttgaaaagagaacaactttcttactaagtaatttaatgttatttaatcttggatgctatggtggcattcactcaaccctttgggtaacttgtgctaggattaatgctaaggagaagtgaagggagtgattggggccaaaacagcctggaatcagctggtggtttagagccaattgccactcacttcctgtggagtctacagtagtcaaaaccaaaggatccattcacctttatgtacggaaatccctgcaagctcctgagagccatggatagaatctctaggcattggtgttgggtctgtgctcttggtgagataggatgtatccaagtgttcaatggtaagaggagagccaaggaggcttagggagcagagagaaggagttagatagaaccagatgaccccacatgtcttgataagagcaagcagcatagccatagcctccagctgctggagcctctgggaaataccacttaggaaaccgtatgcatggctaatttagcagcaacatctccagagaagaagacccagtgggcaatccatcatgcgctggatcatgctgctttatgtacagtgacatgcactgagcgcatccatcatcggggagagagatcacggcttaacaaggcctggggatgagtatttcacatcacttattcattcgtttctaagatctgactttccagaacacaacgcaagtttgaagtcatttgaatgttttctaaaaaaaaatgacaactctcatcttcccactgttactacgatggggctgttcagatctctgctttcatcaaattaattgcccgttcccttgcaatggcttagatacaaggatatagattctttctgggagaacagtctggctttgaatggtaatgagggatatatgcatacaattgctgttcttctggaaaggatggtgtgcatgaaggtttgctaacccaaccaggggtgtaacttaatttagaatgtttgctggagatgtttgaattaagtgctagaaaaatgcaaacattctcagacatgttggaaggtcatagtttagccaaatattgtcacttttaattcggtttagaatatcagaatgtcagaactaaaagggactcttggggccatttaattaaagaccctcatttttcagatggggaaaatgatttgcccaaggcgaggtcatgaaactcatagtagacttggaaatcaccccttgccctttttacttatataggccaaatataaaatcattttaaggtaacagaaaatacattatctggctccggaaaagaagagagactatccaaaatttaaatggaggttagttcaaattaattcttcttgtttatgatgaatagttttgtcctctctgtctagacatttaataatttttgtcccttctaatgattagaaaatttgttcaagttagaagatataaaaaaagaagcagcaaaaagagagcaattgatgaaacttctgcttaggctttccaatgctgcagggctcttccggggccctcttttttaaaggaagacttcacattgaggtgaaaggcatttatctgtgagcagtcctgacgcttctgttatttgattaaaaacaggtggttcctctttgtaagcagctgatgggttcaatgaaaagatgctcaaggccctgcctaagtgcaagcaccttctgccttccaggcatatggtctcttactcattgaaatttcaggattctgccagagagaatgagaagttttaaaagaagacataggcaacccaattaggctccagtttgctcaggccctaagctgccagttttcaacaaaaagagaagtgtaatagagaaagcaaaactgttcactttggtcaacaaaattagatgtcgtcaacggaaattactgcttttgaccacttttctactatgccatggaaagtgggcttccagctaagggggcattgatctttctagtaaaaacaggtataaacccttgcatttgttcagaggtttgcagttacaaaacacattcacatatattatttcatttggtcttcatggcaactctgaatagggataattgttccctattcagataaggaaagtgagcccagattaagttagctgatggcagacttggggattaaaacacagatctttgactccaagtttacactgtatatcatgtttcccttttgtcacttataaaaatttactgcagcaaacttactctgtgctagaaggaaatgacatacttagaaatgaacataaagttcttatcatggttcttgactgtgccaagtaagggcttggcatagcatagctactgttgaggaagaggcagtgtggtggaataattaagatcacaggtttgggatttgaaaaatctggatgtgagtcctgagtttggccctttctgctctaggaaaatgctctgtgtgagcgagaccgaatgccttaactttcctgaaggtggaatgagatgcaaatgtgcatgccaagcttaccatgatgcctgcacttagtgtttgataagcctagggatgattacatcaaaagggtatgctcatagactttgttctaaggaaacaaagcaatccctgccttggaaccagatgttaacatttcatagttaaataccttgtttttgcctctcttgactttttgcatttaaaagtttgctagagtgttcagcggaccctatggctttatggtctacagagcaggcctcgcttgtggccaggtacctgtatatgatgcacgccgtgttctggcaggtactgcaattgttgagatcttggccagttcgataaaagttgcgcctgcaagacagagcatttgctggataaatctatgggcaaaagtcacgtgggccacaaacattcaacctacttgtcccttagtccctatagcacagcattcacggtgctctgaagttgcacggccattacaaataaggaaacaagaatgtcacgacaataggagctcacatgtctagaaggctttatacgtgttaaagatttctcaagctgagagttttttcatgctgacaacaatcctgttgtgagatgagggattctgcaggtgagtggaagggaggttattaaaactcctgacctcttagttcagtacatttcattctgcatcatcacagtgtttctctcctatacggcagtgctgattctgattcatacagcaaacagcagttaatgacttctctctcctactgtttttgatgagctttagccattgcttcttctttgtctttagagagcactttctgcagggacgagcatttcgcatctaaacaaataactgccttttcctcctatactggtgctgagtcacccaggaaagcattttgtgactttttttctctttgccgaaaatgaattgtgcaaaatgaattgtgatctcatttcagttccaattagttggtcattgatgggccagcccgtcatcaaagtagtcagtacaggggaaggtcaatagtaagctgagtggccatctcaagtcctttgtcacaatgacatgaagaacagaaatactgtacaaatgcagtagcttgctaagaggagggggatggggaagtgccttcctgctatcattttcccccatcatgtatcaatagaaccctcatcttcataaaaatcatttttgatcttactgctccattgctgcctttccccattctgttaacacctgaaaacgaaaacaaacagcagtagaaatccacagaaatccaccaaagcctagaactaaatgaaattccattagagaaaagggaggtctgtggttatgatttggagaaacaacagtgcttcaaacattttggagacatttttactaaaagaaaccaaagctgtctctgcccctgtgttggcaaatgacttcacccagtcatttttaatatgaaaaaaaaatctccttacccttcagtgagagctcgagctttctccaagtcttgaattacattcaaaaggactttaattttctcttggttcgagtgcagagattcctccacagattgcagtcggccttggaggtcgcagagttcaccccgtgccaggtgaatttgattaatgtcactaatctccctgttgctctgaagtttggtctcactccttgaaagagaggatgggagatgattacttcctggacaatttggaaactccagtgtgtctgactcggtggggttgtttgccgtctgctcctgacacccaggggcagatttcgatgcactgttagttttgagtgacaccagattctggtgattgttacttgatgaaggacagtctgaggctcttcctgggtgggctggctggctgtgggagccttgtgagggggaactgtgagtccgtggagatgaaggaacacacgtttcctttgactgagatgacagtgagccaaggtctttgtcatctgagttgtctttgggcaaaagcaattcaggtttaagttcctctgtgcctggtgtgtggctggcaacgctggtggcatttaagcaggaggtggatttttctgaatctagtggagtcacccttctcccatcacctggacgtgtgtcatccaaagggtgtatggagttacttacttcagctgacctgtctgggctgagagcagactctctagcttcccaggaaggactgtgataaatatcatctggaacctgaatggcagctgtggctttctctaaggacctccaagttcctgcttccaagcatatgctaacaggaccattgctttgcaccttggggacccttgggaggaatgcatgggacaccttgacccttcgaggcccatcctcaagatgctgagccaaccttaagtaggcaaggtcagaagacacaatgtcctgttcagagaggttaccgttgacctggatggcactttgggaggctgttggcatttccaccagggacttactggctgtgagtctcttccttttgaaaactgggaaatgcttcctgagactgggggaagtttggattgcaatgttgcgaaagccccctgccttctgggacctggggaaggagagcgagtaggtggggggaagatggtgcctggttgcttgagtcttccccatcacagccgggtcttctggagtttggacgtcaacctcagctaggccagttggattcttagtggtcccatcttccttgaatctcacctgctgggatttgctcctgcggtggtgaggttgtttcacaaactccactgattctagactgttacgctttagaagcacaggtctcactttcatattttgctgggccattgagcctcagtgggaaggatcaggaccatacacttctcctaggcacatctccccttaggtctttggagcagtatctaatgatagtatttcaatcatagagaactgctggccaggatggagtggtcctctcctcttagtatgggaaatcctgttggccattcccagcctctagagtctacgtaggaactatctgtaatgctttccctgcagttaaaatattaattcattgtagtcataattgctccttggaaaaacaaatgagttaggctaactattaaacatctgatctaccaagagagctggtaggcggtttatcaagggaggctggcacgcggttctgatcttggaagaagctggctgtcttgaacaaaaagacaacaaaagtaccatttagggggtagtgccagactcccaatgagtgaattccaaaagaaacctgctacgtctagaacatacagctttttgtttcccagagcattaatttccagggtgaaactgcaggaaacttaaatgcatcttctttccatagcaggtaaacaggtggagaaataaatgacctggaggtttgcttgtttgatgatacatgatgctcccaagggaacattcccatttatgtcaatcacaaattcctcctttggggccattgttttctttcatgctgtctctcttttcttcagtgagggaaacttatcttcctaaatagcctcacaaaacccagtggggtatgaccaggacaggattgaggaatcacaggggattcagtgggcagagtccctgttgtggtgtgttggccgaagttcacatgtgggcacggtgagctacgtctgcagcctccatgatgatgtatgtttgcttggcctcaggggctgaggtctgagatgagctggggtctgatatctgcaagcaggcgaggagcacctgaaagggaagagacaacagtggccaatgagaaggcagtttctgtggacctggatttctcttcaaattctaacttcctagctgagtattttgagtggagggtctaggaataagtcaaccacgtggcctttctctcggttctctttgtgaaccaggtgctttgtgggtgcaaggccttggaacaaaatgcctgtctgcctggacccttttctctctccatttctgcacagcactcagccaactcctgttcatcagtcaagtcccagcaatttctcaggcagcctttacaatgtctccctcttactcacacacccagtgccaagaccacatcaggacccattgtacatcctcgtcacatttttcacaatacaaattgcaactgttattaaataagcatttgtgtatgtatttatttaatgtgcatctcctccactaccctgtagactccggagggcagaggctggaaccatctcattcactgcttgagcattcctagccctctttctggctcactataggtgcttaagcagaatttgttgaaaaagtggatggttggatgaagggcaggtccttgtgaattaaagagagcctgggcatgaagaggagtgaaggtcctagggtatcctgctagggcaacaggacctgtgaactcgttctgctatgactgcaacatttatttaaggacaaaattctcccctgatgtcttcatttcttattgcttttcaggagataaatgtgcatgaacttctctgaggaacaactacctcataataataatagccaccatttattgagcacatacttttaccatgctgaggactttacatgcattaattaaaacaactcatatttactgagtactaactaatgtgacagatgctgttctaagcgctttccaagccataactcattcattaatcacaaactactctataaggtagataatatttttgtccccatttacagttgaataaaccgaggcccagaagggttaagtaacttgcctaaacatatcctactgcttttccaatattgcattatctcatttaatccttacaaaaaatccatgaggtgccattatcccccttagacttacggggaaattgaagcttagagagggtaagtactcagtagaggagctagaatttgaacccaggtgtctgtcattccaaagtctgcattcttaactatgaagttatgactctgcccttttgggatctgcatgatatgttgacagttgctaagaacaagggtaaaagacccttgcagatctggagtgatctgcatctctctttataaagaaaaaaacccctctttttctttataaattacacagtctctggtatgtctttattagtggcgtgagaacaaaatgagccatcctgggacagaatgagcagagtttcatgagcaggtggttcctcatttgccttgcctgtttgaagagcagggttggcttctgagagtggcattgtcacatacctctctgaggagatgaacctactggtcccgagttgctttacataaaaattccaaacaatgcaacttttagaattggttctatgtttcaatgactttgtgtaggacttttaggtctgggagaatcccagagacaatttcctcagtccatgactaaatcctttctgcatcttcctcctcagataataattaagcctgcctggatacctatgataatggggagctcagtacccaattccctagtccataatagttattttcattaatagtaacaaatatgtattaacaactcactgttaaatgctatgttagcacctggcatttaatcctcaaaataacctcctgtatattatccccgttttgcagagtaagcagttgaaatttgtgagatggtcgcatgcttaaaaacatgcagttcatactcttcatctttgtactgcagagcctaggtatttatatgtctacttttgagggtttccttgactaattgttttttgctttcttcttaactgctcattagcacttcattctgggaacgataactcacacaggctatgattgtctgaggctggttttcataagagctaatgtctagtgcattgattatgtgccaggcattgtgattggtatgtttcatttactctcttccttaatcctatgacactcgtagaggcaggtgcgatcagttccccactttataaatgagggaactgaggcacagaagatgaatatatttataccaagttattcacactgataagtgatggagctgtcatttggacccacagactgaccctgaagcacaggcttctcaccattgggccttcctgccttcttcaggactggaaagattaatatttttgtgcaaggctagcaagcaggtttcaaactccctccacattttcattctgaaagtcagtcattattctggtgttagccctgccttttctccaggaagtttatgtatcctttagatgttttcttttgatctttaaaagcagttggttttctgcttataaagatattatttgttcattgtaaaaattcaaataatacaaataaacaacaaaaggaagaaaaaaatcacctgaaatcttaccacccagaaagagccacagtgcaccaacaatttggtgacattcattctagccttctccctgtgcaatgcttgcacagaaattgcatacacagacaagcttatggacagaaagccttttgttcactgaacaacctggagaaagttacacattatggtgtacagatcacactgtccttttaagtaggctaacatgaatttgtctagttatacaattatctatttaaatagtatttttgtggatatttaggttgtttctaaatatttggtattatttaaaagtctataaataaacatttttatgtaaatcttggagctcttgtctaattatcttcttgaaataaatgcctagaagaagaattagtgagtcaaagtagctgtgcattttagatttcgttgatactaccatgttaccactcatccttctatgaagttctactaacgtgcaactctgccattactgcatgagaaggtctttcaccagaacctctttgttactgtgcctggtcaatttatgatgattgtttttaatcattgccaataaagtagaaaagaaattgtatctcattattctcgatatggaatttatatgagtggacattttttcacatgtttattggttttacacaacgtttgatacaaataaaggctgaaaagttgaaaatgaaaatttgaatagtcaaacgaatgtggaaactctcgtatttttagacagagcctaggaagtttaggaaatacaaaattttctcttgacaaaaatattttgtgtcggaactctcctgcccttgatgtccaccatgacccttgcacagacacatcgtggggaatacacctggctaaaagcaccctctggaggcccttaagtcttatgggctcccaattgtccattaattcacatttccctaggcattggtggttagggctaaattaatatcctggcccaggatccagaatcgttccccacaggtggtcacagctgccctacggctggaattattactgatctttgcaacactttattctgtcctcccttgattattgactttagtgaacatgaaccaactgtttatgttccatctatgcctttggcccacagcaaatggtcctcatggaatcagtgtccattcagtagatacagaaacattggacaatatctctgtaggttgcaaactgtaggctttctctggaattcctgcccagtcctcttttctcagtatctttaggccatacagtgaggggttaagtgcataggcttttgcttaagatctacgtagatgagactcttccactttctgactattgacttggaacaagtgacttgatctttgtaaaaccgcctaaactggttgtgagaattaaatgaaataatctatatgaaatggtcaggatagtcagtgttcactcttcagatagaacccagctggtagccatgagacacttgtgaatttgtctttgtccctcctctttcccttgggatagtaaactgtaggtgcattcatgggaaggaatgtacaaagatggcattcctttgtgcaagaagtcctatctccctgccgtctctgtactttgtgtctttagcattgtgcttgtctctctatattgtgatgatctgctgacttctagcctcttcaactagactctaagctccttgagagacatgtggtaatggtctactctgagtccttacccctccgcttgacacagagagggtcttatataaactcttgtaaaacaaatgaatataatcctgtattatctaatttgccttagcttctaagacatggaatagttggatagttgcatggaataaatatttgcataactaattaagagtgaaggaattaattcacttccaacattttttttcctttcaaagatttattatcagtaggtctcatgtctgttttctagtctactatgctttctctatttacggcagctttaatttggttaaactttatttagattctgttgtgaggtgggcactgtaataaatactgtggagattccaaggaggaaaaagacctgatccctattgtagcactaagaaaggaccttgtaatgccaacctcatatggaatctgttcctaagaattgctacaaaacgttgtacagggtaggggaagacttagaggaaggtatctgattcatttcatgcatccaaattctgccttacataacagggtgctttacgtgttaactggggttcagactatcctttacgccaggagtcagcaagttttttctttaaagggccagatagtaaatatttccatctttgctggccacacagtttctgttgcaaccattcagatctgccattgtggcaagaaataagtcatagacaatatgtaaacaaatggctctggttgtgttccaataaaactttatttataaaatatgcaactgaatggatttggcctgggagccatagtttgacaacctccgctttaggcactgggaagtcattggtggtttttgagcaggaggctcttgattaggttgtttttcagaggaggctttgtttgctgacacattgccgtgtcccttctctgaacttagtaataataacctttactgtttacaccacactttacaacttataaagcattttcaaatcccatgtaatccccactagggaggctgggaagcattatccctgttttaaagaagacgaattcaatccagaaggactcgatgacttgtcctaagtcacagaggtagactggaaccctgtcttcctgctgccagcctcggggctctggtggagaccccgactcttcctccatttagctggccagacatctaattactttatgtgttagtcctgtttcctcagttacaggatgcatttctaaagtgtagggatatgtcttccactctttttctatcctccaaagtcctaagcacagtgctgagtctttaaggagccatttactgttgatcattcacctctgggccttgtggttcaaagtttgttttccttccatttgtcttcagttaattgcttggtcaaatctgttggtaagggttattccatactcatctgaaatcaaagggttaatgcttgtggtccaagtatccacttatctttccaatttgaaatttggaaagctaattttccaaattatatattccaaaaatatacccctttccggcagctttctcagtaaggaaaagggtatattttgggggtctgcctaaatctacattctgttgtaagtggtcaaagaaacaaagggaattgactttctttatagcacatgggttgacttgaggaaaaaattgggcaccaaaaggtgaggttaagatccagacttatatatttgggaccctgaaagatgttggatatgtgctgattgtgaaatcttgttctcatctttctatataccatgtttgacttttttgcacaaattctggtattcacacccaggtctccatcatctctcacctgtatcactgtgagtgtccccctctcttgtcctctttaccatctgtcctccacacagcagccacagtaatcttgataatatttaatcagatcacatcaggcccctctttgaaaccctgcaaaggtgtcccactacatttaaattaaaatccaaactagttccataactttcagggccacaaccttgaacacaagccacaaccctatgtcatctggcccctgtctaccttccttgtcccatctcatctcatgccactttcccccttttctgtgacatggtccctggccctgaacatgctagattcattctcatcatctggctttcaaatctgctattccttttgttaggactcctctttccccagatccttccaagcctgttatctccaggagacactccctgaccccctctccccttccgtgtccctctgtgcagcaaaaccctgtcctattagcttatttgtgtattatctgtctctgctcccatttattgaagaactttagtatttgttgaatgaatgaatagagtaaattcttatagttagaggcttcaaggaatcatacaaccttagaaatagaacagagaagtttaaaactttagatcttgggtagaatcttatttaacgattttcaaaattcccttagcagtaaaatcagctttccaaatccaagcttaagcacaattccaatatctaaaacagaataaagtggagttgttctagaaaatgtaggggactcagtcctgggactcaaagcaaacctaaaaaccacgaagacaacccccctcattatagagatggggaaactaagactctgagcagctgtcttctacctgcaagtgcttcaaaaagaacaaagtcagccgggcacggtggttcacacccataatcccagcactttgggaggtcaaggcaggtggatcacaaggtcaggagttcaagaccagcttggaccagcttgggcaacatagtgaaaccacatctctactaaaaatacaaaaaaattctctgagtgtggtggcaggcacctgtaatcccagctacttggcaggctgaggcaaagagaatcgcttgaacctgggaggcggaggttgcagtgagccgagattgtgccattgcactccagcctgggcaacagtgcgagattccgtcccaaaaaaaaaaaaaaaaagaaaaagaaaaaagaaaagaaaaacaacaacaaccactacaacaaactttagaccttggggagaatcttatttaatgattttcaaaattcctttagcggtaaaatcagccttccaaatccaagcttaagcacaattccaatatctaaaacacaataaagtggagttgttctagaaaatgtaggggactcagtcctgggactcaaagcaaacctaaaaaccatgaagacaacccccctcattatagagatggggaaactgagactctgagcagctgtcttctacctgcaaatgcttcaagaagaacaaacttgctggtgtgtatcccctacacccgcacagcttctagcatggagcaggagctaggtgaacatttgtggaactgcacaagtgacacattgagttgaaggcagaagtggaactaatgtcaatccaggttctcctcttctccagtacaccagtgagaaaggttgagggccatggcccacctggttccagctcaggtgcctcatttggaaacagacctagtggagaagacaggctttctgatcccagaggcctctccgatggatgggcaagccactaatgctatttttttctaccactccaaccctctaattgcatttgtcacagacacccagggagatatgactaccatctacctctacctcctcttcatttttatcctttcttctaccttatctttcttttttcaaaaacataataaaatgtttcaggtgtgcaagacagcacagaggacagtagagtgaacataacaaacatgaccagcctaagacatgaaaggttacaaatctagctggattatcctctggatttcctctctcctttctcttttattgtgtttccctctgtcttcactccttcttttccccttcttctcttctgttttctccagcatggctccccatttcatttctcccctctcctccctgctctttgtctcaccacctttcttgccctcctcttttccacaccctgcccttcctcttccttcatttcttttgttcctctctagccccttctcttgccttctccttctctcttgcatcttcataaatgttttagggtcagtgattcattcctttggctattctatgtcaagggtggggaatcagcatctcttgaatttcctcttttgcaagcctcagggcacctgccctgtagggacaattctgtggtacattcacccctctagccagaggcattggctgctgctgctgctgctgctgaatctgaaaggtcacctccagcttgctttctccaggggaaagcctttactaccaccagatgcaactgctggccaattcatccagcttctcatagaagaaagggcattggcttaatattatctctgtatttctcagcattttgatttctctccagagatttttctgatatttttcaatccatttgtttttcactacataactggggacattttcttacccttttttttttttttaggtcataccactttttgactttaaataatttgatttatttttcctggggtcaaacactgggggagctgcctgctcaaacagatagaagaatctagaatctttttgatttgttgtcagaggaatagctctgtgtgtcagatggaagggagagagcagaagtgggtggtcatgtttcacccctcttctccataagctccatccagaaaaaaacaacaggaagccagacagacaatgatttgcattgctgtgaacagatttactcatagggtacagagttggcacaggccacttctaagttatttttcaatgttgacgtgtcaacattttccacatgggagagggatccagttggaatggaagaaggcaggaaaatcgttttccatctcagcatcactttctgtggttttgtggtacttggaaactctgtttacacttgacaatctcttcctgtagattgtctaaagaaattatgaataaaattggaaaagtctttccattctgaagggacctatgctccagtatagaccagtcacacacatttggctgattaaaatactagtcgttgtactaaaaacgacagactccagtgaccccttgcttgtcaatagcactgccaaagttttcaaagcatttttagatttactagcccttttccacctcacaacaagttttgccaagactaggcattatcactcccattttgcagatgagggaactggtagagaggtgcgagatttgcccaagatgaaggtggtctggcaggaccaaaaggacagcagaaatttcattagatcagagagcttctaatggaggccagaagaagctgggtgcctcttagaggtgccttgggtgggggctggcaggattggcccacagcatgacttggaagtacccccttctcctgacatagatacacattgcacacccaccaaggacaactgttgggccctggactctgcagtgcgccatccaccctggtacagcaaagcattggcaggcagctgcaatgaaggttttcccacttctggatccctgcctacactgaagaattttcacaaggggaagagaaggggggaagtttatggtctgatctaatcacagatgaacagagaactcggtggcacaagcagtttgcaaaagcgcatgactgcagtgccattaaagagcccactcttcatttctgagatgagtaaacagcgtgcccagcagcatgtgcaacacacagtaggtgctcagtaaatggtgacttccactgttcttatctttaccatggttaccattatgcactgggccccaggttacacagagacgggacaaaatcccaggttttgagagtccatgcgggggttgtggcaaatctcaagtaacattaaaaggcagaagtaataaaaacgaaactcaaggagaaaatgctgccaaatgtcccgtctgctggttttggtgttgtggccccccgtgaggtctgccatttcttaaggggccaagaacatctctgtggctttttgtcattcatttcctcctctcgtgcaggaatctcagaccattgctggaatcgatgttgcattctgggacttaggctctctgcctgtacaagctgtgaagccccatccacctcccatgcaaatcacaggctgtgtagcacacctttaattgcctctcacctgatgggctcacggtgtttgcctaatgacaaaggatatcctttttctcatggatgctggtcaaatccagaagtataaaagctcaagtttaaatgtcccccttccttctttctcctttcctcccttcctttctctccctcctccttccctctcttgtttcttgcaaagggaagagcatatggtagagagaaccacccagcctcaaccccacttctcactctccaggataggagactaggaaaggcactgagctgggtggagaactttcctggagatccggggacagggggtggtctcactcctaaccacctatactcacctgagtcttctcccctgcccctagagaaaagcagccagcagccagcattcacgcatcctcttcttttgggggtaggatcacactccctaaagctccttcggtgccccatgctttcaccctgactccagccactgggggttccaccttccctccacgttacctattgtaaccacagcccccgagagcagggtgacattccatctcctggaatgaaatacttatcatgacttggcaaagcctttctcttacaaagagttattcatgcacttacacctaaacttgctgaatgacctaggacaagtcatctcatatctgggttctcagtttcctcatttgaaaatgaaaggagcatttggctcacataacgcagtgcctggcacataatagatatagtaagaatcagccagcagacctcttggcttccaaccttccttccttcttccctattttctggcctggagatgtccccgattaccactacccttgtcttgcctgaacagggacctttatgtgaatgctatgatctcaagcctggccttggccaccctccatgatcctttctgggccaacgaccaggacagcctttctgtttcccagtcccatgtctgagcctgattggctgcactggggcacagggattggaaggagctcccagagcgtgcaggcagatggtgaaagagccagaaaccgttgctcctggggtcggggggcggggaggcagtcagcagtgagcaacttcttaaagctcacatcaacattccccattctggatgagatccagaatcttatgggttcagagtttatctgaagtaccgggaccccttaaatcccatgtggagtggctgggggtggtctgataatttaggtagtgtggcatggtggacaagagcttgcattctgaaaacagacggcttagatttcaatgctggctctgccattttctgcatctttgttggagggtaaattacttaacctctctgggctatgattttctcatctgtaatatgtggctaataatattacttaagaagatgtagctaataatattacttaagaagctggctgtaagatttaaacgaggtgacacactcataaatctttcagaaaagcgcctgtcaggctggaaccacttaataaactttggctcctattatgattactagcattattactataggcagtatcatcattattattatcaaagtgtgagaaccagcaaagatttctatcactcactagtcgccactcaaactctcatctgtgtgaagcaggaatatttatgatatagtccctacccgctgctcacagtgggtgtgggagtcgattgataatgtagaagaggataaatgtttataataaaatgcagatgccatagaactaaaagcaattagtagatgacagaagatgagaggtaaaaaataaagttaataaagaggagaaaaactgagcatcaactttgacgtgagcttcctagtaaaccaaggcagaaagggaatatagtaagacatatttttgtcattacttagtgcttagtgctagacatttcatcatgagtaacaaccttcttttgtagccttgaactctaagagaaaattatcataagaatatttattatgaatttatttacacatctaaaattttaggctttctctatgagaaagagaatccttatgagatttggaaagtatcacaataaaaatggttgaagaaatgtgagctctttttttttgagacagagtcttgctctgccaccaggctggagtgcattggcatgatctcggctcactgcaccttccacctcctgggttcaagcaattctcgtgcctcagcctcccaagtagctgggattacaggcacacaccaccacacccagctaaccatttttgtatttttttaagtagagacaggatttcaccatgttggaagggatggtctcgatctcctaaccacatgatcctcctgcctcttcctcccaaagtgctaggattacaagtgtgagccaccgtactcggccaggaatgtgagctctttaaccaagagaagagcaaacggaaagacatgatggtccctttaaagacttcactactgtatcaagtgggaagtagggttgccctgtaatatttccagagacagaaccacagccccatggttgagagcctggggatgcaaactgagtttcagctaaagacagaagttccctcaaactcaagtaatgcaactctgccttgtgacggggtgagctccctgtccatgcaagcatttgtctagaaggccatcgtcagggccacatggggaagctctcactgcattcttagagagcaaagagatgattccttcatcccaggatactttaattttctccaggtctatgtaatagaggagtggactctcaaaagaagagctgagctttcctcccttgaacgcagatgaacaactctaataaaaaccatttcctacaaagctgctcccctagaaataaaggagcaggctagctagagcaatcaaatcactttttaaaatgattctttaagatgaagagtattaggaaataattcggctgagcaattgtgagtggatttggggagagagtcccctgtcagaagtgactctgtcacctgccaccaaccttcttgtgtgttgttcttcctttgtgtgtcccagctttcatcagtacgttctgagcttctggggctgactgaggctgcatgaacaagtatgtgtccctggggctcccacagctctaccccagctctcctctgcccatcaactggctgccatggtctcctttctcatgggggctccgcttgggaagggccatatattgctcagcaccatgtgattggtgcctgcacagtgttgggcccacagcagccaggtgtactgtatggttaggagcataggttctagagccaggctgcctgggtttaaaatccagctgtctcatttactagctctgtgaccttggtcaggatgtttcaactctttgagcctcagttttcttatctgtaacatgggattgataggagtatcctctacatgcacacacacacacaaaacaacaacaacaacaacaacaacaacaacaacacacaccggattgcagtatgagttcaatgaaagaatgacagttaagctcttaacatagtgtctatcttatctactatatcaggggtcaaaaaactctttcaatcaagggttagacagtaaatatttgcagctgtgtaggccatgtggtcttttttcaagtactcaactctaccgttgtagcctgaaagcacacatgggcaatatgtaaatgaacaagcatagtgatattccaattaaactgaatttacccaaacaggtagcaggcaagatttggcccgtggacggtagtttgctgccgttgtgtaaagcagcaagtcagagaaccagatggaaatgagcaaccacagagactaaagtgaagaagcaaaaggtggtagaatggtggattcaacagcagcatccagaagttaagaactcagtctgtgaagtagaacaggtctggtttcaaacctggctggtgaatggtgtttgctctctgagacttggcttcctaatacataaagtgcaagatggcaagtaaaagggacctttctcaaatggctgatttgtggattagaagagatattagacatggtgccaggcatctagtaagagctcaaaaaatgttagcaaagaggagaatgatgacaaggtggctgctgaagtgaactaaactgaattgaaccacagcctccttttgccttcagcacgcccagacagtatggctcattaggaagagcaagagtcttagatcctcagagtgcctgacttcctgccttgagacttctctcactctctgtaaagtgcagccaattcatattctttctccatgccaagaatcaggttcaatgagaccctggagggagagcctgcctaccacctacctataaataggatggcaagtcagcaccagcatcaatgattgcaggtcaaaaatgagccttggtttctcagtcttgcttgcctcaaatggacttgaggatagaagggccaaaagatcaataatggagaatataaatgtttgtgcagagctgcttgggcactcaggtttggagcaggactaggaaggccctgggctttgaattgcttttgttcgatgttagtgtcctggaaatagacctctctacataccacgttttgttgggagatggtattgccatccaaagtgagactttcaatgttcctttccattccttgttggcatacaaagactgcataacacatgaatttccccaatgtgttcacagtgttgtgccttttgttgactccataagtttttattcttactttctttactctcagattttccagaaaaaaattaagcagactcttacagccctaattaatgctatcaggcatctgccctaatcatgtattacttgatactgattttcagttatgtcatttccttccactaagatcatgagagtctcacaaactgtccattgtattcacttcagggtctccagcactcgaaaccacaagctgtcttttctcttctttcctccttccctctctccatttagcctttcttcctttccttctactaagcacccactatgtgccaaacattgtgctgggcatcaggaacacctccaagctctcagatctaaaggaggagatgggcaggtaataggcagcacggtaagacgcaagctttaagcaaggtcaggtattgtagaaatccaccatcccaggccctaacctgttgggacctttagacaaccctaacctgttgtcccctgatggaggggacatctgagccaggctttctatgatgactaggagttcaagtcattgaaagaaggaagaagcaggttcaaaggtgtgccttgagtctagacgtgaaatggaagtttttccttccacataaacttaattatcgtggctgggcgagatagtggcaaatgtcaggagaagactggctggcaggaggcatggcatgaaggaccttattggccaaacagatcttctggagtgatttcaacatcttaaagcttaggcaagctgtacatttacaaagcaaacctaaatgtcgagtctctctcctttgggctgtaatattaagagtattgactccttcatgcactacttctaattagaagcttcgattagcagtattacatgctttggatgaacaaaatgataaaataagctaattatgacttaatgtgtagagttgttgcccactatctttcaatacaccaagtcagtggggagagggagagccgcaaagaagctcttggtggtggaaaaactgaaaaatatttcctcctattaccaagatacagatatagcctgcctggaattgactgtaagtaaagtgataaaacccagcaaatcatcgattaggagttcaccatatatctagaactgtcttcaccttgagatacaactggtgtaccaaacagccaaggtcctgtctattttggaacttagttacgggtaggaaaggctgatattaagtgaacaaacatccaagtaaacatggatttataaaacgtgctagatgttgtgaccaaaaaatagaggccggtgggagaatcatgagtcctaattgacattgtgggtaagggaagtgccttatgaagaagtgatgtttgcattgaggagggatggtgggtgtgattgaggtgatgggatgggcatgaaaagagggtgtccaggcaaacgaacattgtgcacactggctctgatgcaagaaaggtatttggcctttgtaacagctaaaggaaaggccagcttggatggaatccagagagcaggccacagttggtcttgaagagttaggcaggagtgatgatattggtcctgaaggccacattaagtcttttggttgatttttgaaaacagaatgacttcaagaggtttacgaagggtgtgtgtgtgtgtgggcatgcatgcgtgcatgtgtgtgtaggagagaggtatattaacacgtttgcattttaaaatgatttttctggtttttctgagaaaatggactggatggggcaaaagtggaagcaggatgaaccagtggggaggctgtaacagtcgtccaggtaacacatgatgatggcaaggtggtaacagtaagatgatgagaactggataaactcaaaaacactgagtattacattagttagagttgaagtgtgaggcggaaagatgtagagaaaggaaattaatttgatttgagtggatttgacttagaaggcaacattttgagacacctagaatgatggcttctaataggctttcccagagccaaatggaggggttttctggaccctcagccatgtgctatggtgttaccaccatgtttgcttgcatctgttggagaagaagctaccccttcctctgcatggtggccgccttgcaagaacacatggctctggggaccacagtgccctctcctaccctcaagtttggagcatgagtggtgtacaccataccatatcaggcattggccttcagaagtaagagaccacccagatgcccaatcagtcaaacggtttgtttctccctctctgtgtgccaaggaaaccacagaaaccaaaaacacaaatgaggctgcatcttgatctgtagggttaatgccatctatcagaaataccacaaaaacactgaaaaggtcaaggaaagtccaggaggggaataaccagttagtctagtcgtgtttaactcccctacaaaagagctgatgaactgctgagaaaagctgtcacaggagcaaagaggcacaatgataaccagcatcacttggtggtgactgtggacgaggccatctttttaaggctgtgctattttatatgatcctcatgttcccagtgagccacattttagaaagctgaggcacaaagaagtttagtgattttgccaagccaccacagtagtgaatagtccagcagggccttgtgctccaggggtcatgctcttatccactacgtgattctgtagcaagaggccacaggctattaaggtcaagtagagtggtttctggaagggacagccttgacctgggttgagaaaagtgggaaatactgagggtcagctgttttgtagactgcaccccgctgaggctccctggggccatttgggaagctgggttcctggcatgatgctgagtgttccacagagagggaagcctcattcctgactgtattttttcctcaaatccttctgagcacccttaatctgcagaaaatgggttgggtactagggacacggcagtgagctcagacattctcccagagcccacagagtagtgagggagacataaaagaaaggggtgaggccaggcgtggtggctcacgcctgtaatcccaacagtttgggaggccgaggcaggcggatcacaaggtcaagagatcgagaccatcttggccaacatggtgaaaccctgtctctactaaaaatacaaaaattagctgggtgtggtggcacatgcctgtagtcccagctactcgggaggctgaggcaggagaatcgcttgaacaaaggaggtggaggttgcagtgagctgagatcacgccactgtactccagcctggcgacagagcaagactccatctcaaaaaaaaaagaaagaaaggggtgaatttcaatgtaaggtggtcatggtgcatatctgtagtctcagctactggggaagctgaggtgggaggatcttttcagcccaggaatttgaggctacagtgagctatgatcgcacctattaatagccagtgcactccagcctgagcaacacagtgagatccccatctctaaaaaacaacaacaacaacaataaaaaaaaaaaaaaaaaaggaaaaggaaaaagttaagagcagggtggtaaatacccaccaagaggaagtcggggtgccgcaggagtcccttggagcagcatgcatccctgatatgtttctgtggtggtgtgagtgtgaaggctggtggctaagggagcctcctcaagggcagggttgtctattgtgagcttggaagagagtaggagccagcgggggccggggggcagggggcgttcgggtgggcacaagtggggagatgggagaagggaagtcacttcaggacacagtaggtacaaaggcctccaagtatggagataagaggaagcagggctcttttgtggaactgatagaagttcagacttcctagagggtcgaacttactcggggcagggggagaaaagaagtaagtttggagaaaggtgggtgagagctcggtcactgtagcaggaagtttggacttaaccctaagagcagtggaagcctccagtgggttttaggggaggagaaactgggcggagtggctcatgcctgtaatcccagcactttgggaggccgaggcaggtgaatcacctgaggtcaggagttcgagaccagcctggccaacatggcgaagctctgcctctacaaaaaatacaaaaattagctgggcgtggtcctgtaatcccagttactcgggagggctgaggcatgagaattgcttgagcctgggaggcagaggttgcagtgagccgagatcgttccattgactccagcctgggcaacagagcaagacttcgtctcaaaaaaaaaaaaaaaaaaaaagtttaggggaggagaaggtaagacattttctggggctgcctagatcctttgtactttcttgggtaaaagcagcatactgacctagcctttggcaagaagcctgatgatttggttcccaagagacagtactgcttggcttcaagcaagtacttgaaagcaaggagggctttcccctcagtcttaatgctagttgtcccttcctttttcttgcaacgctgggcttgctgagtagctgagatgtgttgtattttttaaagagcaacttgttctctctaaatcacctacctgtctatggaatttctaccagtgtgttcaaacacctctccaaagtctcacttctgggcagcttccctttaatgggggtggtggggaagggtgcagacaggcaggggagggcctgagggagtgaggtgggaaggggttggcagagagctcaggcctttagagtgctggcgacctcagcagcaccatcatctcattctctctcattcacatggaggccttccaaccagcctctccccctagtgagggccccgcagtcctttaagaaggcttcccatcatttaaacagacaataagtctgacagataccgagggtggcctcagctcagcgagcattaactgtattagctacattggaatttccatcagtgacactgtatggagctaatttgtgggtttgctaatccccaagtcactcctagtagcaacacatttctgtgtgggagggcctgcccagaagactatggcaccttcactgctccacggctggagcagctcagtgtgagggaagaaaccggctctggaacccgagagacccgggtttgaatcccagctctgccactccctagctgtgtgaccttgactaagcaactgaacctccctgagcctcagtcactcatatgaaaatgaagatagtagtcatgacactctcatggggctgaggtcaggattcagggaggccgtgcagagtgctcagtaaatatgaggtgctggcatgtattttctacagtgggtttaggaagggttgcaaactcacatggcttcagggtgacacaagtgggtgaagccagctgggagcaagctaggcagagagaaatgtgccacaaaggggacccctgctgtcagctgcagccccagttggtgaatgaaacccaggagcagtactgttagagccagtgttttttttttttttcaggagaagccagaactctgtgttaaatatcccaacttttaaatgttggagactgaattaagcttttaaaatcatctgggggcaaaccaaacacatctgaaagccagctgccccttggcaacctcttgctttttctttctgcaagaagtggtttaaaattgggtcctcagtataaatagctcgaggctgccaggcagagtatgttgggagaggacagtttgtggcaaaataatttaatgcccccacctctctgagggtaatgtcactcgctcttcaagtcctgtatacgggcttgaatgatgtccagaatggaactgaaatagagagggatgggtgtggggtaggcagggactggacaaaccatccaggctgtgtgctgtcatacagcacctctgggaggggccactaaatggcagcgtctgcacccaggaactgcaaaccacccaggtgtgcagggctcaccacagctgcgattggtcctctgtcctttttggacttgaacaaagtgagaacactttggggcagatgtagcagccaggaagatttactttctgacaagaggatgtctaaacattcattcacagtcaagctgatttcctaaaaacagctgtcttgaacctgactgtatctaaaatgtctgttgccttcgttcagaaagcctctattctactttacccatcaacattttctcttacacaaggtttaatatctcagcaggtgttgactggttggaagtagatggggtactaattataaatgaatgcaaagacatttttcttacactaagagttaccaaacggtcctgagttcgaccttctttacattcattcgtgcagtaaatcctcaatgagcgattactacatgccaggcattgtgcccggggccgtggatagtcagaaagttctttctgacgtcaaacgcaagctttactgtcagctaagagagcctcagtttcctcatatgtaaaatgagtatgatcatagtactgactactgattatttcaaaggctcccaagccagtgtgtgcacatggccagcattcaataagcattagccagcaaacgggcgttcatctcaattaaaaccaccatcatttgggcttggtactgttatccccacttctaacataggagcaaactgagatttttagatttttaaaatttattttattttgttacgttatgttatgttatttcattttatttgtagagacagggtctccctatgtttcccaggctggtcttaagttcctgggttcaagctatcctcctgccttagcctcccaaagtgctggggttacgggtatgagccacccatgcctggccaaaactgagttttgctgtgacaaattaccttgatgaaagtcacatacctgagctggagctgggattgaccagtcatctaagcccattatctttctgccaaatcacagggaagaccattcctgacctccttgctttactgtcagaaagaattgaagggtggttctggtttaagctctggaaagtctatagggaaattagggcctgaagtagaaagactgctagccgcctctgtcctgctggaaatgtgcatgaggctggtgctgatggtgctgagaaagcaaatgctgtctagagggaaatactatcattcaataaatatttattgagttctgctatgagtcaggcactgtcctagggactgggactacagcagtgaacagagcagggtccctgctctcactgagcttatggtctgtcacaatcctgtaggtgaaaagatgccaaacataaatatgaggttttaggaacgccagttgaaatcaatcgaaagatatggccggggatgcatctgggacccatatctgatggctgctgaggcattttggtcaccagtgaaatattttctgcttattggcaggcaacttgattttgcatttggtttgcgtcattcttagggatactgaagatacagcgatgtgcccaagtcagatgaacacgcccaattttaggagaagattctgctttcatctggaggcagtaaccatgtatttctagaagggagctcttggaaagatcctctggccagttctagtctagttcctgtttactctctgctgggtttaagtggctgataattgggctcctgcagagaagcagctaaaatctgtggcttgtttgcttggaacattttagaaagtcaaagtagttaatgataatggtaaccaccacttagcgaagactagttgccagtcatagtggcagaggctttacaggcattatctaattgaatcctcacaaacaacccagtatgttggaaagttcaattacctctgttctacacacaagaaaattaaggctcagagaggtcaaattcttgctcaagatcacacagctggaaaatggcagagggggaaatgaaccaggcctgactttctctagagcagtggttttcaactaggggtgactttgcccccactctgcaaccttacagggacatttggaaaagtctggagacatttttgtttgccacaactgggagggggtgctactggcatctagtgggtagagggcagggatgctctaaacatcctacaacacacaggaaccgttggccagtccgtgtcggtaaacatctcttgtgcaggcacttcttgccaaaacattttgcattttgtacaatattcccagtctccactgaagtgttgtctttatctcctctcttgctctgccttcatctagaagctgtgatggaacaatttagatcaagccatccccaggaaaagctttcattgaacaacagagcaagggaaagcccaatgtattctgcagccccatttcagttaaggttcaagttcactaatgccagaaaggaattcattaatgccttacaggctgcaggacaaatgttaatagcttcacctttaatttaagctcagttttatttttatagctggtcccttggtggcaactagatttattgggacattttgaacagctgaggcaaatcaataaagtatataagcacatgcgattcttgtgttatttgcaaatataattctgattactcacatgcatataggcatactcatacatgctctaagaatatgctttcccctgctccatgttttaaaactaatccccaaatcatgacatttggtcttctgaatatggcccccaagttatgagatgggcaaggattggaatgaatagagaaatgaacacaaataggttcccacctgctagaggaaaataaatccttaaagcatatgggtcctggacgtttttgtctatctataaatgccaagcaacatattgcaatatggaatcatgaccaatgttgcaaaactaaggatacagtgaactatgtttgtagttgttcttcattttacaggtttcaatgcatttttctcttttcttttttctttttttttttttttttttgagaccgagtctcactctgtcgcccaggatagagtgcagtggtgtgatgtcagctcactgcaacctctgcctcccaggttcaagcaattctcctgcctcagcctcctgagtaactgggactacaggcccccactacattattgcatttcaccttcaaaacaaccctgaggcattagccccattttgcagatgagaaaacaggttcagaaaaattaggaattatgtccaaggtcacagaacttgcctctggcagagagagccactgtctggtgctatttctgtcataattgtcagcccctagagtgaatgtgagcgaggctgagccaggctgcctgctttcagtagctgctgctgatgtgaggagagtctgtggatgatttcatcacctttgctgtgcctccatttctaaagccttcattctttatctatcagggctcagctatgatgtgctgtccagtatgggaaccttgtaccacatgaagctatctaaatttaaattaattaaaattttagttcctgggtcacattagctgcatttcaagtgctaatagcccagtgttgctggtggctaccatgttcaacagtatagaacatttctttctattcagtagcactggatcagagtgattaaggaaatgaaatcagtgggacatagaatatttcagaaagatgctatccaatttgcaatgaatttaaaaaaatctaagttttttctttttgaagaagaaagtctaaatatttggttttggattcacactccatcaggtaccagagtgggaatatttccctgtgcttatctttatgtcagtcctgcaaggtgagtattattatctgcaaaatgtttcttttggattaagaaacaggtttagttacttgaccaacatacatatcttctaagttgcagagcaagaattcaaactcaaatctgccctctaaacctataatacatctactttactctgcactgtgagtcctcaacaaacagaattttggttctatcccaaagccagtgtcactgtgaataaaatacaatccaagatgatcacttacaaggattattatcatccagatttggaacttctagaatggtctgagtagataaacagtgggaaaatcacctgagacatactttatggtgaatatcactgagttgtttacttggggctaatcctctcttttcttctcagtcccacaattgacccttgtgcagcttgagccacaaaatgccactcaaattctgcaccagcattttttttaatgactctgcaagtcatcagggtgcctttctctcagccattggaacaaatttgccatgaggacacttaatgtttactctgaatggcaccaaagccaggcttatttccatgtctgtggcctggtgttagctgagccatatgttcctggcccagatggctctctcagttctagatgattagtaccgcagatccagatcccaagtctgtccatttgcaaagaagaggacagtcatcagacaggcctttcatgttagaagtggccatctgagacaaacaggacattgttccaagccggttaccaccgcatggaatatgtaaggaagatctcttttgagccctgtaattaggtaagcaaggtcactacaaagtcatttaaaattgcatctcaagacagttcgatggcagaggatctaccccctcagtgctgatttattgcttactctcttaactttttaaaaaaagatcagcagattgattgtgccgcctgtggttggaggcgtgcttaccttttctcaggcctgattcataaaacatgactgacctgttttcagcatcctttccctgtgtgcccagggagctcctccgaggttcactgcactaagtgtttggcactgagtgaaaacgatatgtcatgttcacagcagatgacccagcaggggccacggcaatgaagtccccaaaatgacctgttacatctctagctacaagactcagggaaacagagaggcagtttctaatggtctcctggaggaatttggactgatgactaaactttttaggtcacagctttcttgagaaatggcaggtgccccttctgcttctggtgaggtcagtcactggctccagcccccagtaggctctctccagcccacctagtcggtttctcctgcagggggttggttaaccatttgtcctcagaacactatcctcacaaggcacaatttctgagtccttcctatatctggggtatgagccacttggaagtgagaataataagtgaaaccctcaggtgcctccaaggccccaggaaaagcatttctacctttgctgatgctcgttggtccactagcaggcagctgttgttctggccactaaatctcagtgacatcagttcttttctaggtttatttcttcattaatgtttttattttattttattatttttcactgacaaaatggcccctagtcggccagttgatttaacaggtcaggtatgtgctgtgctttgaaacagaggataagaaaaaaaggatgatcattattagagtttcatgcctttctcagatccttattacgcctctgctgcattccacacacataccaatcgtgtatgaatttctgtttattagagaactctccttcacttctcttttcatgctatggcgttcacaggacatcagagccagtggagcttttagaacctagagctgttcccactacactgagctgtacataagattgccctccatgtccagactggggatgtttaatgtggccagtgacatttttccaagtctgtttattacctgctggtgagagttcctgagacagtttgagataaaactttaggagtaattatactttatgaggacataatacccttcaggcttcatttcacgtggtgctaaatcaatactcatattcaattcttttctgtctgccttcaagttaaaggccacaatattaaagtttcctataattagccaagaagttggtgctacagagatggtaaaaattgacttcaaaccctttatctgattgtgcaaaaccaacacaagacaggtggcatattgggtcaccaagttacatcagcaagttccacggaaagcctagatgccaggaaagaaaataaagggagggaagtgttttctaccaactgctgggaaaaataatgccccactgtcatcttcactaccagagtctcatggggctattaaatatctttctgttttcatttccatgatgtttcctaggttgaaattgttctctctagaatgattgcataagccaagatccctaacactagagggcatgggctaactgcgtacctatgcacatcaggctgttgaacaaccaaagcaccttgctctttgagacaatggcatccactgagccactcttggtgatacaagggaccctgggtataaaaaaaggaaagcgactattattttttcttctccttctttcttcttttgttttgtctttcagttataggccaggcttttatttatttattattttatttatttatttagaaaatggggtctcactgtgttgcccaggctgatgtcaaactcctgagcccaagccgttatttatgtttgatttacaagtgtattgggttccttggttgaagggtggctcttatttacatgccctttcttatcattgtctattggctttcaggattgttgctctacttgcgaagggtctttaatagtcttagccacacacaaattcatcttttggcacgtgtatgtgtgtgtgcacatatgtgttttcttagggtcttattgagacatcagcattctcccctgtcttaataactactccaatccataactttctttccacttaaaaccattacgttgtaaacagaattctttatgtgccactgtgtgtggtggagtgtatgtgtgtgtgtgtgtgtgtgagatgcaggtgggtacattcattcatgttgcattatacccataatgtatgaaggtagtaggaaaatggagtggtccagcttattgtccaatgccatgtagtttttggtaaagaaaggaggatcaaacatagcagggtggcagcagcaggagcagcagtataaccagagtgttgagattttttttttctaggaggtacttcttttttttttcaatcaactcatttgaatagattacttaattagcatttattgtttgtaaaattccttgtctagaagtaacattttagggtctgcagttttgaagaaagacaatttaatgggtgataattttgtatagaattttcaaattgatttcttggtagtaaattgttcctcaattgtagtgccttctccacactcattagacagcaagccttctttctaaatgcattcataaccattaaagtgttgtctctagtttcctgtcatttgaaacaggtcataacttcaggcacaaacatttaaaggacaactatactttcacaatttcattagtgttctagcggagtcggaatgtgctattgaagtttatagagctttgcagttcctgatggaaactattcggctctactcatcccaagagtagagataatctttctctttgtacagaaagttgtttcacttcaattccactctgcctgagttttatttatcagcctgatctatggctagaactatatagaagctccctagaacctgtttataattcacctcccctcctctttctccaaaaacaccctgggaatagaacaagctcattgccaaggaaactccctggcagtaaagtactgtttggtcctattttctactggcttctttgacttgttgggagatggtgtttaaatgcattactcaaaaggagctctagaaaatttgaaataaaacaaaaataaaaataaacatattgaaattccctgatatctgcagtggtttgtatgctcttggctttctgggagtatgcagcttatgagcagagctatttcacactttgttgtgaaattcagtggagaaagtgcagtcttaccacgccctctgcctggacattttctagccaaattaggtctacaaagtgatctaattggtctaaccctcttatttttgatcaatgaggaattagatgcttcgctattagaataacaactacaatgttgatcccatttaagaactttttgtatactgagcaagaagcttagaggacattatctcttttaatcctaaattccagttgccaagatgataaagaaaatgagattgtgtccatttctacagatgaagaaataggctcagaaaactcacgtgtcctgacccatatcacacagcagtttactaatagactttgatggacacccaaagatgtttactaaagatgccctttcaaatgaagcttttgactgaagaaaaaatatgcatgctctggtccctcagaacgccttttgtatagatattatacatcctgaagacaacccttcaaagcaaaccttggctccaacaaagctcctttcttctctttgacctaactctccccagttcccaaaatttgtggatttttcaacttgatgctctcctcatactatgttctaaaactcaattcaccttaccccattctttctgattctttcataacccatatagatattctcttcctaaacctttctttggttaatctcactgattccttcattcagaaaagaatacaatactaagtgcctactctgagccaggaactgctcttggggaatatccgtgaaccagaccaacaggctcctgttttatggggctttcagttttgggtggagggattgattattggagaactctgaacttggattcaaaagaccaaggctaaatcagaatgttaaaactggcagatatgggaaatggttatatctaatctggcctgcacagtgtcttaaaaattgaattcattggtagcattttaagatcaagagtttccacatagaaaacaacctggatttctggcatcttagtagtaacctgggcccacatccccatctaaggcatcaatccctgcaggaggagcagttctgtagccttctggtggggcagggtcttttagccacctttgcctcaaccatgccttctcatgcccagccagctacactcatgtacatgatctgttgacctctatagacacttttgcatcccatggagtaaatgatctacaaagtcccttcacagactgacataactgttgttgtctggcttcctgtgcattgctgtggcctcttcccacaggcagcgcctgcccagagctggcagccagacaaagagaatctgcctgaccccagaggaggctccatcattgcaaggcaaactcacagcacagtcagtccctggacagcgaccagctgtcttcaccccagagccacttagaatcaattctaggccttgatgttgaggccccactacttgaaaatttcaagagatttagcacaagtggataaaactaacaaaactagaaaatcagaagttgtctctggtggaagccaaacaaatcagaaatgaataaggagagaactttcgggtaaaagcaaataaaggctgtgtaatatttggaggaataatgctaattattaccagttttaaagttagtttttggtactttgaaaatctttactcaaaatcatcagcaaaagcaccagtaagcactaatattaattgcaggcttattgtgtttgtctatttcatttaacccactgctcccattttgctggtggaaaactgaaaaccaaagagattaagtcatttacccaaggtcatgtaactaatatattgaatctcagatgttttaatgattttgactcatttccaatttgcctggctatatagagaaaatatttgaggaattgacagggaacacacacacacacacacacacacacacacacacacacacacacagagggagggaggggagagagagagacagagacagacagagactgaacagattatttctccactgatgttcattatttagatctattttcaacatttaaaggcaattgtcagcatagtcaattcagccattttaaaccatcaagggccaatgagcaaagtgttttactgaagagtctacatatggaaatcaatgatatcccaaaactgagctggtacataaatctaagaaatgcaggtgtgagattgatgacttgggatttgatccccatagcaaatctgattaaatggtatacattggtttagaaaaacaatgtatcagggaaaatcctactcttaagaaacgttatgctgaattctgtaagatgataaaaaacatgtcacactagaccagaaatattacaaatgttctcagattctccctttctcattttctcatgtttagattagaagtatgggaactcagagggctgaatagaggattgccaggcagttaatgagaattcaaactagatttgaggtcttcctgattcccgggatttactctaccgggcagaagcagaagctgcttaaattctgaaaatagagtcttttaagagtgtgggattcatacggaacctcttctaaacaagttacctctgaaatgtgggacaaaataattctaggtgtgtttgtccaacaggagcctgtgacttgggatttgtgtctgcacatgcatggatctaaggaaccagccactttgacaggtggcctttcatcaggctcatcaatgtcttagtcaatttctggccctcctatcacccctgttctggagctgaagaaaccttgccatggggacaaatgcacttagagagtgagagcagcatagcaaagtgatgaaggggatggacgctagaattggaaccatggctctgccactgactagctattgggcaaccttcctgtgcctcccttatttataaagtggagacaatgatagtacctccttcataggatgaaacaagttaatatatttaaagtgcttagaagagtacctggcacatagtaggtattaggttagggattggtaacttttcaaaatatgagagactttttaataacaacagccagtattttggtccattttatgtgccaggcaccagtacaagaatttggcatatataagtcatttgattttcagaatatacaaggtaatattattacctttattttcagttgagaaaactggagtgtagaaatgttagtaatatgcccaagtcacatagctagtaagtaatggggcctagatttgaaagcaagcaacagtctctggaacccataattttagccactatgctgtaaagaaatgcaaatagccatcgtcattactcttccaaatccaggactgaattcgttcattgcaaatatggtggatctcagagagcctgaggcagaaaatgggcacctatatgcctctcttactactcacagcttaaagtcagtggagttgacgtatgatcaagccaccaaatctcagcatttctttggacaaaagacaaccttttttagtgaaggaaaattcacagcaaccaatctgggtagggattccaggtgattcttgccacctcattctcagtcattctcactagggttgattccacaaccacattataaactcctagtagaccaggccaatataattgctcatctcccatgacacccaagtgtcaataaataccaatgaatgaattgactccatttgtttgttttgcaccctgacaccagtagccctcattgcttagagatttttttccagtagtaaaaatagggattctagagtttcctttggtgcaaagtttgagctctagtgctttttaattactgtgactatcagtggagcagattattttttgataatgaaatcatcatagctgaggctctgtggaagacctttgacttcccatcaagagaagtgtaggataaaatgaaaattgaatgttgtttgttgatgattttctaatcgattgcttgctgttttttggtgattgcgaaacactagaaagtcccaaaggaatcagacatgcatagaaagagaaatgaaggggagaacatgtccctagggtaggtccacagggaagataattgaagatgacagaagacataatgtcacactcagaaagggattttttctggccctaccacacagaaaatgatgaccttgcagtggagagataagactggtaattaaggaggagttattgtgctaaagctggtcttccctttccactggtatttcattctggaaactgaaatgggacattaaataaagaatggtgtctcatttcagggcagagggacttacaaactatcaaaaccaggactgaaaggagccctgagctaatgtgtgttctcgttacagaattctgcctttcagcaaggaaaggtatttagctgggatctgaggattagcataaacttctgatattctacccttcctattttgggggaaaaagtcaaaccttagtagaatttgaaagcttaaaaatatcctgttcaatttgctttggatggcatttgttactattaaaattttaaaaatacagaaaccacatatgatccttgtcttgggagactgcacatcctgttttgtctaggacagtcccagtttatatttgcgatactggtataattattactatctctcaaaatgttgtggtttgagtaataaattatactctgcctatatataacccagcgattcttctgctcagtatctaacctagaaaattactcacacacatgtacaaggaggttactgtagcactgtttataaatcacaacataggaaaccacatgcatgcacactagaagaatggccaaatgaactacagaatattcatgctgagagcatcatctcacagttaaaagactgagatggatccatatgtggtgaaatagacaaatcttctagacatgtcctgaggggaaataaataatctttagaatattgtccaatatgatactgtttaggttactttaaaaatgcaaactagaccaggtgcagtggctcatgcctgtaatcccagcactttgggaggccgaggcgagaggatcacctgagttcaggggtttgagaccagcctgaccagcatggtgaaaccccgtctctactaaaaatacaaaaattaaccaggcgtggtggcaggtaccagtaatcccagctactcgggaggctgaggcaggaggattgcttgaatctgggaggcagttgcagtgagccaagatcataccactgcattccagcccggacgacagagcaagactttgtctcaaaaaaatacaaactaatttaaaagatattttaggggccagatatatgagtatgtaagatgaaaaatggaaagacatttataaaccagtaacaagggttatgttggatagaagtgatgggtttggattcaatatggtggtcaagggtgactttaaccataatatttcagccttttcctaaggacactatgatctttgattgcttgtggaattgatcatttattttaaatgtaatttaaaacttaaaactatgttccagaggtgatgttgctcagttcattgttttgaattgaagtaactgaggccttgagaagctgcataagttttccagggtcacaccatcgatatggggcagaggtggggcccaaatgagtctcctgacacccagtttctttctcactgtctggacaatgctctccttgaaggtttatgaagatttactgcgttgccttccctccatagatggaaataaatggctggacacaaactaattcacactcatcaaattttactccccttaaatccccaactaaaaagtaatggccagtatcattaattgaccccaggctggcagccacctgatttattctctgaagtctaccatctggttttgttttgaccttaattctccagcatgcatttctttgatgtggacattaaactgatcattaatggtttgaagaagtggtaagtgtatggtgagaagggtttccctggcgtatttttgtgacagttatcgtggggtcttttgctttggtttgtgtcattgcctttcctttggtaagcagtgcactcatggcctttcccctggcgattctctgagtccccgcgaaacctgctaatgtgggggcaactggaagcagctaaacccttattcttccctggagtatttgcatattaatagagatcaggacctgaagttaaatttgatgatgctttaaaggtggaaacttagacattaaccagcagattagtattagtggaaaggattttactgtacttatttttgcctttcttatttttctgaaattatgccaagtaactacactttgtgttaatgaacacatactttagtgatacatgttgtccgtgttgttgaatatagaacccagcactttacgtgaattatgtcatttaatccacaacacaactttgtgagataatgattttatctccggtgaatagttaaagaaacaccaagagattggctttttgagatttagcgtctcagggagggtaacaccgtagaagatagagctaggttcaaacccaggcagtccatcttcagagactcagctcctcaccaccatgccatattgctggcaccataataatgattatgcagttattatgatgttcaaaacataattaaacacaataaaatataatattatgtaagatgtaattatatgcaattagaagtgtggatactcatttgcatactttgatttcagaaacaccaaggggaagaaaacaaaatactttctgagagttgttgatagtattccagaaagtaggtggatttggcaaagtttgtaaggtggtttttttcccttcctttttggctcaacagtttgttggctggcactcatacttgggagataaatgcaaaccgagatctcaccattcacaccactcccagaggtcacacatcacttattgaataactgatgggtttggaaagagggcatggctgtaactcagctcaagaattccactgatgtcataaaaggtgatagctcagccccagtggcaggtgatggacagtgtagccatagagagcacatcagctctgtgctcattcccgtctcccgtctctgcagatttaatttatagctggaacttggcccttcctttgggcttacaggaaagcctaagagctgaatggctgagcttatcatgatctatgtggatggctcttcttgtctttctgacctccaccctaggacacctgtatctcctccaagcccagtagtgggcagttgttttcctagagatcagcagctcttattgtcaaaaaatatagttaaacagtttattagatgaactgagattcatattgttaggtcttccctcagtccacgggggcactttcctaattacctttgcaagaatatgttttattcctcagttattttccaattccttctggaaattcttttaaagagtctcaatcccagtgttttgcttccataagggaaaagcacgtagggtgatggtcagtaggaatgaatgcaatgttagcctggaaaagtgtctggatggatagggaaagtactcagaaaattgtgtttgtgtttgtgacttgaactaagtccgtattcctcctgatgtaagattttggattagaatattcaagatcatcacttcctaatattatataggaaatctcataatctatataggaataggaaatctgtataatctttatttgtatttactatgttattgttctttctcagcataggggtcttccagaaaaatcgatgagtctagatttttgaggactgctgtgatattcttttaaagatgaagactgtaatcaagccaaattttcccaaacacattccatggaacactaagcacgtggatcaacagttttgtagtcaaatatttggaaaatgttgcctctttcctcctcttcgtaggaatttgctgtggctctaagcattcctgcatccagtaaagatgtctgtttaactttgtttaacccagtgttttccagtttcacctcatcaaagagcccttacagagctgtggagaggagcacttgggagaagccagttttggagatgggattgcatcccaggagtacattgaaatgattgctttcttgaggattagggcccactgataagaacaggctgtaagcagtgttgtgacagtcttctcccagagctcttaatcgaacttttaagtttctcaattgaatagtgcacaaatacaatattttacccttttactgaaggaacatagtaaataatactgtgatagccccttgacagtagaaagatgatcttttaaaaaaatgctccagagaggttggaggagagaattacttttatctgtgtctatcagaatcccatgtacatcctggtcctgggcaaatattattttaagagcttttccatgactcaaataccttctttctattctgctcatttccttttctttttagccttaatgccattccacatttgagagagaacgttaacataaactgcagtaatgtcagtcatcaatatttgcatagctagggtgcagcttttggaagaagctctccagaaaaaattacagtacagtgtgcacattgcctaaaggtatttattgcttccaaagaatgaattatctcatcttatggaggaaaagatgaaggctcagagaagatgagccctaatttatgcagaacccctgataatattcatctggaataccaagaaataatgttaatacataaaaataatgtaatgtaaatcatgttatgcactgcagcagttagctggaagatctggaactgattcacctggtcagtttagagctttctgaactcccttggtattgtatccagactgggcttgatacatttaattatctaagtaaagtagatcttggccatcacctttgaataataccaacaatgagaaaaataaccgttaatggttgaggatttgcagtttagagaatatcacctacattatctttctaagctggtggagttacctcatttaacagatttatagtgctcagagaggttaagtgatttgtatatggtcacacagcttaatgtatacttgagctggagccagatcctaaccccttgtatctcccttaaattgtgctgtctcattccacagagctcctcaggcaaagctgtttgattggatataacctacattgtttgagtatctgatacattctgggtggttttccaaggggaattctttgaaagggagcttgaaatttgtatgttgaagttagataacctctttatttaacaaacacctgtacagtacagtgtttattgtcattacaggcaagcttctaagcactttgtaaatatcgaattgtgaatttctcttatcggtcccacagacagatataattttaccgtatttcacagatgtggaaactaatatcagaggctaaataattccctgggggacacagagccaccacctcatggaaccaggattgtgcctaggctctcaggctccaaggcctatgctcctcacctctgtgctgggttccttctccttctaaattctctgtttacacaagcatgggactgggtagaaaaactggatggagggtgattcagattgagatgttttcttggtgtaaacatgagatgtctgggtggtaagcttatatgaatggtttttacttttttctttgtactttcatatatttcctaaatttcctacaatatttatgtgttactttcctaataatgaaggggcatacgcagaaaacacattggctctagtataggatttcagcctttatagatgttgatgctgacttattagcaacctatttgttagcagcacatgcgtgcgtgtgcatgcacgtgggcacacacacacacacacacacacacacactctttgcaggggaattttgagccagaaatttatctgtaggcccatattcattcctttttgcacatttctattgtgaccttgggcacgtctctatccctctttgagccactgttttctcatctgataaaagaaggataatattgcttcaaagaaggttaataggactaagtaaggcactgaatatgcatgtattttataagttttaaagtgccttaaaaatgtgagtaactgtgtttaggtaaaaacatatatggcatgtttcttaaagtttctcttctctgttatttgcatagatgttatgcaacttgtgttgtagatagtttgccaaggagaattttatcctgcaggcctcagccagtcagtatatgagctaagatggaagttttgtgggataagcaatctgctgctcccttggagaattctctaaatttgcaagtagaaacattgcggttggcaaaatggagctggattaataacgtttatcattcaggtggaggctttgtgtttgcaaagggcctggtaattggtaattagctgatgccccttgtctcctcctgccaccctcttcctccctgccctgctgtgccccctggaatccagaggcagaggcacctgcatgctcccagtctgcttctccctgcacagtgcctggaaagtcccaggggaccacagccatctgacaagttggtactgggttgagttacaccagccacacacactagctctggccctgagctgggagtaaatgaggtcaggccaagagacatcaagcttcaaacatatattttcaaaataaataggaagtctctgtcctcatactctttccctgtcacctttgctccctaaaagtctaacctctttttagtcagtttcctggtatccaaaggcccattttacttcctccaaccatcctgtcagcaaatcacatttccctgttgtgttttctccagtagaaaggacttttctcatttatttgttcctgagaagaattaggaatctgagaatcttgatgatcttttggctgcttcttgggtagcaatttagactctcactgaacacccatctcatctcttcagagctattcaatcatgctgaagttcatttgaacaaactaagacttcctattagcaaccccatcctgcttaaaaaatggagattcccctctgccattaaagcagatctgagaggctttttttgaaggagggctgaaagttgaataattaacaggacatttcttttccaacccttcttttcttttcttttttcatcaatctgaagtatcctgggacgctctttggcctggcacatgggtaggtaggcatattgtcaaagattgagctgcagtttttcaatttgtgacttccctgataactacttcctctagaagtccccagaaatgaaaatgggagtgtgtgtccaggcacaattgcttctcccagtcttcctggggatgttccaatcttgtcaaccagttttcagttttgtttcagagtattgactcaagtaattaaatcatcaataatattagacttccctttttcctttttaatttttctttctctattattctttttcttcactatccaccccaaccccccattcatctgttctttttatggaaggccaaaaagtgtaatacatggtaaagaggggaaaggggactctgtagtagggagctgaggactagttcagtcaggcagccctagcttagcttcagtttccttatctgtaaagtggagaagtcaaacctgccttgagggcaggtgactgaaaccctgcaggtaagaccctaggacagatgggtcctggtaagagcatcgtcttgttgagaggctgaggtgggcagatcacaaggtcaggcgttaaagaccagcctggccaacatggtgaaaccccatctttactaaaattacaaaaattaactgagcgtggtgttgtgcacctgtaatcccagctacttgggaggctgaggcagaagaatcgcttgaacccaggaggtggagattgcaatgagctaagatcaggccactgaactccagcctgggcgacagagcaagactctgtcttaaaaaaaaaaaaaaaaaaaaaaaaaagcattgtcctggggtgtaatcccagcagctctgccattgattggttgtgtgacctgtgggacttctgtagttcagtttcttcatctgtagaacggagtgacaatagcacctgtcatatagggttgtgtgttgggagcattaaaagagatcatgtaaagtgctttccaggatgccagaccaataatggtgagtccttcatacatattatctattgctgctattatcactgtttctggaatttaacaatttctggttccctggggagaagatgttccctggcagctgggcctgttttaggtcttgtgtttcccgcagagactctagggaaattcttaaaggggctttgtgagtatcatctctgagcataactgtgtgcccaggagctcgcaacacacccctcattccatggcaggatgtcgtcagctctggttagtctctgagtccattgcttagagctgagcttagaaaagagaatttctctcttagagacaagtgggatgctgtgggaaaacatagatctgggaagccagtcaggccaaagggatccaggagtaggagttcctatagtcggcatggatgtggataggtagacgcaggcccagtgcctgacttggggaccacggggaagccactcacctgattgtctctcacctgccacctgcagaccctgctccttacttgctgtttgggaaatattgtcgctttgcataggatggcactgttcttacttttgatgaatgtctgaaaaatgaacttcttatcctctacctttttcaactgccatatacatgctggcattactgttaacaaataggcccttttccctgatcacatgagcctcggattatggtctgcattgatcttctgtgagctcaggtggccatgttcaaagaaagctttgtgaacatgatgactgagaaagatgaatctgggtgccgcatgaggctggaaggtgggggcagtgatgtggcacatcagctcactcaggcaggacagaatagggtttaagcaaagaatgcattagaatgcattatgccatacgtcacccacttaccatggcataggactagagggggcctcaaagattatttaaagaaaaacaaaccaatgcctttaaggcttgtgactctgtaactagaggtgaagtttggctggatgcattcatttagcaactagttacttattgagcttttactgcatctcaggcactgcagtggaaacacaggatgaactagacaatgtccctccctctaggtcttctaaaaaaaagaccagtacatgaaaaataattgtaaattatgatacaaaacaaggagcagaatagggaagaactaaagcttggggcagaaatgaggctggctactttaggtgggatggccaaggataacatctctctgacatttgtgttaagaattaaagccatataaagtgcttcccagggtgccagaccaatatggtatattcttcataaatatgctacatgaagagtgggaagagcaaaagagcagaagagcattccagctggaggagcaaacatttgcaaaagttcaagatgggaagatctcggccctttccaggacttgaaaaaaggcccctggctggagagtcatgagagaagggaagcagcttcagatgaattcggagaggtagaagcagccagatcctctagagccttgtaggccacagtaagggggttgagttgtaatgcaaggcagagttctcaagctctatcatgaatcagaatcacctggagattcaatagagattgctggaccccatccctagagatggggaccttctaataagtttgcatgtggtgccgatgctactgggccagagaccagactttgagaaccactgctgtaaggcagtgagaaccctaacagaaggatgtttcatataattaatttgcaggacttagtaactgatggagtgtagggttaaagagggaaaagaatcaaagataattctaaaggtacagtcctgtgtgatcaggaggtaaaacatataggaaaaattcttgttttttgagacggagtctcgctctgtcgcccaggctggagtgcagtggcacaatcttggctcactgcaagctccgcttcccgagttcatgccattctcctgcctcagcctcccgagtagctgggactacaggcgcccgccaccacgcctggctaattttttgtatttttagtagagatggggtttcactgtgttagccaggatggtctcaatctcctgacctcatgatccacccgtctcggcctcccaaagtgctgggattacaggcatgagacactgctcccggcccgaaaaattctttattcagggctggatgatgagatggtataaccagcaggaatcttccttgggtttcagtaggtgtgggaattaactcacagatccatgtgtgtgtatgcattttttcttaaacaggtggtagagagggtacaaatatcagggagaaagtccacagaagcaggataagatactgtcaacctggggttccttcaggccttcccagccaaacccttccccctgcaactcaggatcagccacctcattgacttgccccacccaaggccaaaccaatattgacagcagcctcaatgcaccagcaggaggggtctacagttattgctgccacaggtcttacaccagatggccctcggtgggccagcctgttcttgcccagtctgttcttgccctgttctgaccagtggcagtgctgccttaccagggatgccctatctccacctgaatgaaccaggtctgggtttgcactgctctgccccagaatgccccgctgttttcacgtagtcaggcaggttccccagccttagttctaccagagccagcctcctcgcttccccatgcatcagtgctgctgagagtgaatccaagttacgggagtaaccttgctgagcaggaggccaaaaccagtgagtgacatgaagcatcgtccatccaaaagagaggccaagaaagcatggaaaggacagtgtcatggaggcctagcaggagacaaacttttaaaagaggcagagagatctaaatacatccaaactgttgaagcgtaaagcattagaaaaaaatatgatttctcaacaagttatgacaccttcatagagaacagttatacaggaatgagtgggtggaagaaaatagcaaccacagcccaataatgcagatctaatgttattaggttaaatactacacaagtaattactcagtgatgaaaattattaattgtgcacatgatgctcactctatgccctgggtgtttctgttcctgcttgaatagtggaataattagcagataactgcgctattaattatgccaaagcttgctttgagatagactaaaaggccaaacatgtaggatgaggaggagctatgtgttctgttcatctttgtgccctgagaagagcagatggaaagcttgaggtcaacctgggcccacagctggccaggtagactgaagttctgtcatgccctgccttgaaagggaaccagagtgcctatgcaggaagcccacgcacatagcacttaggcatagcagggggttaaaggtgttttcaagttcaagtcatgacacatttataagccaaagccccaagggccagtattttccaatctcttcctccaccatccttggccatatggtaaacatttctctttcctttccccattgacaccaacaagttcatctcacatgggtaagactcagacaaatcccatagctttttacacgtagattttccacaaagcgaatcccggcaaacgatatacagaactcctagcttatcttgccatgggatgagataagatggtaagaagtcatcctgtggccaggtgtggtggcttatgcctgtcatcccagcactttggaaggctgaggggggaggattgcttgagcccagtagtttgaaaacagcctgggcaacatgatgaaaccttgtctctaacaacaacaacaacaacaaaattagctgagtgtggtggcacatgcctgtagtccctgctactcggaggctgaggcaggagaatcactcaagcctgggatatggaggtcacagtgagccaagaggggatcactgcactccagcctgggcaacagagtgagaccctgtctcaaaaaaaaaaaaaaaaaaaaagagagagagagaaagaagctatcctgctggagtctgaaagcttgacctagcactttcctatagacccttatatgaggatagaaatcttgttttgtgctccttgttttgtgctccaatatggtagccactagccacacatgcctgttaaacatatgcatattaaacatattaaacattgaaatagggctaatgtgactgaagaatagaactttatttgtttatttatttatttattttgtttatttttgagacagaatcttgctctgtcaccaggctggagtgcagtggcacgatctcagctcactgcaatctctgcctcctgggttccggtgattcccctgcctcagcctcccgagtagctgggactacaggtgcattccaccatgcccagctaattttttgcattttagtagagatgggggtttcaccatgttggctaggatggtctcaatctcctgaccttgtgatccgcctgcctcggcctcccaaagtgctgggattacaggcttgagccaccgcacctggcctaatttaaatttaaataaccacatatgggtgatggttaaagcaggacttcagaagacactctggctttagttctccttatgcactcacgactggggttgtctgggctcgagggacctcagagcctcttagggtaatgtgtgtcctctgggatgacatttcttggacaatttcccttctcctctgaaatgtgagcttcattcatggtaaatgagtaaaaatctgcctggaattacttacaagggtgaagaatgaacatattaacaggctatagataataagaaagtcctttaaaaatgaatgtggtggctgccaaatcaatttgtgcaaaataacggtagacaaggatgagctgcggctgacagggagcaattaagttttgtaattttaccttgaattattaatttcaagaagggttgcttctctcactgcagtctacatcttcgccctttgagagtcgggtggaaggcactgtgggtgagcctccatttccaggttgttgagaaaccatctctcttggtttcttttcttatgctttcagctcttcattgggggttgcacttcattttcttctcacattcacaacaaattagccatacacataaatacaataaaggatacctgtcccaaggaaaagcatcctcatcacatgtcatgggccagtcccttttacaaggtgctcctgcacagccatggcaggtactcatgtgtgtgccagacagaggggagtttctaagctaggaaaagtggatttgtgggaagttgttttcctccaggtaaagataaagtggctttgcttgactggttgactcattggccaaactaatgatgctactaacacccttgatcttaggattaagcattgtctgggatattttgagtcatgaaagttaccttcctacagagcccagctctaggaaaccatcttacaaatacatgtgcatcccaaagacgaccaggagagtgaggaaggcttggctcaacccagcccagttgctgacaaagccatcaaagtacaggtcttacttccaacagtgggtcagtgggaagaacacaaacaccagcgtctctcaaagggcttgccttgatattgccgcctctcggcaattgaacacttctcccgttcgcctgaaccctcagacttctttgaagaaactctttccacctatccaagtgcactaagttcctggcatataaaattagatgtggttattttatgaggtggtatcgttttgtggaaagttgttttggggtgggaggtcagaccaattcgggttttaatttcatttcagttacttattcgctgtttgactttggcaaactgacacaagatctctgagcctgcttccttgtctgtgaaactgggctaatgctgctgtgtgagatggtggtgagggttataagtgaggaaggtgaagttcctagcacagtagctcacatgggagaaggtggctggcactgtgcttccaggagatggaagcacagccaagtggcccagaggacaattcccagctagccccagaaataacaggaatccttcctccagggatcatagccttctgaactgcttccctcctgcctgcccttctctatgttcctctttcttcactgtgggtcagggaaaatatcatgcattcattcactcattcatgtattcaacaaatacctctggagcctgctgcctgccaggaactgctctaggtgctaggaatacagccataagcccaacagagtcctgacctcatgatgcttatattttagtggggagttaggcacagatgcagtaaacaaagaagatacaacatccagtggcgataactgctatatagtgagataaagtggcgtaagagcatatgatggaggtgacagaagcctattaacatcaacggtgagtatctgatttttagcatcacctgcacacacacacagagtaaggagggtgggtccctgagtttacagagccctgttatgaggaaggagcactgagtgagggggacactcactcatatgaagggactgcatggagtgggatctaagaggtaggaagtggttggaactatacccgctgcagagtagttgaggaagaaaaggggaaaaggcaggtaggtgacatgaagtagggagagaatggggaaggaagatggcagctgccatgtggcaagagagagggaggctttggagatctctcagttgatggaacatgcttctgggtgtcctcatggagcctcaggaacaatctgcatgcctcactgatgcttttgccgtcagttttgggttttttagacctgggacgcttgacactgaccacaaggtgagggccaggctggatttgtatgtttgttgttttaagtaatccaaaccttataaacacatgtaaggagaaaacccaaggctctttccctgttccctatattccagtctccagaagtgacttatattagaagggaaatgtgaatcctctctgatcctttcctataaatatacaaacactcacctatgcatagtgtttacaaataaatagtggcttccttgtctttttaaaaaagagatgtgatatcataatttcccagggccaaataaaaaaaaataactacaagaatattctagtaccaatcctgcatcctcaaactgtagcagttctataaaaaagcctatctcttcctcccaccgtcaagcccttctaacttcttagcacactctgcctctgtctgccattctctgcaaagaaatggtttctccggcaggtattggcaggcaaaattatatcattgcctttccacctatcctacagtcgttaagtaagagagatgcccttactcccgaccctctcacctgaaacagggtaaggagaagggtgtagaaactaaataattcaccttttggtgtaccctgaaagagagaggagatgaatgatatgtcaccatggaaatcaggttctgtttactagtagcttcccctacttggagtgcatcaggttagcctgtaggacagtggctgtcagccctggctgcacattgcaatctcctggggctaatcaaatacagataccggtgccccacccctaaggatatgatttcattagtttgtgagatgggctggcatccaaggtccttctaatgtgaaggcaaagattgagagtggctgctatagaagagctctttctggtaaatcagtcattatcctgagcatcaagagtctgcataaataaattcagaactgtgttttgttgttaatattgatactgcattcacctggggaaggaggctgcttatttgcccacttttcagaaacaatgaatctttagtccagctccttcccttttcttccttcgttcggcctccttccttgtgaggagtaacagctgtagaagtcaggggaccttactggccgcactaagagagtacctgtgtgtatcagccttcaagcagttttggggtcagacacccacttctcagacttccaggcagctgccaacctttgccttcccttcttggatttctttcaacatgcagatttatgaggtggggaatgcatgaggggtggctggcgtccagacttactgtaaccagagagaaatgaacagagcgtgctccaggggacatgcagcacttcctgaacaaactactggtgtcgccattaatgctactgacttaggaacctcatgtgcctttttgtctttttcttcactcagcaggaccggcatctattgctaatgttaggtttaagcatttagggcagagcatgccaatcttcccttgatccatactgctcattgatcagtggtcacatttgtagcacacctcatgtctgtgggaggtagctgtggggttgagaactgctgaggcagggggttgagtgttcccaattaggggttggcagtaatcaggtactggggcggggcttatgccacttgctttattgttcacgtaataacagtggacttggattgtgaattccttggaacaagaagagtcccttctactgtatttacccgggaagacttctctgatttcctgggctgatttgcattcccctcctaggtactttggtagttgtccccggagtggatcatagccaataccaccctgtgttgttcccactaatttacctatccgcatgcccgtgaatcacaaaccctcaagggcagggtgtccccagtgcccacaccacactggttttgtagtaagaggtgcatgcacatatgctaggagatggaatgcttatcagcacccacatttcttccagcctaattgtatgcgctacattcacacacacctggatctaaatcctgctctttgcttccaggctgtctgaccttgggcaagatacttccccttgctaagtcttgtctccttcctttctaggatgcagctgatgataggactgaaccgattgggtgctacggagtattaaatgtgatagtatctgccaagggttagcacagggctgctcacgggatcagtgctcagtaaatgctagttatcatgcaatccttattgttagtttcattattatctgtatgataaattgattgtagtgtcatctgcaaataggtaaataaagcattatacattgccaaaacaactttaaccaccttacacttgatatttattctgattaaacaacaatgacctgagaaagtagtatagaaagtgattgtgctatgctggatacaatatcagctagaatgcaaacgttagcagccaacatactgactgcagccatctaagattcttgggaaggcgggaaaattaatagaaagagcactggagagggagtccacgtgggcaggaagctaagcagcagtgaagacagcgtggcaagatttggatagaaggactggccagcactgtggagagccctcttaattggagggagcagctgtgtataaagacagtctgcagagcagcatgccattgccgtttctgagtaaatttgtacactgtttgctgtgagtcactgccaagatcctctcttttgtacattatcagatcaaagctttaactcgaccaaaaaaaggtctcatctcccatgcctgtgtagggaaactgaatctcacttgcgcccttctgctcccatggaaccatcgcagaggcctagaatgccctagctttctttctcttcttgtgtgctaagtcaccaaaatctgacatgctgaactgtcaacttaatggtggagttcgggttgagagctgatttctaaaaccactgccacctctggacagcagccattcggatatcaggtcaaggtttgggagactattaagaagccagcaccaagacatgctggtggagaagtcggagttttatcacgtcctacctactttgcggtgaaatgaaggtcttcatagtgaggtggtgatgaacgttgccgatgcggtgaagtcatccttcatcactgtgctattttgcttagagcttcaactgctacattatgtcttaaaacttgtcaagttgtgcacagtacactgacttcataggagaaaaaacgcgttgtgtaaaaatataaaaaatcagacatttctggtagaacgagacattataactcaaaagtcctacagataaataataattaggaatggcatttactccacagagcaggaagaaaacaacattctctatcagctacatcctcaaatggttacagtttcctgtctctaaccacaactaataaaaggccaggtacacagcctttaggaagttaacataaattttttcttggggaggtggcatggcggtggggggaacaactgtaaagaagtctgtttctgtttcctaagtatttttgccaataaaaacaaaatcgttccccacttgttagaaaatgtaacaaaaccacctgtctgcccttgaggagatggagaacaaaatcaacaatatttgcattttgactacacacagaattaatccatagaagcagaggcatttttgaggcccaagcgtgataacacttccgtgcatggttctacagacaagataatgtccgtgcttcaacgacagagatggggctaggctgcagcaagggcagtgggttcctagggcaaaacattttaggacggttattcctcatcctcaaactctgaacttatctggccattttaggagaggaaactgaggatccaggaagtgaagtgattctcaaaggtatcacagctagtcaatagcagatccagtacccagggagggaaacagctgattataagataatcaaaatgaataaacacatctattctatcctgtgtgtatttcgatgggcatgttggggagaatcattggtgattctcagactcctttttttttttttttttttttatgaattagcagatccttggatttcactggagaaaccagtgtggctactgatccattacagaatctagcattccccagagagcaaaaacctcctcctggggggcgcgctccagcctatatagatttggtgcaccaacactgcactgtcctcatgaataatctctgatcagaggatactaattaagacgtggcaatgcccacttagtaaattagctaaattgacaaaactcaatttaaataacaattttgtctcttgtgatagaattataacgacacccttcacttaatgagccagacacttaataattcaaacatacttacagaaaaatcaaacaaagcttctcaatcccagactgggtttcccaccacctctcctgccactgctttgcaaaaatggtagcttgaacactgtggaggagaggctgggtatttggtgaggagggaggggctgaccagtttctgggcagagtaattggtaggtgactccttcaacaaacttccagccagctgcctgtttttgtaaataaagttttactgcggcacagatatgcttatttctttgtatagttgtccagagctgctttcaaaccaccatcaaaaatttgaggagttgagtagtggtgacagagaccttatggcttgaaaagccttcaacatttattatctggccctttaagaaaaaaatctgaccctttgagaacaagtttgccaacccgtagacttgggctgcaccttggatctatggttccctgggtgtgcaaccttgaatagatacttcccacatccctggcctatgattttcttaagtgtaaaatagggatgatacaaagactatctcctgagactgtgagaattaggtaagatgctgcacgcttatctgtgcttggcacatagtaagtgttcaataaaaggctaatgagattagtaaaagcaatgataataggaacatatattgagtacttatatgttctagactctgtgctcagttctttatctatattaacttgtttaatcccataacaacctatgagggagatataattattttaattttacaaatggataaagagtatttattattattttgtctattcttctaaattctcatttagtaacacttttgcccagtagtaactgctctcctggctggcaagctgctcaagggaaggtcctgagggtcctcattgtccctggaccctagacctaaaggcatggatcattctattggtcactgacaacactgaaatcaaatatttcttctctcacgtgagtggtgggtccctttctccattctgcctttccagcctcccttctttgtctttcacatcctctccaggcctttgcagtgtaacaggaggtggacatcacccccaggtatggccagacagatagtgaaaactcaggccagtaaaaactcagaaatcctgggagccattaagttttgaaagagccacatattcatttattcagtacacatctattgtgtgcctaacatgcaccagccatggaggttatacttgcaagacaaaatgctccctgcctctctaaagcttgcagtctattcaagaaaagtttacagctaccgcacagctgccaccttaaagaaatctttctttttctttcttcttttttttttttttagcacaaaagtaaatgtgttcttcctgggatgtccgtgtccaaacacagtcacacatcacttaaggatggggatatgttaagagaaatgcatcattaggcaattttctcattgtgtgaacatcagagtgtactcacacgaagctagatgagagcctacctactacctaggctataaggtagagcctattgctcctacgctgtaaacctgtatagcatgttactctcccgaatactgtaggcaattagaacacattggtaaatgtaatgtgtttttctaaacatagaaaaagcatgccaaaaatatggtatgaaataaaaaatggtccacctgtacaggacacttgccatgaatggagcttggaagttgctctgagtgaatcagtgagtaagtggtgagtaaatgtgaaggcttaggatggttactgtacactactgtagactatcaacactgtacacttaggctatgctacatttattaaaaatattttttcttcatcagtagaaaattaaccatagcagagtgtaactttacaaacttttcattttttaactttttactcttttgtaataacgcttagcttaaaacacaaatattgtataactgtgcaaaaatattttctttcttcatatccttattctacaagcatttttctttcttttttttcttttctttttttttttgaaatggagtcttgctctgtcgcccaggctggagtacagtggcgtgatctcggctcactgcaagctccgcctcctgggttcacgccattctcctaccttagcctcgggagtagctgggactacaggcatgcaccaccacgccctgctaatttttttgtatttttagtagagacggggtttcaccgcattagccaggatggtcttgatctcctgacctcgtgatccgcccacctcagcctcccaaagtgctgggattacaggcgtgagccactgtgcccggccttttttttttttttaaactttttaagctcttttgttaaaaactaagacacaaacacacacaggagcctaggtctacacagggtcaggaccctccctatcactgtcttccacctccacatctggtctcattgaaggtcttcagggacaataacattcatgaatttgtcacctcctataacaatgccttcttctggaatatgtcctgaaggacctgcctgaggctgttttatagttaatttttattagtagaaggaatacactctagactgtgataaaaaatatgatatagtaaatacataaaccagtaacagtcgtttattattattgtcaattatgtgctgtatgtaattgtgtgtgctgtacttttatatgacgggcagcacagtatgttagtttacaaataggtgagtgatgcattgtgttatgacattaggatgggtgcgatgccactaggaggtaggaatttttcagctccattccgtcattgactgagacgtcattatgcatgtatatatatgttttcatataaaattaatatacttaaagttcttataaggaactcagctctatattaaggtccctaaaaaatataagaaaggtaaaaaaagtcaacctagagttagctccttctctgtgtcaggcactgaataaggtactttgccctcttcagctcattaatttcttaccacaagagttgatcatttcccattttatatgtggaaaaacagagattctgagtgtttaagtgtcttgcttaaggatagttggctatgaagaggcagagtcatctttcagatcttacctccaaaccccaacacctcccattccccagggagttttctcactgtgtcatctagagccctggtgacggctgtgggtggggagaggggtgattagggtcccatggtcccctccgtctattgaagtagcgccttcttccacagttttctgtgtgtgtattctacagatctttagaagggacctgctgctttaacaatgaaggtagaactgtgctgagaagttggtggtctttatggagtgccagctgtgtgccagactctgatcactctcaaccaggggcaattttgtctctcagcagacatttagcagtgtctggaggcatttttgtttttcacaccttgagtattgctattggcatctaatgcaatggtctccaacctttttggcaccagggaccagtttcgtggaagacaatttttccacagaccgggaggaggattcaagcacattacatttattgtgcactttatttctattagtattatattttaatttataatgaaataattatacaactcaccttaatgtagaatcaatgggaaccctgagcttgtttttctgcaactagacagtcccctctgagggtgatgggaaacagtgacagatcattaggcattagattctcataaggagcacgcaacttagatccctcacatgcacagttcacaatagggtttgtgcttctgtgagaatctaatcccaccactgatctgacaggagggggagctcaggcagtaatgtgagtgatggggagcagctgtaaatacagataaagcttcacccactcacctgccactcacttcctgctgtgcagctcggttcctacctggccacagactggtaccagttcatggtccaggtgttggggaccccagatctagtgggtaaggccaggaatgctgctgctaatcatacagtgagcaagaattgtctaatagaatgccgatagtgccatggctgagagaccctgttccatactaattcttagataaacagaggtgagaaaaacagacagaaagcctgccctcatgaagtgtgcttcagtggggtaggcagatattaatccagtcacccacgctgagtctttaatctcacaaactgaagccgcgccccgaagggaaagcacagggtgtcgggagagcagataacaaggatcccttgtctgtgagctccagaaaggtgctttttaaatttatttatttattgttattattattttttgatgtggagttttgctcttgttgcccaggctggaatgcaatggataatctcggctcactacaacctctgcctcctgggttcaagcaattctcctgtctcagccgcccaagtagctgggattacaggcctgtgcccccaggcccagctaattttgtatttttagtagagactgagttggtcaggctggttagagaggcttctgtctgaaggcagagggcaggtggagtgggagtggtgtaggcacaggttactgcaggtgcaaaggccccatggaaccagggcaagtgtctgttggaaggcctgtgggctagaaaggagagtgcaagaggtgggctgcacagtgatggaaagaagaaccaaatctggcagaactttggccatcttaaggaatctggacttgattaaactaagagctgtggggaccgtgacggctcctccagcagggtatggcatgattttattggaactggaaaagatcacgctgactgttatgtggaaaacaaactggatggagcaagagtggccctagggaaccagcagacatcgaataccacacgctttcttgcattgcagggatgggacaggggcattcccctccagaatagaaccccacttccctggggctgccaattttggtttgcgttaacagcagggtcacgctgcatcaggaactctgtcacctataaatgtcaagtcccatcctttctcccaatttaaaaaacacacaccattcagaagtaaaactgtattatatcatttcagtttcacatctgttctgtagttgcaaaataacaattccactgctgtcgttagcctgaacgaaaacagttcgacatgagaaggatgtgggcctgtctctaatttcttttttctttattgaccttttccaaggtatcaggaagcagattctctcattaagatgttgacacctgagaaagtctgtagcatatcttatttatggcagtgtgtgtatgggtgatggagaagggagtttaaaaatcaactgtcaaggcaataaaaatattatcttccttggtctattctctctctgcaatgacttctgacttctctgaatcatgaagtggatccatgcctctcccatggtctaattaacttagagggagactgggtaggaggagaaatatgtaaagatgcccagaaacacaagtttgtggagctgacacaattcatttctgattagcaacagttcatgcactcgtccatgagccacacagatgttcaagtgggttgtcttgaggtattgggaaattatcataaatttgaactcatttgcaaggatctatttccatattttacagaaaattgtaattttccctcccaagttccctccattgtgaggaggaggaatttttcaccaagatggtgctggctctgctggaagcagctcttatgagttgaggatgcagggcggtctggagttggccttggccctgcaagcagtacagagaaatagaggacacagctcctgccctccacattggtcggagagaccacgagggttcaggaaacagagatcaccaactagcctgctcaaaggttaactgtcaggaacctcagtctttgttgcttccaaggcttggtctgaactcttcctttcagccttgaccactgtgtgtgctcgcctctgaactcagattttcttactcagctgaaataaagaatgacaataatcccttcacaatgtcattaggattaaatgagagactctatgtaaaacacctggcaaatcgtatgcgtgggacaaacatggttgttgatatcaatagctaaaaaagaggaataagtataggaatgtgttgggctgggctggaggaacctgcaggtctttggaacgctctgcagcttctctattccattcaatggaaatatcattgagttttccccacacccaggccatcaatgtctctgcttcctaaagtacccgtgtgaagttgagtttcagctttggagcatgcttcaggaatttgaattggatgaataggttttaaaatattcattggtacatttcctttgaagaaaacccaggattctgggttggatttatcttgaggaataagcagtagctgtctaaaggttgatcccaccctgagatccaggccctgtggacaggcaatacttaggtcctggacctgtggcccgcgggccatattctacacaggaatatggcccagacttttaaaaaatgtgaatcctttctaacatttaaactctaggagttttcacataaaaagattttagggcctctcttgagaaaacagaaggtcccacattcccatacaagtccatcccacgttgatggagagttgccgttttcacaagattacacatgctatttggttaccctcacctcctggcttgtctattatattaatttatctgcctggcctcatcaggcattagagtttgcagatctgggggcagtggttctcaaggtgtggtcctgggatcagtggaatcagcatcacctgggagcttgttagaaatgcacattctcaggcccttcccaggcctactgattcagaacagttgacggtagggtccagggacctgtgttttagccagcccccaaggtgactctgacgctcattaagtttgagaatccttaccccatggtaagggatgagcactggaaaatgaagggaactgcttctaatgtcatctttgccacttaattcagtgggaaaatttagaaaagccactttgctttcttattgtctctgtaaagtggtaagagtgggctaatagcatggtgtgactctataattctccaggtctgtggactaagaattagtatttataaagtgctgaccatgtgccaggaccggggtaagcactttacctggattatgtcatttaacactaaccatggctccctttgaggactgattttatggatggagaaattgaggctcaggggcgtgagctgccacaccaaaggccctgcctttgagtgccctggatttatgtaactgagagctggtgagccccaactccctgatattctatttcctgtgacctgcccatgcacagaggtgtctgaaaggtgatgacggcagtgtggccggcacctcagaacaaagctggcaggtccttcaaggcaggcagaggcatgttctaccaaacaggaaggattatcaaaaatagaacgtggcagccgtggccttctccagccccagttgcaaggagccagccgtgactctggagagatgctgaaggaggcaggagatttggaaagggagggagggagagcagccaggcctgtgcagtgaataccagggaggctttgaaactcccccgtcctcagtggaatcccagccatcccttatggagtgaccttgggagagcattttaatacctctgtgccttggtttcctcatctgagaaatggggacaatccccacttcacaatgattgggagcaaacaggttaatgaaaagcatctgggatgctgtaaacagctgaacatgtggtggctctcaccagtgctaggaaccttgcttgccctttctggagagctctagaagcaccttgtgctgttgtctgtgatgatcggaaagctgaacggtttctgaccatgggaacagccttcctcctccatctgccttgtgggctccagttgctcagaatgcttcattttccagacatcttgtttccttgccctgtctcttgtctgctacatgttctaacttctttctcccttcagaaatcctctctggggtctatccaacctgagaatggctggcaaatacctctaggaggatttaaatcctgactacaacttcagaggtgtcttcttagcatgaccaggacaaaagagcattcacagggaccctcaattctcagattagggaaccgactgtggtttcattttctttctcttggccccagaagaatcctctgacatggttaaaaaggtgtgggttaaaagcagacaggctggttgtgctgcagctgtatgagcttgggaaagtcatgcaacctctccaggactgtgttatcattcatacaacgggtcaataataccatactaacgccttagcaggcatataccgagtggtagttctcttctctcctctagttagaagacatatataattttgggcagagagctcaaggggagagactggaacaaatttgaactctttgggtctcagagtgaaaaatcagtgagaataaactcaacagaaatgctaacaagtgttattaattgagctgttacttcgtgcctggcacagtgccaaacactttgtatgtgttgtctcatgcaatcttcccaggcgttcttttttaattagggagatagtattgtgctcatttcgaaggtgagaaaatcagggctcagagaagtgaagtctgttgcccagagctcacagctactaactggctgagctgcatctgcagtggcctcttcacacgggtactaggaaggagtagaacggaggctggatgtgctcctcccgcttaaaaatcattctttcagcctgcagaacacttgcctctggttctctcggcccccaaggcttttcttcagcagccagcacctctggcttttgcttattgtttggattcgcccacggcctccgtcctttgtgcagcctgatttttcttgactcgtccttatttgcataagagtctcccagaatattgatgtggctcttttccagaaaagcgagcatcccccacactgctggctccaggaagccacatgagcaggccaggcaggctccagccctggtgcaacaccccggtgccatcccctcctccctgcttccttgcatccattcacagaccatcagctgagcaaagctcctcagagccaaagctgtgtttacccaggaagccccagttcactctggcaggccatctcagcacagcaaatatgaggaaggagtgatctaacagtctccctgcccttgacagaggaggggcctcaagctcccagtcacttgaagagaaggccaagcctccagccctgtaggattattctggactgccacagtgaagaaagcagtgttccagccccccacatccagcccagccaggggtatccggaggcaggcatctgagggaagtggtgtgtttgctctctaactgggcgactgagggggacgagtcacaggaagtccaagaaggctcttccaggagctacctttatgtttcttcatgtgtgttcttagctggttttcatattgggaggaaagggcaggagtgttttggaaattgatctttaccccagctcctgtgttgggcattaggtgggcagaattccagcaaaacactgcaaagaactgggggatctggcatagtcactcatccattcattcattcattcattcattcactttttcattccaccagtctactgaggactcattgtgtatcagccactgtttcaaggaataagataggccagttcctagtctcctggagctacgttctaatggggtggggacagacaataaacaaacctaatagaaaaataatttcacacagcgataggcaatctgaaagtcacacagtaggatcctgtcattgagagtgacgtggggctgagggagactacttgaaactgggtgggcagtgacatggaaagggcctttaggctggacctgaatatcgagatggagccagctatgcaaagatctggggagacagtgttccaggcagagggaagagcgtgggcaaggccctgagtcaggatggagttttgccatatgggaggaatggaatgaaggccagggggtttggagaggagcgctgagtatacccatgctggagtgagtttacaatgtatctggaactgttctcaatgcctaacctgcaacatacgtttatctttacacaacactatgactccctgttaccattttggaaacttaagttcaaagagattgtgcaaacttccaaggtcacacacttaatcagtgatagagctgtgatatgaactcaagcagtctgataggggaagctgtactcttaacctgtacattatacagtcactgcaaactcacttgaatgtattaacaaaatgttccaagattgtgaagaggagatgggtcttggaataggacagaacattttccaaggggaatgaggagggacctggcatttgttgatggtgcctaggctgagtgccaggcactgggctgcatgctttctcatccattattctgatcccaaccctccaaggtagacttcattagccctgttttacagatggtgaaagcacaggctcagagaggtgaagcttcctgcccagggccacgcaactaatatcagattgaccgagtgagggttcagggcatctgccctggcatctgggcctttctgaccctccacattaagctgatgcttttttgtctcattatttcttattcctctccctccaaaaatgaaaatgaatatccccaaaaatgtaaaaatcttaacagtaagtgcaaacctgctttagggtgaagggaatggcgggctgtcagcatgcatgtattgttcttcaaattacctgttacctagaggggaggagcaggaccagatccttcactgtcatggtgcctgctgggtgagcatgagcatacataaatacatacagcataaatacctacagcatacatggtgcctgctgggtgagcatgagcatacaggcattccataaataaaaagtaaatgtcacaccgtgcagtgccgctgcgttctgcaaagcttcacccaggggtccttgcaattgccagaagcagggtcaggatttgtcattcttattcctctcaggcctttcctctggggctgatcctaccttcaggagacccagagagctcatcttgtaaggcaccgagagaagagccaggccaccattcggtacacaccctcttcacttctaagcttaaattctaggtgtgaaaatttcatccaacctcttctcttcattcattcacttgacaaatagttatttgtctgctgtgacctaggctctgaagatactgtggggaacagtgcagatgaaggccctgctctcacagagcttatattttagtagagggattcagaacgttttttaaaaaaaggtaaacaaatacacataagtgttatgaaaaagataaaacacagtaatgacagaaagagatgggtagggggagaatgattatttgcacctttctctgttttttcatacccattcatccatccctccctttctctgtccactcattcattcatccatcccctacatctctctctctctctatctgtatatctgactatcatctacctacacacacatagaaacacatatacatttatagattttcatagatctctctttatccctccctccttcccttctctcctttcttattccttccttccacaattaatttttttttttttttttagagacagggtcttgctctgttccccaggctggagtgcagtggtgtgattatggctcactgcagtctggaacttatggactaagcgattctcccacctcagcctcccaaccagctgggattatagatgtgtgccactacacctggctcacaactactttctgacacccactcagggccagttcctcaggatggtttgtctcttttttttttcttcagctccccagtgactggcacctggtcattcgtccctgcctcctcagtagtgaacatactgtttggcataagggcaagcataacaagcatttgtgaaattatcaaattacaagaatatcctatacttttttatatgcatccagttacaaaggtgcaatagaagcctctgcatgtcctcccaaccttagaatcaccacgttccctgatatgaaggatgattattaaaggaaaagcagagcatgtggataaaagtgtatagccctgtattcgaatttccttggcatctttttgaatattcatgcaaaagtcgaagactgttccatttatgaatcagtttcctgattatcaattcaactccacaagcatttgctgcacgactactatgtgcagaatgtggtagggatccattgaagatacaatccttgccctcctgttctttacttcccaggagggagatcataataatgtggacagaactgtaaatagaggcacctgggaagcctcatggaggcccatgagaggagagatcccattccatgttcctggggctgcctgaagggatggcttttgagatttttcttgaaggagatagcccattagcccagtttggctgaagggaagaaggaatcaatgaaaagtgagaaataacttgtaaaagtagctggagcctggaactccatactgaatggagactgaatttggaggcgttggtacccagaggcgggggagcacagcagctttttaatggtgggggtgatgtgaaatggaatgccatgatcaggttagaatttgatttctttgggctgtggctcacagagtaaatagcatgttcaatgtgatctttaaaataaattacagagatcaaaagggaacagagtaggagagtttctgagtgtacacagaggtgtagcatttcagattcatttaattaaaggagccaactgagaaggttgtcaccctgtcatttaagaatttttgatagaagagccagaggtttcatttttgaagtggcaaatgcaaatagactcttcaccatacatacgtgctcatatcagttagtaactcttctttctcgattttcttttatagttaatactggcttagattatcctctggcaggattcacatttaccagaaaaacacaacctcgcaatgaaggagggttctgcgtttgaggggatcacagatgcttcccactgagggatccagtgccatctcttctgaagcatgttcaagcccatctggcaccattctcagtagatggtggtggcctttctctccctctttctgttctactatcatgagatgagacaggagccatcgtggaaggtggttggaagcttggtcactggagccagcctgtcagattcaaaccccagctctagctccatgcccctagagaaagttattaacctttctgagcctcactttcctcataagagaacaagcagaccttcctcatagggttgttttaggattaagagcattgatatatgcaaagcgcttagtgtctagcatttactaagcactcaaaaaacagtagtattatctcagcataacagtctttttggactttcaaacaacagaagctttctcaagacaaacctaggtaaacagaagtggagatcactgtgtgaaccagggttgagaggcttgagttttgggccacacaacatggcccctctcttgtagcaaagaagtcattctctgggggttgtgtcagtttctcttttggttttagttcttgcacctggatcatgctacagattttctatgtgacaggaggcctcaggtgtactcttttcccctatgaagtattttgtccaatgttgtgttcctctgggaattttgtcgttattcctggtaacagccacattctttcacagcatcatttgatctcttaagattcgggtgtatcaggaccagattctgtccccagctctatgtgatgaaccaccagcttcagcagcctcctctcacagtctgggctgcaggttcttactgaggctgagccaaacactggcagcccacggggcagatgtggcctgtgatgttttgactggtcttcatgatgttggctcactcaaaattataaaattaatttgaatttgatgagactatataaaattgggcggttgaatgtaaacatttagatttccagctgctccgaagtcagattagccagcgtcaccggtcctgcattcccacaccacagtgattggctggagctgatgagacctgcctgccttatctgggacacggtccccaccaaccctttccctccctggctgctctgtcattctcactcttgcagggatagagtcagggcaagagaaaaggggaatggttcttatactcattcctttatcaaatgtgggaagactttgggctttaccttccctagtgtggacagtctcagggattctcccagcttatcttctttggtcctcttgtttgtttcacggacattccttctgatgctgcatatgtggccccagacagaggattcttaatgcttccaaataacacaacacatggtggagtcagggcttgaatccagatcttctggataccattgcagaagatatctgccccttccccacatagtcttctggcttagaaattcttggctaattcactcagagcctgctgtgtgctgcctgctccattctggaggttcagagttggaagacatggacacctgccttggatcacaccctgatcagaccagtgcacccattcattcaacagatagttatcaatagaaatcaaatgtttggatattgagaatagcattatgatgagggtccagagtatgttattaataataatggtataattttgagcttctgttatatacacaaacatatgtatagctacaccaaggattgtgctcaagttttgacttatattagcttgtttaagcctcttccacacactatttaaggcaggtactattattatcatcattttatggatgacaaaactgagaagctgaaaatttaggaaacttgcccaagatcacacagccaagaagcagacaccagaaccagagccccaggctcacaaacttcactaccttgactcctaggctctatgttattctgaccatctctcagccaggaagtcactcccttttatacaaatgacattgttggtgctgatggttaaatatttctattctcacaacatgtgaaagagagatccttgtgatttgttacctaagccccaagggtttctcctaccatttcagagagatagaagcttttctttgcccctgaactgtgactaagaaaacagaaaggaggaaaaagccatcagaagactaaaaatctctcatctttgcaaataagaattcactctaaccgagcttttttgcatgcagcactgggaagagacctgttttttattctatcaactcgtccgtataacaatttattgagaacttgttgtgtacctgatgcactgctggcattgggtatgtaaaaatcaatgcagcatggtcctttctccaagtaactcaatctcctgcttggttctctttcctggatcattttaattatggctcccctttaagtaaaggacaaacagagaagtagcactgagtcagatttttgccgctggtcttatgcaggtgacctgtttttcttaatgctccccacacatgggatctgagccagctgagcccagaaacctcccaggctgagaaggtagtgtggcacttcagcacatgagactgtacaggagtcaatacaactgacatgttagccacagaatccctgctaagagctctggaatagaagggatgcacagcaccccacctgcttttcctaatcccgtggatatcatgctccagccagccttgcccctggaatggagacatctcaggtaggggttgtcattgttccaagcttcgtttgatgccgtttcaatccagggtacagagttgccacatggagagtgaagccaccagaatacataagtgagaaatgaatggaaagatggacagatacctagatagatacataaatactttgcagaagtctgggacagtggaacataggaagagagcctcagatagggagaaaacagtaggttgattgtggtaaagggaaggcttcactttgttattcaatatacttatttattgaattgtttaaacaatatgtatatctttctaattaaaagagaatttggggccaggcacggtggctcatacctgtaatcccagcactttgggaggctgaggtgggcggatcacaaggtcaggagttcaagaccagcctggccaacatggcgaaaccctgtctctactaaaaatacaaaaaattagctgggtgtggctgggtgtggtggtgggtgcctgtaatcccagctactcaggaggctgaggcaggagaatcacttgaacccaggaggcggaggttgcagtaagccgagattacaccattatactccagcctgggtgacagagcaagactctatctcaaaaaaaaaaaaaaaagagagagagagagtttgggctttagaataagactggagtgtgagtcagtcctagcttcctctatttctgagagttatgtgactgtgggcaaattgtttcagatctctaaacccgcaattcccttgtttatgaaatggaggtcttggggattgaatgagattaagtcctgtataaaatgctgatggagctgtcaataacatcagctttgcattattattatttgcattattaatagcattagacgaggctgagagtcagctacagaggagacctctgtgggcagaagagttcacagaggaggtagcaagtagtggtagagccagcaaggaatgggttccatttaatgcagcataaagtgaactcctcattagggacatgcacctccctcccttctcaacctgccagcacttgttttctcctcgggagacacctgggatggcaagcattgtatatggtaaggtggctaagagcatgagccctggcaccattggttttccattctagctgtgccacttacttgttccgagttagtttcctcatcagtagaataggaatggtaattgtaactacctcaagaattgtctcaccaattaagtgagttaatgcatggcaaaggcttcacaagaggctggcacagagtaagtgatttataaatatgagtgcatattctatactctggttctagagcaatcctaagactttcaaagaccctgaacactcttccttttggagatttcaccccacattttatcaaacatactgaaagtcacccacatttcacattaattattattgttattatttgctgtagtatgtttaaaagaggttttaatgattttgcttttagaagtgtttggctgtgactaactcatggctatgaagccttagcaatcgctggacatttttgaaaatcctttcgaagtgagtgattctaaggaataaattgtttttaagtgtaataaaatttttatgaacatcaaacttaacaattaatgatgtttatataacattccattatgtagacatttaattaagcttttatctattttgatttttcagttttatctttttgtattttgaagccccaaaaaatgtgttttcagacctcaggtaaggcaatagatgaaggcagtcaggcagggaccagaaagacctcttggccacccccctgaagctgtggttcagcagaatcaggcagagcctgggtgcagaagggacccataagcttatccatccctgttcttctattttatgaaagggataactcaggtccaaggaggggagtgacttgcccagaatatagtgcagtttggttctccaaatgcagaatcctgggccctttcaaacttgttgttgttgttgtttgtttatttgtttttacatgttccaagatgattttcaaggagtggctctcaaaacccaggggagtgacctcatgagaggtcaacgcagctgatgctgggaaggctcatacaggtccacccaggctgcaagtgtgtgtaacccaatgaccaaatcaacagtgacttgaacccacagccaggggagcgtgggtgaaatatgagcagacgttttcaccagctgttaaaacctagcaggggcattaggaatcaatcgcagactgtgcctcctgtgacttggcaaacctccatgaggaaggctcaagggattggaagagcagtcacaggtctccaccagccaagagcaaacctgagcagagctaagcacttttgtgccctctgaagcaaggcaaccccataaccttgcagagattcaggaatgatggaagctgaggagctacatggccatgtcaggaggatgacgagatcgccaggcagctgccatcaagttagggttcagagtggtcctgcaggagaaggggagatgcccctgcccgggaccacacaggacagaagggcatctggacagtgccaggccatgttcagaaagtgaagtgcctttcccataggaaggttctgggcccaaacacttactgagcacctactgtgtagctggcatattcaataagtgttaaaggaagggagagagagagagagactgggagggaagaaaggaggaggatgcgcccctggacagtacgtgctgtcactctgagtctcctccaaggccagtttgcggcttctaccttacatctttatacctttgaattggatgaaatgtattttctcttggtcattagggcactgatgcaaaatttcagtatgaccttgttggttctttccacctggtccttaaggttctgaggaccgtgtatgaagcagtatcatgcaggagaagaaggcaggcaaacctggttttgaattccagcctagccactatatagctgtggaattacagagacattctttaacctctctgaaactgagtttcttcatctgtgtaatgggcactaagaaatcctgcctcccagggctttagcaaagtaccaacacagtccctgctacatagcagaggctccatcgattcagttccttttcatgtctcatggtcaaggtggccttgcctgaaactaagacatggctcattgtactgctcaagtcagaacaagccaagtgtgctttgggcaactaatgtgcctaagcctgggtcatgagagtcctaaaaaggaacagggtgtggctctggagctcagggaaacaaagagtcaaatgtgggggagacatagatttgaaaaaaaaaaaaaagagcccaggcttggggtctggagtctgggttatcttcctggctttgccacaaatttgctgtgtccttgattaagtcacagcagttctctgaatctcagtttcctcttctgtcctgcaagggcaaaacttgatggtctctaagattcatcctggttgagcaagtgctaagctgcatagcacaaatttcagatgcttctttaagtgtgtgcaagaagaacattctcagagatagttggagtgcctgggagcggctagaaaaaattagggaaatgatgccaagatttagccacaagtgatactactaacttaagaggctgctcctgatctcatgggggtcttaaattcttccctccagtccctctctcgtgggttgtattagaaagattactgcagcgactttaagcacaacaggttggattcagattagatttaaggagggacttccaaacaaatgcttttgaagacatgagcttgtaagtgaacagagagaaaggtatcatctaccttttagaagccttaagatgctgggcacaggtatattttgcattcctgaaaagctatctgctaagaaaatacattgactcaatcttgcttaaaatgcattggagtgttcactatttaaagtcatggggatgcccttaaattcacctgtttataaatacaagctttgttaaaccaggttcttaaagtgaagtttccctagctggatctctctcacaaaaagttcaaatgtaatctttctcagaggcagaaaaataaattcattttcaaggttcctttcagacctatgggtccaggaatgcatcaaatataaggaaaatgtgtaggatgtttctgtattggccaacatgcctggtttctgtccctggagggcctgcagagccagcactgtcttccttgagtatgtctcaatcatgaacaccaggcaaaaccacaggagcaatacaatggtatcattgttctggagagtttattctggggcttactagatgttgagtagaatttggaatcccatttgacttccatttactctgcactttgtactttgcagtaataagactgtcagtgccatgagggcagggactatgtgtgatttgcttctcattgcctggtatggaatgggtactcaataaataatggtgaataaatgaatgaatgaattaattaaaatggacacatcaattctagttgactttctggcctttagccagggacttaactgctctgagccccagtttctgcatccatagcatggggatagtaagagttcctactttgtaggattgtcatcagaattcaatgagacaaaatagacaaagtacttagcacattgtttagaacgtaataggcactcaaccaatgttagcttagtactactttttctgtgtaaaactatgttgtcctttccacagccctgtaaggagaagtataccattcccactgaacagatgagaaaactgaggctcagaggtgtcaggtgactgctccaggtcacaggtgggactgggactccttggtctgcctctttctactgctaaacagtctggtgaaatcacagaaagactcattcctggtaatgagacactagaggcaatgcgcgaggaagcctcaggaatatttggaaacccttctgagtttttcagctccccagagtaccctggctttgtggggtgaagtcctttgattgtctcaggttcctggtctgttcatgaccctgttagcccaaaagctggtagagctccatgtactgctactgttctttgtctccctgactctcccctgctccccacctgcattgccttaggcatttattatttccttaaacatgcctatttgcagagacacactgagctaagcagcaaaagtggaggtttccagtgggaagtccactgcgagggagtagggcgtcaggagaggtcctaccagctcaccttgactgagatgctcatatgctgtgcttttgaaaatgcaagcagtgcaagaacatttaaaattcacccaggggatacgttccctgtgtggaaccaagcaaacatgagtgcaagtgtgaaacatgacgtccacatgcacatagaaggacaaaacacagtctttgtcaacttgattatctaccctgtggtgagaaatgagggcctggctaaatggaacacagataatctggaaactttgttttgcaaaaaaaaaaggcacctaccccatttatactttactgcactgttattaataagaagcttatgaatctattagatatggtctttgccttccttctccattctaagcttgggtttctggggacagtgaaaagccccaaaggtgggaaaagcaagaggagggcaaacagaaaatctgcaaactccatcatccgaataacagggctgatggtttagaatgttctgcttgaaaagctggtgtgcatatttaaattacagctttccatacacagaaagggcagctgttaccattagcccagccccctttccgtcttactattaaaatagaggacaaaaggggtgctttcttttcctgggtttctttttttttggtataaatttacaaaatgtggtttaaatattgattgtataggaacaatgtcacattttaagattgagtgttaggcgtggagctctcttgaagatggttaagtatgtattaaggccaggaaaaaagctggtgtgcagcaatgcccagcaatagagggcattcaggcaggaggggctgtcattcatcagctacccagtcaccctcataattggttcagggcaaaggggtctcaccttttcatgcttctctgttttgccaaaaatacttaagagagtgggggaaaaacctagtacgctttgtgtctctcaaagacaatgtgttttatcagcattagcaactcatagttggctaaggaatgaggcaggttcctagaatccaaatcaaacagctcccgttagtaaactactaacttataaagtatttaagcctaggactgggcagaaacaacatatgaaaatgtaggtagcattgcagaatattctgatgagtagaaatcatgtataaaaagcacaaactggctgggcatggtggctcatgcctgtaatcccagcactttgggaggccgaggggggcggatcatgaggtcaggacattgagaccatcctggctaacatggtgaaaccctgtctgtactaaaaatacaaaaaaaatagctgggcgtggtggtgcacgcctgcagtcccagctacttgggaggctgaggcaggagaatcgcttgaacctgagatcacaccactgcactccagcctgggtgacagagagagactccgtctcaaaagaaaaaaaaaaaaggaacaaactattcccaacaactctaggggagtccagaagatcattctgcagaagtagaactggtgtgatggcttgatgttaccaaaaagaagtttatggttcaacataaggaagaactttctaacaattctaatagtccacagggtgatggaatttctgattaggtagagatttctctctctttggaatcttgcaagcagaggtcactgaatcttttattgggaatgcttcacagaggatcatgcataaaggtaagtgttggactaaaggactttagggagtccgtccagttctcaggtctccaactgtgtgttacttggccttgactagatattttactaacaggtgccatcctagttattccacatccttagagtcatcgtagatctagagagatctagaagtagttctgtggaaaccaggtagaatgctcagagggcaaaataggaaatacaacaataggatggaaaagaggtttggccaggaaaagaggaaacagaagcacttcagagagctgagcctgcaatatttggaaggggtgcaaacagcttgtttggtttctgttgaggtccagataagagtaaataggttaaattaaattcgaccatgtaaagctagatcatcagaggcagagtgtcggatctcaggctatcagtccctcaaagaactgcctttattgaaggtggatgagggaacggtcaggttgaggagcattttatgcttttgtgaaactgatgaaggcaaggtctaccctgcctctctgagttcttttataagtacccatgataaatttccaccagtgtatagttccagaggaggaaataatgtagttcctacagaaagctgtgtatgccttccatgtcaaaagataaaacctctgtacatgggtatctttgtttttcttagctgttagagaattcagagacagatccttgggtatttacatctgctcatttatggtgcctgaaaggtgctatttctggttcttgtagcagatgaactcatttcaggccattgataatattaatatgtcttgtttttcagcctgccattcatctcacatcttttgggaagtgagtaggctcaaatctcatatactcaagatgaaatggaataaaaaggaaaattattgattagaaagaaacatgaggttctaagataggttttcaaggtggattggaggatttctatcacttaaaatgaccaataatggagggccagccatttgactcaatattcttggccatcattagtcacctgtacttgtgtggtaatattcgggtctctatattgttgtcccctcctcccacaatccatggttttactttccatggtttgttacttgcagttaattgtggtccaaaaatattaaatggaaaatccacagataaataattcataagttttaaattgtgttctgttctgagtcatgtgatgaaatcctactctctttgcctaggatgtgaatcatccctttgtccagtatattcacactgtacaggtatgcatgcataggaaaaaatcatagtatatatagggttcagtataggctatgaactgaatatatatactagggttcatagtatatataggttcactatccatggagtcttggaacatatccctgaggactaagaaagacgactgtaactatcatggtaaacaccccagtatattgcatgagtgagtgatggtagtgagacactgtttaggtcaacctgttgcccatttgcaatttcatgcatgtagggagatcagtcatatgtcctacaattgtcattggccatagatgagggggcataaatgggtagccccccaagggcaattaatggatcatcatcatctctaacatttccacacctaggataaatgctgtcagagttctggtatctgtgaaggtttgtggaattaaattaagatgaatggaatataattgaagtgacttgaactacactgaacagaattaaattgaattgcctagtcttgccttgcatcaggggaatgtattacctttgcctgctaatcaactctaacaacagtgcaagaataagtatagcatgctgagcataatgtttgaaatttaaacgtgttcattttaaaactattgactgtgcaccttttacattcaggcactgtgttggatgctgggaaaacatggtggactaagcagacatttctctgcctcaaggagctccacctaggaaaggagacaagcactaaacaagtcttgaataaataaatatctaattaaaattgtgacaagtgctaagaaggacaagtataaagttttttaagaagaatagaagccaggccgggtgcagtggctcacgcccgtaatcccagcactttgggaggccgaggtgggcagattactagaagttaggagttcaagaccagcctggccaacatggtgaaaccccatctctactaaaaatacaaaaaattagctgagtgtggtggcaggcacctgtaatcccagctactcaggaggctgaggcaggagaatcacttgaacccaggaggcggaggttgcagtgagccgagatcgtgccactgcactccagcctgggtgaaaaagtgagactctgtcccaaaaaaaaaaaaaaaaatggagaaaaagaatagaggccagaacttactagaacaaaccaacttgtccaacttggagaaagccagtgtgtctgagcagagtggtggctgatgaacctgggctaagggcttcacgctttattgtggctaagtagagatgtgagtaataggactgggtttttaaaaagtctactctggttgctccctggaggggagggagcaagattggaggcagaggacagttaggaggctattgctgtagtataagggagacatcgtggtggactgacctggggtggagagaaaaggagagagtctggccatatgttataggtgcagtcagaaagaacttggtcaagagttggatatggccagtcagaaaaagtggtaaagatgtcaaaggtttccatagaggcaaccggaaagtgggggaggatggaggttccatttcccaagagaaagaagagaaccagatttggggtgagcaaaggtgtgaagatgaagaattccaactgagcatcttgagtttgagatgcctgcaaacattcacctggagttgtcagacaggtagttgtgtctatcactagatctgcaaatatgtgctgaaagcctaacctgtgtcaggctccatggtgggttagacaaagaggttagacaagatccctaacctctaggaacgtattgtctgttgcttgaaatgacatattggaaaatacggcactaaaaagtagggaatgataactcttagagagaaagagaaggaaatagggcataccataggagttgaaaggggaagagagcactttctgctgagatggcaagtgtcaaggtagacgtcaaaataaggagaaagggtatcgaggccagactggggatgaggcagaattctccttgcccagaacagagaaagccttagctcccctgtccctgcctggctatattctgcaaatacccctaggccaggtataggatgggaagtggaagggtaagggtggaagctctagctgggctaaggccaagggtggaagaattgacattttgatgcttaagtggggctttgggactctctttacagttacagttcccatccctgaaatatctactgggttcccctggaatatgtgtttcaggaaactacaccttctacccctctgctctgtgttcataaggtgctgtaaccaaaagagagtttgggaaggcctgaggatgctcttcataatgttgcctctttaaagtggtccacgtggggtgggtatcagtttatgtccatgaactgatgagatggatgatgacagatcccttattttctctaaatcaaattaaatccaacccacagcagccctgacctgacttggctggcattgacaggaactcaatctcagcctttgattaggcctccatccctctctgctccctccccatccagagagtcatacaaaagtccctggggacctatgcttagcagtgcattcatggtgactcctctggtcctaggcccattgtggtcactgctgatattctcattgtacaattgtgcatgtcccttagagctggaggctttgctggtttggtagtgctgggcccagggaccagccatcacaggggcacttacacagccgttcccctccggtgcacatcaaagcaggagttactgatctttgctacccagaatgttaacccaccccctcacccagtcttgggagtctcttttcaccctttctttgcctcagtttctgcctcttcctccctaccagcagcatttttccctcttccttccccctagcatcattcactcactacagatgctctctaaggccctggctcttatccttgagcacccagcagagtccccgggaaggctggttgaacatagaccgctgggcctacccctagatgctctaattcagtgggtgtggggtggagcctgagaatgtgcatttcaaataagttttcggatgctgctgctgcagctccagggcccacacagagagaaccactgcttcaaggggagggagcaaaagtcctaccctcatggaagtggcaggattgggggagggagaagggggaggagaattaaagaaaggttgaggtacaaataaatatttccaccaccttccctgccatctaccacctcctgttgaatgatgaaattctactgaccagaacataattcagatgcagatttgggggaactcatctgtgtgcagaggaagacccaggagaattacattctgtgctttatcctcggtgaccacaggccttttcttagcctggagttcaggacttctggattgggactcccggactctggcccccatcaggcagtttccagaaagttgctccgctcccacccccaagctcagactataaatttcttttctgttgccttggcctgtcattgggaagactggcatcatctgcagaatgtatttgcaagtaaaatgttcaagcagcaggagagaggcctgggagggggcagctagacgcagtgaactgtgtcagacaggtggctcatgggagctggcggccctgtggccagctcttctgctggaatagaaacccagcatctccgcctggagggcttccttttgccacttttctcagtgcccagagaaagggccacccttgaaggggccatggtcaaagttggtaagccaaaagtcagcccttctgcctcatctcccagcagcagtactataccaggtgatcaggctggagctgccctgtcttcaaatcttattggtgccatgtagtagctgagtatagtttcagatgagctgcttctcccctcggagcaaaagtgtcttcatttgtaaaaggtgtataataatggcatctacttctcaatgttgcttggaggattcaaagggggaactgcatgtaaattgcttagctagtatctggcacatagcacatgtgcaaataaaggtgagtctccgtcgctcatgactattattctgttctgcatattggcattcatatctgttttcctcatggactttgagctccttgagagaaggagccaggtctgattcccttttgaatcaattcattcaatcgccaaacatctgttgaagccctactgtgtgccacttgctgtgctaggggcccatcatccattgctgcacatagtatgtaagtgttacttgatggttaatgagtgaaaggggaggattgcagagaaggcttacaaaagatacattttcttgaatacccactgtgtgctaaggcaatgctccttaaatttccatgggcctaatacccacctgcagatcttagaatcacattctgattcttcagctgcgggctggggcttgcagttcttcatttctaagaagctcccaggtgatgctaatgctgctggtccacaggccacactctgagtagcaagatagacactcctttgcattatgtcacttattgcttgcaaaacattatgggatgagcttagaaatgagaattcatagagattaaatagcttgctgaagatcacacagctggctagtgttggagtcaggtcagcatggctcatttttgtctattgagctcactcacccttaagagcagtggttcccaatgtttgccacatattaagatcacccagggagcgttaaacatcccaatgtcgggagagctggtggcaggtaattctaatgtgcagcagagtttaggaaccatggcctcagagtccaacctcatccaaggaacaagaaaggaaaggagaagaattttgacatctctctaatttcaggaaccaattatagactttcagaatttggaggtctaggcctcttttgatgttacagatgaggaaactgaggcctatagaggttaaaatattcacccaaaatcatttaactcattgatggcaaagttaggactagaactcaggcctctgggctctcacctttgacgtggttcctgtgctggaggaggaatccaggaacagattatccactggaaaaaggcttctccatgctcctccatcagctgggaccttggagactcaaaggagacctaggtttccctaggatgaaccagggaaaaatccactgccttccgaagagcaggaagttttcctttgcaatattctgccaatctcgaaatggcaatgtgcaacagaacatactttgaagttgtaaggcctttaaaattccaagatgaaatatataatcccattatggtaggagcataattggtggcttgatttagtgcagtaaggatttattgttttaatcataacataatgtacattggttggttgcttcataacaaagataaaatgggctgcaaatgtgtacagtaagattattttggggggcgggggttgaggaaatggcatgactcagagtttaaaagccccaaatcttagctgtgcctgtgtagctttaccacataacccattgataacttatccctatgatgtgctggtatgcttaagtgtaaccatttattgagcacttattctgtgagcagaatggcattatccacttagggaatgtaatcacattcaatctatataagatccccatgaagtcagcattacttacagaggcctgcacagcaataattggaggagctgggatgcaaattcacctgtgggtgaattcaaatcaccacactcagcataggacctggctccatacccttattttacaggtgaggaagaggaaggaaaagcaatcctggcacacagggacagcaagtggcaggacagagctgagactatggtctcctcactctgggacaagtgttgtttcctactacctccatggaaaatgaggccggaaagaatggccaggactccatgagctgttcccctccctactcaggctccagccatcatgcaatgaggaggttactttccacacagatcagactttggtctaatgtttttgaggaacctattcaacgaaagagagcccttcaccaatccatgcgccatcaaattagacttaaattaacacatgctatgtagatagctactttcccaatctgtgtcccactgattcttccatctgagaccatattatatatccattcattgagcaattaatggtgaagtacctcctatgtgccaggcactgtgccaggtgctagggataaagagataaggagaaagtaggacactgagccagtctctgccttcctggtccagaggtggacagagatagataaagtgggttcctgaaaactgccatcagtgccatgaaagtgatatgcacagggacatgagaactcagaggagggccctgaccacagctagtggtggagagaatcccagaagcctttccagatgaagtgatttcaaatacgggacctgaagttcagtagaggtgactatgtcaattgtttaaaaggtaggtagatacatgtgttggctcagatgctgaacaatgcttctggtaaaggcaacagcatgtggtcaggctgtcagaggtgatcagaatatgatctggatgtgcaggttggaggggaattagtataagttctgtgtggccggatgataaagtttaaagggaagagtaggaagagtggaagaaataaggctgaaaagggaagagggaccaggtcatgcagggaaccgaacaccatgctaagaggtttggattttgactctgtgagtaagtggagtctattttagtaggattgagatttagtctcatttccattatagagagatcacactctgactgcaacagggagaattgattagaggggccagagtgggaagcagggggtgcgtttaggaggctactgcaataatccaggtactgatgatggtagcgtcaatcagtgcagtaagagtgtagggagagaaatgaacaaactcaagacaaatttcttttctttcaagaaaaatttctaaatccccatggcttgtgatttattgaatgtgggaggagcgagagaaagggtggaacaaaggactatggctggattactgtcctggccaaagtggctggttctgagaaggagcacatggggaggaggaagaaaggtctgagaggggaaggatcatgttgacatgttaatatgagctgcccatgaggtggaaatgtccaggaggaagttggatgctggatgcataagtctgaagcttcaaggagagaaaaccttcctggaattctctttacttatcagaaaagatcccaaagctgacaacactttgtaatctcatgagaaatggccaaaagaatgacagcttgaccccaatcatgggctggttgtttcagcttgtaatatggctcaaggcattcagctaagcttcagtggccctgtgggcactgggatagctgagaagacctttgtcctttaaaatcacagcaaacgaggcagtccttttaacctctttgataggagtccagccactcccctccttgagatatttttactgagtgctttctatgtgtcaggcattgaggatacaggattgggaagaaggttcctgcccttgagtttctccagggccagtggggacagacacatgagcatatgattaagataccacattacaggtggaagaaacattggggggtcaatgttcagggggcccaagtgttcttcgacttcagcatggtaaatatccctatggagttcgtgcagatacttgtgagatggtttttgtttttcattttgatgaatgattgcaaagctcacaactgcagagagactgagtcttcgaaatcttcacatttttcaattttatcacaattttgactcccgctagttattaggaagggtactccctgggtcagctcacttgatgctgtgttaatggtgatgagcaaaataaaaggaggaagaattgagtgtggttagaacacaaagatggactgccctgttctacctggcacagggagaatagagaaggcttcccgggagaagaaatggcacttgtgtgagtctttaaaaatgaattatgcattttaggaggccaaggcaggagaatcacttgagtctaggagtttgagactaccctggataacatggtgataccatgcctctacaaaaaattttgaaaaatagcctgatgtggtgacatgtgcctatggtcgcagcttctctggaggctgaggtgagaggattgcttgagcccagcaagtcaaggctacagtgagccatgatcatgccactgcactcaccctgggtatcaaagtgagactctgtttcaaaaaagaaaaaatggccgggggtggtggctcatccctgtaatcccagcactttgggaggctgaggcagatagatcacctgaggtcaggagctcaagaacagcttggccaatatggtaaaacaccatctctactaaaaatacaaaaattagctgggtgtggtgtggggcacttgtaatcccagctactcgggaggctgaggcaggagattcacttgaacttgggaggtggaagttgcagtgagccgagatcacgccactgcactccagcctgggtgacagagtgaggctccatctcaaaaaacaaagaaaaaagaaaaaaatgaattggacttcatttgtgtcagagagagcatccatggcttttgcaaataccaaatagtgaagagaagttgagagcaggtggtatgtaggagagtggggagaattcagagtggacagctttgcatgccattctgcggaggcattccctagaggggagtggcggaggctgtaggaaaggtcacacgtgcagtgcctacagggtccaggcagataacaacagtgagagaactaggtggggtgaccaactgtcctggttacctaggactgaggggtttcccaggaaaagtctcccagcagaccaagatgagttggttaccctagaatgaggccaggccttgcctgcctagaaagggcctgctctcttcagggggcagctccttggaaatatagactgggattgctggatcttccaaatgtccaagagaaactgaatatccaaaattcaatgcaagttcttctggtttttaattgttgacaacaaattcaaatgttttaaaaacatgatgctggtcaaaccaagcatttctgtgggctatgtgaggcctacaggctgcctttttgaggatctctggctacagtgatgtaagtgaagcctcccatgtcccaccctgttactgccctgaggccccttaaaggcatgttcagatgattttcattatgcagagtgacttcagtgatcaatcgtttggtttttaatttgatgttcttaaccagatttggatgccgtgcacagaatgtaatggatcaaagtggcaatgaatagtggtaatagggacatgcattccatcttttttttgaaagacaaaataattgctcaatggcttgttctgccccaaacctggatacctatttggtcagaaaagtaaagaagaatgtatttctcaaatatcagccttaaggttcatttatcctgggcatctggacagccccctggctgaaataaggctgggaaagaacaatcactttgtttgtaggaaacttggaaggtcaggggactgctgtttgaaggtggtggagggtgatagagtcaactcaacactgtgatcatatgactgggttgtaatgtgactatggggaaaccacccaacctctctggtccatggtttccccatctgtgctgcagggaggctggcttgcagggtagttcccaagaatcatcctccccatcagctctctaactctaagctttaactttgattagacttttgctgggatttctctggccctgccagggtgaaataatcaggggagattttaaagaaaaaatcagtccagacaactgtgacatcttttttcttttctagatggaattagtagatatggggctttaataagttgatctgatatctgggctccaccaggccagctctctgaatggcatttttcattgtgtcagttgatttttctttaattgagtgtggatccgaatatacgtatgggagctgggtgcaggaagaaaccttcaaaggcaggggttttgcagtcagggagccatcctctccaagacaggggagggtggggcagcggggggaggacctgcgttcatgccaagctgctgtgtcacctttattaatgatgacggggagagggagtcagcaggcagctaatgcggactgcagaggatggtaatcgggaggtgttgctaccattccagaggacagggaagtgggacaaatgtgaatttaagaggcaagaggtgaacagagggaaagaaaggcaaaaaaaaaaatgagtatgacatcatctggaaaattgcaaaccaatgaatcaatgaagtatcattcccagagcaggaaggaagctgccagagaaggagccagcctgccggggagctggggcctgacaggaagcacaagctgggttggctatgcagtgccctagccaggggtcagccacagctggcacgtgagccctaggaatggacttccacttccttctgcccctttcctcctagagccttttttttttttttttttcatgaaagacatcagaaggaatgctctatccaaaagggctttacaggagctcattaatgtgaaaccttggagtcagcttttcaaacagttatctctgagttcagcctcataggatttttctcatcatggggatcagcttcataaaagccagagtgtgatgattctgccagtttttgctgttaacagatgaaatagtactccctttatagaaatgaagagcaaggactttgggtagctttctttagttctcaagacctcgtcagcagagctggcctgaaggcaacacagtaggcaggtgcctgcatggcatcctattacctacaaattgaggatcaaagcccttagctaggcatccaaggcccttccatattcttcccctctaaatatctctcgtagttacccatgaacttctgctgtacccaggcactttgttcatttccacctctgccactttcctcatcctgttccaacatataaatatgaagcagcaatttctcagtatatatactaccactccctgcccttgcccatggcagacatcactaattgattgccacactctttcctgctgagctaggacttggccttagaattatttccaacacaacttcccagacagtcactaccaatcaattaaattaatcaaattataaaataaaatgtattttctattattgatctaagatgtcctttcccattcttagctcaatctctatcaatcttgtagtttctcaaatcctacatgctctatgaaattttccctgaatatttctaccctcatagattgttcctgcttattaaaagcctagtgcaaaccttacctatagcatgcattttgcacttatcatttagtatcataatgtatcttcccctttatggatcagagcttctcaacatcagtgctagtgacacttggggctggatcattttctttgtgggggctatcctatgtattgtaggatattttagcagcatccttagtttttaaccaatagatgtcagtagcaacctctccatcacttttgacaatgaaaaatatttcaaggcaatgccctttgagggacaaaattgccccagttaagagccactgtgagacagatagatagatagatagatagatagatagatagatagatagatgatagatagatagatagatagatagatagatagatagatagatgataggtggataaaatctcccctgttagtctgagaccttcagtgtgtggaccatcatcatacctgacatagctccttacacacaataagtgctaaataaatatttgataactgattgattgattgggagtgaggactgaggaattgtctaggaagcgggaaaaatgttctccaatgtggactaagaattacaccttcagtgtgtccttgctgcagttaagcactgcggaattgagcaatgcagagtttgcaaaggggccacctccaagcaaccacccccctccccaataagctgttagcagatcctagtacctgagtgtgctgtgactagcagatctcttgcagcagaaacaactagaggagggaggaagtgctaaaagaggcctggatgatacgtttggcttgaagtttaatacatgatgtgagagaccttcactcctcttcactcctcaagaaggaaaacgaggtaaactgaagaaatccttttatccacaaagtaatcttccctcctggaagctctctggcttggtcacccgatgttctgtgaacatatttatctgcctgccccctccactcccttaaacaatagaggctttgtaaagggagaaaaatggaagaaactataaatcctcacccacaatgcagctgccctcatttccacaggggggtttaaatcatcctctacaagtgaaccagaagcaaactctacacatctccggctgatcacagactgttcctggtgaatcaggaatggaactgaggctgagcattgcaagaagtctttctgaatacctagtgtgtgccaggctttttaagggaccctctgcatgtgtcttctaccttcatcctcactacagtcctacagaacctgcatggttatccccattcacaaagagagaactgagggtccaagaggtaaaataatttgtccagagttccagagcatgtcaaggagagctggcattgatcccaggacttaggatgtgtccagtgcctgccggaaaagctacatctatgagaaactagatatatttcccagtatgcggtattggtacctcatacagaacccttcttagccttcaaatcccaagtaatgcagaaaacaggaggggtgtcctcagccatagagaatagtcattaagagggctggttctgtctatgtaactgtgtaactttaccaattggtctatctgtgtatatcatctagctagctttatccatatgtccatacatccatctattcattcattcatctgttaatttatccatctgtccatccgtccatcatccattcctcctcttctatataggcacaagagatgtcaatgatgtttcctaatattcaaggttaattcagcagggggagaggtggtgaggtggacgatcacacacttttcctttcttcattgacttttgaggtatggcttaattttaatgataataagatcataccatggttgcaaaaatgatagcctcctttttttctaaattaaatgaaagcattctgaagtcaagctgatctaggcaacctatatcccctctctgttcgttggttttcttatctatcaagtaaaaatggtattaccaacatctactgaaagtttggaggattacataagataaagcttacatagtgagtgcttgacccatagtaagtatcctataactgttggctattacgatcatcagtgtactttttaacagcgtctaacacataaacatctgactaatactaacttctctttcttctggttttttcttcctttgttatggccctataaaaagtcctttcagatgggaaatggaggcttagcctagtatctaacatgtatttagcccttgaaatggtgattattattactgttgtttagcccacagtacctcctgtcagagacttcacatcctgttgggacacctttacccacagaaggttgaccttggtgtcattttaccctggatgcacatgtttgcaggaaagagtgggagcggagctgcttaggatccttatccagagctccataccctagcaatgctcctggttttgatttttctcagggaggtgtgaactgaggaatataccgtattttcctgcacagcccttcctgagatgttcagtgtgaggcacagaagcccatcgttgttgtatacatggagaataaatccttgtttctgaacctgttctttttgcaatcatatttgtgacccccctccccccgacacacacacatgtttccatggagagagttagaaacaggataattatgttctgtgccattaaaaactggggtatcctgaatgataacccctctcctggcaagcaggcttctcaggtaggcccccagacttgaatggctttaaccagagactgggagcctccaaaagtaggcttctgttcattcaactctgcatgacagggagatgagcccactggactcaaagataagtggaatcaatgtaaaactaaagtccatgcccacacctgctgaaggagggccagattctgctagaaaataatcatttagcaagaaatgcttgctgaagagtgacaaccatcaggaatgaggaagagtcaacatttaaaacataatttgtgcttttcacaaactcctgaccctaggaacaactccagtctagtgccttggagatgggctggtgtagaaagacatggaaaatgcttctctaaagaggagagctttccagcacacagcagctacagcatgtttctcaaagtccaaatcaatggcttctctttgtacttacaagaaaatcctaattcttgcactgatcccatgggcctccaagggcccgtgggatcagactgctgcctgtctctctgacctcatcatatacggagccttccctcagtcatacctttccaccacactgaacttctttcagctcctccgacgctccaagcacatcccacttcggggcctttgcatctactgttctgccagatttttgcatgacccattttcactattcaggtttctactcaaatgtcaactcttaaagaggccactatgatccatcctattgaaaatagggcagatactccatctccatgctattgctttgtaatatttcattagtggcacatatcactatctaaaatgatcttacatatatatttccttgtttaaagtgtgttccctctgttcctggctcttcccaacggggatgtgagcttcttaagaacaaagcctttggtaacctcagctgtatccccagcatctaaaaccatgcctggcacatagtaggtgctcaagaaatatttgttgaattaagaaatgtgtgaaagaattatctcactctggattgctagaatataatttaagatgggatgtgttcagaggtagaacaaaacttctttcatttctggcctctcctaaggcaaaggtagtcaacacaggaccctaacttttcagcttttatggagggggtggtccctataacattcttttggagatgggaaattctataataaattcaatctcccatctaacaaatatttattgaacccatgcaatatgcaagttcaactctaccttctgacaaagaacaatgaataaatggacacaaatctctgcccatgagagtgctgatgtggaagacgtggcgggtttttaagagaacacagggcttagagtcggaaaggcctaaattttaggtcctatgtcaccatatactaaaagtctgcataagcaagctacctgacctccaggtatctaactttcctcctgtataaaatgagcatgaagctgacctcatgagattactgacaggattcagtaactgctgtgcctctggcacctagcacttggtggtcgctattgagatgatgaatgtagggccctgggcaaaaggaatgaatgaatggaattttctttccttccacttccccttgtgattaaacatctcatcatatactttagaagttttcaagtgatctcaaaaagaaaaaaaagaagaaaatttaaagtgatttcacatcacagagccacaagcacaggctccaaccaggatcagaaggtgttagtttcaaatgaagagtgtgtaatgaattcaggcccctcttcgagccttgattcaaagcagcctgcgcttctggccccttgtctgtgcttaagagctgatctgtcattaatgcccacagcgtcaggcaggggtgcacatggctgactctgccggagttgccatgttgtacagatggaacatgtcagggcacacccagcatatgcaacatccaagtggcatctttctgttttcctgtgatgctatgcctttgacatgtagcaggccacatgaaccttgcggatcaaaaagcttcttaggaaagaaggtgattcagtttattctattgcacagcaggatgtcctgggtaaccaaagaatgtcactgcacgcaaagacagacacaccttcttaaagccaaacaactggggaactaagttttcgatgaagacagttatttttcaggcttctgaacaatttggacactgttgtcacttttcctacctgccagcaactgttcctgaataaaagaactgtcccagcatgctctgttccaagaggcacacactggacttactgaacagtggcatgttgttaaccaaaagcatgttcagcggcagaggctcttagctgttcatcccaagctgtgattgggagtgcttgatgtgtccatagatagtcacgggtaggcggagtcatcatttcctctgtccaggtcaggaatttcaatgagctaatctgcatagcttctctggacttgagtcagcaacaagacaatactaataatagc[450 bp omitted]caccacacagacagcaccaatttcatccaagaataaaatctgttacataaccagatggcagacatgggggtgaatagagaagcaacctgtgagtgcattcggccactcctagtctccaaaggacagctcctagaaagaacttttcatctgtctctgagcctccctcggcaaactttccttcatctcctctcactggtgctttctatattttattttattttggtcgtgcgcattatttgaagttactatagcaacgtgtcaccagctggtatcacatagtaatgttggcatttaggtagcaagcttccgaagttggctgtttcactccctctgcgatctcatcactcctactaatcttaggtgagtgagggttgcatgggcaggcagcacccatgcccctcgcccctattttgtttgtttgtttcccaaggcaaggcaaactggtagcctttccctcagttcacatggcactgcaggggtcctggctctgtgtatgtgtgtgtgtgtgtgtgggggggggggggtgtaggtgtgtttgcattagaggttgttaaatagatatgtttaagttgaatgttgtacactaaaattattggcattgtcaatatcatgatgatgatgatgatgaattttttaatgcaaaagagtggaatgatttggggagtgctaatctcctgatcacaatcacctagtatcccagctaattaattttgatcacacaatactgggtttctcttcttctctctcaccatcacacagtgaagagaccctcactcttttcctttggagcttccaagtgtgcaagacctccctacgtcccgaagggctgaattaattaagaggattgattgtcttggatcactgaagagggttctgtacagcaaataagccctgccactcaaggtgttaagtagtccctcatcagccaagtgcctgcgatgattgcacttatttttacacgtttgacctagtttcaaaccgtgtctcttcatgctgtgattcattagccacattttaaaccatcccaatcggagcgaggtgacactgtctggtttgtgccagagtctcagatacaatttctcactggaatttaatatgcaagtctccctggaattctgttttaagaagcaatttcccatcctggcatgctgcttggatatggatgagtggctgcctcattcctaggtagtaaatatgtcgattacagaatttctgcccgggatgaaaagagggggattcttgctagcctggagactgcaaggggtccctccacccctctgttccccatgcagtattcaggcttttccaggtttctgacagggctgggagttcgagctcctacactgtaaagtttgaacaacgtcagtgttagggctgtctaagttgctagggcaaatgcagtctgctcaacattcccccacccctattcctatgtcccctaaaaatttaagacatggtggatatggaagtaaggtctcaaacttgtacagaggggcaggacacaaatgccatttttgaggaaactactgaaaaagagacacacatcagagaagcaaaatgttattccatgattctatcgctgtatgacaaaagaggtggtttttaaaatccaaatgacagaaaggagacttttctgaatatgaagctgctgcttgtttctcactccatttcaggttatcaatcattcacatcggtgtgatttcccacagatctgataccaaagggggctagacaccatagcagaaaaaaaagatgcttctagtcagaagtaaaacactgtcatttttcattaacagccaaatgcaggtaacttgtccaaacttcagtcacattgcactacaaatcgtaccaaaaggcacgcaaccgggtttttctacgtggtagtgagaactaagaaattaacaagctggtaaaagtaattttgattgatcagtgaactacaacacaccgaccaactcctaatgaaaagataatggtttttttcataaaacagccactctctctagatggggactagaatccccctccctttttatcttttaaaatgaagaatggaagtttctctaaacaaggcttaagacaattcatccttttcaaggcaattccaggcaacttgagatccaaggtttgtttttctttgctttttttcccccttcaaattcaaatcaagccatttgaaataacaagcattccatatccatgcatttggggcagcctgcagttctgacaatggtggattttccactacataccaccacacacacacatacaagctcccagtctcactgttgatttaagccaaagctttaaaagtaaactattgtccaagagacgatcgcattttctctcagaggatcatcgatcataaaaaataaaacctacccacatctcttaccttgaagcagtggaattacctgcagaggatggtcccccttccttgcacaatgagccaggctttgaccagcagcaaaattactccaaaagaaggaataataagtccttcatattgtaattttcactgtttatatgcaagaagtgtagtgggtctgctcacgtaggaataaataaaaagccgaacaaactgctcggcagctaccatgtgaaaagaaaagacctctagtggccacaggctgaattctttaaggaagggagaggagagatggagcagaggaaacacacgctcctgtgtgtgtatagacacacacacacacacatatgcaggcacacacacatgcatatacacacactcctacaccccacaaatgctaaggtttctcctttcttgcatttggcctggctggaggtagaaacgagaataatggttatttcttgatttaagtgggagctggttaaattagcagtgacggcggtgttctgtctagtttgaaagggataatttcacacactcactaccaccccctgggggcctgagcaggaaaaagaatttgactctggctcttcaaggagttgcctgccacccagtgtagaggctacaagttcccatcaacaaagcatcatcagccattgtccctgagagtcccagctttgtgatctccgccggatttgcatgttttctagtcatttacggtgtgtgggtgtggtggtcacttggcagggagagccagcttcctgggtttgtaagcttcgtagtcatgacagaccccttgcttagaagggctccatggctgtttcaaaattctgaatagttttaaacaagggctttgcatttttactttgttctgggactcactaattacatagctgttcctgctgacaaggaaagcatgctatccctaacttcccaattgaaaagaacctagaaacaaatgaaaatccatatcatgggagctactttcgggagtataaacttaagaaacagttttccaaaaggcttcctgtttctctaccactagaacgaaattgtaaacctgggaggaaatatatacacgtgtatatatacatacaggcatacctcgttttattatgcttcacagatacctgttttttacaaattgaaggtttgtggcaaccctgcattgagcaagtctcttggcaccatttttccaacagcctgtgctcacttcgtatctctgcatcacaattcggaaatccaagcaatatttcagatttttttcattattattatacctgttatggtgatctgtgatcggtgacctttgatgttactattataattgttttagcacactataaacaaacttcactatggcaaagttcactgttgtctttttttaagaaattgccacagccactctagtcttcagcaaccaccaccctgatcagtcagcagccatcagcatcaagcccagaccctcccccagcaaaatgattcctatttactgaaggctcagatgatcattagagttttttagcaatatttttaaattaaggtttatgttctcaaattaaaatttatatttttttaaacataatgctattgcatacttaatagactacaatagagtgttaacataacttttatatgcactgagaagccaaaacattcatgcgactggcttgattgtgatattcactttattgcggtggtctggaaccaaacccataatatcttcaaggtatgcctgtatatatttcatatttgttattttattaacaaaagaggaacttttttatataaaaaaggcagcagtttatggtaaaaatgcttttttttttttttttggttcaaacataatacttccagccaggccatcttccacaagcccgtgcttggctggaccacagtagaacttcatttggccaagatggcagccccagtggaaacttgcaagagacagtcaaaaatgacttctcacccctggtggattcgtggctagtgctttgtttaccaggttccagaatagatctccctgaatgctgcttgcagacacagaaaactcaccctgatatggactgataaatctgggaaagaggaagcagaaaaggctatgctgatgtcttctggtgcatgaaagggtgtggttcctcctctgctcagagggtctcctctctgtgtccctgccttgatttccctcttctttgaatctttctggtacttagttggctttgccaattgagggtcttactctttttctctcatgattaatctcgctttcccaactagatcatgaactcacaaagagcaagagccatctcttctcatttctttcatccctctcagctcttaccaagtggcaggccccaggaggtgctgggttgccactggctgattcctggtgatccaactacagattccactgcagagaactttagtgcatttcaaggtgctaaaggagccacctgattcttttgatactgctctagaggtagattcagatgaattattgtcccatttgacagatgagacgattgggacttacacatgtaaaattatttgtcataaaatgaaactgtctccatgattttgaaataggctggatttcctgacacaagtacagtgctctttccccagtgtgcgaacagcaggagaggtaatggatcaggtgttatgtttatgttcggcactgctattacagtcccaggcacataatagtactcagtaaatactttattgatgaatgagccataaggagacattttctcacagggaagttttccatggtcctctctcaactatttatagtatttgtcttcatttcttgcagagtcactttgtggcatgtatgacagccatcttaaaccagatgggtgaccagcactactccttctacattgagaccttccagaccagctctgaacttgtggtgagtctgcaggatgctgggggtgaggaagaactcttccatctctggaacatggcttctgtccctgtcagagagacctgcctgtctatcacataatctagatatgacttaaccaatatttgttgatgaatcacagacattttggggtttaagagcatgactgttagagtcatacattcttaggtttgcatctaggatttgtcacatgctagctgtgtgaccatggtcaggtgaatccttttatgcctcagtttccccatttgtaaagtggggataatgtcatttatgtcatagggctaagaaggggttgcacgagaacacaatagctctcacgtagtaagtgctcagtaaaatatagctcttattaagatcacaaatgcctagaggaagttggtctctgggccaccttcttctagcctctcaggatgcatttgctgcaagaccatctgcccgtggcctgtggcttctatctctgcagctgatgacttcattaacatagagcccagcccaggctgttcctgccccaagggtggagcagagcacactttgccctcagtgtggcctcctttctctctgtcttgttgctaccaggttcaggagtcccactgcttaaggtcactctcaactctccctggagagaccaggagcaccaaaattggatcaacctcagagagtggcccataaaaaaaggaatcattagaaaactaatgccctaccctttcatccattcagtagtgagatgttctctcccttggagtaagattggcaagaaatggaacttttccctcaacctccaatttccctatgtcttaagacatggaaatagaaaaactggactcctaatttttgatcctgtatggaaggaaaggtttctgggggaagaaggtaagaaatggaattcttaatgattgaacatacacattttcttacataaccctcacaaaagtatgacatggaaattaggagtcacatttcacaactctacaatctgcttgctcaaggtcccgtagctagtatgtggtggaggtaaggtctggacattgactgtaacccttataccacactatctcctcattaagaagccactcttcccatctatgagccaggagccttcttcatttccacaggaaggggatgtgcctgtgatgatatccacacttccgcaggtgacatcaagtatgaataatataacaatactcaccatcatcatcaacaggtaatgagaatttgtaggagaccaggctctgtactaagcatgtgataggcagtatgcacttaatcgtcacagtcaccctttgaagtagatattattcccattctgctgacgtggaaactaggacttaaagtgttgaggtagttttccctagcaacaaagattgctggaaaggaacaaatgtcatttccagaattttgcaacttagctaaaagcagtgattttcaaattatgttcctcctatcctcactatgctttaccataaacatgcacacacgtgcgcacacacacacacaattccaccagagctgttctacctttatatattttatatattgggctccaggtaaggctttctttgaacaaagaattctgctgttaaaataatttgaaaaccaccaacttaaggaaacaactctgaacggatttcctctagattttaaattttgcctaaagtacactggtggtatgtcttcactacctccagctcaaaagggtctcagtgccagtggttctggtcttagctatccagatttctttatttattttttattttttgagacagaatctcgctctgtcaccaggctggagagcagtggcacgatcttggctcactgcaacctccgcctcctgggttcaagttattctgccacagcctcccgagtagctgggattacagtgtctgccaccacacccagataatttttgtatttttagtagagaccatgttggccaggatggtctcaatctcttgacctcatgatccacccttctcagcctcccaaagtgctgggattgcaggtgggagccaccgtgcctggcctccagattttgctttaatttgtgttttccaaagatggagaaaaagtatggctcactgcaaaatctagtgaagggtgctgaagtccgctaagaacctcttcaaaggagaggaagagttcctgtcattgtgtctcagctaatctgctcgtgtgtgtgtgtgtgtgtgtgtgtgtgtgtgtgtgtgtgtgtgtgtatgtgtgtgacatatgaattagctgtatttacagcactgctaattagatgttcattttaataagagtttatttgctcaatgacctgagatgctttcatacagtgagattatttccttctcaaatacatatttgtgaaaatgattataaaattgccacatcaatgagtacatttacttctttattcccaaagatggaattaatagtgctttattttgagaacattttcgcatcccatattcatgttccactgacatttgggaaacagcattccagcattcaatctttaagcttccatttaatttagttaatgaaaggctgtgtcccttcccttttcctccctccaaaatataatagcaaaaaaatttgaagagccaacaagctctgagttcctgtaaaacaggatgacatgtgtgctgtgcttcattgtttcaggacttcttgatggagaccttcatcatgttcaaggacctcattggaaagaacgtgtaccctggagactggatggccatgagcatggttcaaaacaggtgagctgctacctgcttccgcaaagctaccttacccagccctcacttcaaagatcacttattttgggttaaattagggacaatttctccttgctgaaaagaaattaaagtgttaaggcatgctttctttctatctttaaacccagggaaggactcctcaccaatcgaagctactcaaaaaatcgtctccaacttctccatttttcaaatcccagttagaatatcatacttcatctctgaagcctttcgttcactcttgggacaggagatcttagaaaagcattttaaaaatatattattttaatttttaaaaagtaataaaatatattctgtgacatggtaaaataagtttaggaagcattaaattaaacagatttgaacagatttccatgctgcaggacttcttcaagcttttaatttgctaatgtgatttttttctaagaggaggatttagggtacagcattccatttgcccatccatttgcacataggatgtgcatttggtgtgtctatgtgtgtatctataatacccgttaacatctcctacactatcagtgtaacccaagtatagcttagatgtcctatggcccaacacaacaagagataaaagtaattctaaacaatttcagtctctgctcctaggtttcttatatcatttcaccaaagtaaaatccaaattataacattcattaatcttttctaatattcccttgggtttatttctaatattccttggatttccccaagcctctctcagaacctgattctcaaatcctgccgatcagttcctttaaaacagcatctttttggttcttctcttttctttctccctgctttcctttggcttattttatttgttttaaattctttcatggaaagcccttcaacttatactggtgtctagttttatctccctctacctattgttcttgttttatatcaaaaaaccaagcattgtctggcaaagatagaaatatccctagagggcagaataaggggagaagttaaaaagacaaaatcagaattctctgaagtggaagggaaagagcaaacactaactcaaacttgcccaagcaaaaagagaatgtattggcacagataactgaaagagccctgaggtgtggcttcaggcatggatgtatctaggtgctcaaatagcaatgtagggaatctgtgtgtgtgtctctctctgctttttctatttacttgattctcaggcagatgctctcttagtggggaaaatgggctctagaagttgcagatatattccttgttgtattttcaaccacaatagaatgaaaaggcttcttttcctataggtacagaaaaaatcctgaggccactcttcaaaggtctggcctgagctacatgcccatccatggacctctgcggccagccaaatgaaatgtgctattaagtcaggcttggatttcatgacccgcctttggaactgggtcagttctaccaaaaccacaaagtcagggaataaggaaagaagcagagagagtagttcttcaaaggaaaatctagaagttgttaccagaaagaggactaaataatgggcaggtgaatgcacagatgtccagccttgatccagggtcttggggttggagccctggccaggcaacttccccttctgagctgtccacacggtccttctggaagaaacatgtgctgggtcccatgggagtgctttgaaggaatatttcctcctgaaatcccagcttcattcaaactttagtcatttttgggagaggcccccagaaatgatacagtaatccttatttctttatacctagaaaattagaatgtaatttcctaacggacctaatacattggaaatctctcctaaatagaaatcatagatttgtatctcttaagggtcagccaagtacttatgttttgtacattaaagaaaaaagttagactctagaacacagcctgggcttcagactctttaattctgccactttctctttcttgggaagtcatttaacctcttggagtgttagtttcctagtctgtaaaatggggataatggtagtttctatttcatgaaaattgctttgtgtgtacgaggatagaatgagttactccttagcacagtgccaggatcaaggaaaatatcaataataatagcgttgccatcactaggtgatgacaacaaacttagctttagactaaagaagcatgtgttaatgtcaaccagaaaagattgcttttttctgcttgcaggcacatagcttagttcgaagatttcctgcatcttctggccaaaatgatctcttatgtttatagaacacatgaaatgttctcactatttttgcattttgtatattataatagctaacatttattaagtaccgagatccatcactgttgcaaaggctttacatgaaattagttcatttaatcctcccaacaactttataatgtagaacaactataatccacgcattatataagaggaagctgaggtacagaatagataagtaacatacttcctgttgcattgctgaaaagaaacagaagccatttcattgaaaacaatgctcttaatctctgtattattattattattattgttttatttatttatttatttttgagacagagtttctatcttgttgccgaggctggagtgtaatggcatgctctcagctcactgcaacctccgcctcctgggttcaagtgattctcctgcctcagcctcccaagtagctgggattacaggcatgcaccactatgctcagctaattttgtatttttagtagagaaggagtttctccctgttggtcaggctggtcttgaactcccgacctcaggtgatctgcctgcctcggcctcccaaagtaatctccatattattaagtgcattttgcccagagaggtgaaatgactctccaaggtcatgccactagtgaacaatttcaacccaatttagataaacagaacaggtaccatgacttatgccagaccagtgttccccagaataccattttcttttctccaaaaaggtgcaacttattcatgtggtcagggccaacttcacttgtcagtatgtctggacattccaactaacttttcttccttccttccatgatctgtatgttatgatagttggcctgtttttataatttttctattatcacttatgatttctgtgttatgtatgcattagtcatctattatttacttatctgtttgttggaaaagggagtggagttttctagattttaatgtctccccagctgtgtactgtttgcgtatgcagacatagtgacacatctcctgcaagaaatacttcctgttagagtgtttttctttttggtaagctgcaacacagtaagatctgatttacatgatgttgttaatttttaaatgatcaagttctttataatgttgtaaatgaacaagattatgcctagaaacctcttttacctctcttccatctgcacctcactctagaaatccaacattttgaggaggcttaggatttatgcatagccctaaagttaccctaaatgcagccaaccaccaaatatttattgaatttcatgagcatccagggttgtaggcaatggacaggccaatttaagctatggtcccagaaggcagagggcttacggtctagctggggaaacaataaatattcccatggaaatgcaagctgcagttgctgtcatgaatttggagcccagacagagaccagaggcagaacagggcagttaggacttatggctgcctggattcaaattccatctgagcaagatccttcaccactctagactctgttttcctcactgtaaaatgtggctaataatgatacctaccacaaggatatttgtgggaactaaaatgaagtaatatgtagaaagtagttagaatagtgtttgacacatagcaagcgcttcataaatgttagttatttttattttatatttctatttctatggtttgggtatagccaaactacttcactgaagcagcaaatctgggctggatcttgtctaccttttcatatggtagttccatcagtgtgctgatgaatcactgacacccattttcccttcatcctacctaccttaatttgtagtgattattcgtttttggggtccccacctcctccaatccatgtaatccagaaagaaagaaccctcttaatgtttttttttttcttcttctttttcttttgagacagagtctcactctgtcgcccaggctggagtgcaatggcacgatctcagctcactgcaacctccacctcccagattccggtgattctcttgcttcagccccctcagtagctggcattacaggtgcacgccaccatgcctggctaatttttgtatttttaatagagacagggtttcaccacattggccaggctagtctcgaactcctgacctctggtgactcacctgcctcagcctcccaaagtgctgggattacagacatgagccaccatgcccagcttacctcttcatggtttcattaatcagcaaagaacacctaatcctgacatccagctggctgcaggatcccgatcccagagcctgctgcatccctaactggaatcccaaattatgcagaaaatgtttccgggcacttggggtgaaccgtgtcctgtcactgagctggaatatgctgattcattcgaaccttttggcccatggagcattttgtgtgttgtaaaggaggcactgaaatgctctgtgggagaataggtatcccagcggctcaagaggagggatgtctgtgtctcccagccaatgcttttatctttagttctaaccagtagaatcaactacatcccatgaatgacaggggattgggatttggagtggccttttctctcccttggtgaatctcaccagatagggcatgtccgcctcctctcccctcttttgttcacatgatactgcctgtgggcatggtccacgctgtgttgtcacatgggagtattatcagcctcatatcctcctgccccagaacttcgaggccatgggcatttaaggataaccataacaacaacagctgacatgtactgaggacatctgtgtgcccaggcactgggcccctgcttcatgtactgcagctcatttagtcttcacacatggctccttttacagatggggcagttgagattcacagaggtcaaccacccagcccacggccgcagctcagaagagtggctgagtgggaaggtgaccctggcaggcttgcagcgcctgtaggactctgtgtgcaccttccattcctgggcctgggccagggagtagtacatgtagtgtgtataggcttattctcggctgcctcctgacaccaggatttgttctgccacatgaagagaagtaggaaactggggacttgagccagcaggctctgtgaggcctcacatggaacagttttgagggtagcaagcctgggtttggctcctctttctgccagcttcttcctactcacaacagctgacttatctgttccctgctctattgcatatggcttctggttcctcatggaatcatctgcccatggcttctgctcaaggctcagactgcgttctccctccttgtgggctatttgaaaggatggatctacttctgtccaggcttgggtatttccattgcacagtgctatatccataagaccacccatgggctgctggccagcccatacaagactgctttgagtcacgtgttggctctggacccagtcagctgtaggcaggcagcagaatgatgcggacaaagtgcgaagggctgcgtgcatggcaggcattagtggaagcatgccagtgccggaagttcaaggagccagtgtgtccttctggttaactgaaaacactttagagaaagacagacctgagtttgggtctggactcttctgcttctttgctgtttgaatgtggggaaattatttgctctttctaagactcagtttcctcttatgtttaatgggtataacagtagctcctatttcagtttatagaattaaatgaaataatgtttgtagaactgttagcacaggccatatgaattatggcaattgatgcttccatcattgtcattattaataaagtgagctcacggcttggattgaacagaactacagagatgtccctgtggacagaactgccctgtggttaaatacctagattctgcaggccgtgtaacttcatgtaaatcctgattttacatgtactggctgggctattgggaaagttacctaaactcacgtctctaaagtggaaaccatatctaactcagagatatgtgagcattagaaaaacaaaagcaacagaggaaagaatccatgcaaagccctagcatggagcctggcaggcagttgaaaaccatggttgggattgttcttcctcctatacagccgctaagcaacacagacgagacacagcaagtgctaggttgagatctgataacgaactttgttttcaacaattcaggttcattgttgagagtaatagagttgagtgtgttttcgtcctaacccactttaccatatgagtgcttaggctttaagtacaattattgttgttgttttgagacggagtctcgctctgttgccaggctagagtgcagtggtgtgatctcggctcactgcaacctccaactccctggttgaagcaattctcctgcctcagcctcccgagtagctgggattacaggcactcgccaccacgcccagctaatttttgtatttttagtagaaatggggtttcaccatgttggccaggctagtctcgaactcctgacctcatgatccacccatctcggcctcccaaagtgctgggattataggcgtgagccaccgtgcccagccaattactgtttttaaaaaaaaaacaagaaaaatgagaagaaaaatgccttacttttccaaacccaaacatgggcacccaaagttaagtgatattctgatttccagtgtgtggctatgaaagactctagagaaagggaggaactttgatttacctgctactaatccccatcatcagcacaggggcaaatcaattcgcggtcattaggctggcctttgaggctggagacaagtttaagctgacaaccaaaataatgactgttactggaatgactgatagctttgttggtgctgagaatgtgtgaaagccccctctttgatattgtattcaagtttctgagatgtttacatataatgtgacaggcactcaatgcatttccatctgggggatcagataactaatctttaaggagagaacacaaaatacaatgttgtttcaaagacatattggtgaataacagactaacaaaaccaaagaaatctcactttgtgacagcctgatggggtggcagattttgtgggatttttatttctgtttttgtatggtgctgcctgcctcaaaactgtctgctgactgatccctgtcctctgtctgccctgttgtctggctcttgcctttagaagaatgaagcagtccagaggggtctgaagccacctcagctagtgaccctgtgaaaaaggttacattactgctatttcacaagggaggagactgaaacttcaggggttatattaacatgcttcaattccacacagctggagagtaacaaagccagaaatcacatccatttgtgtgtgtgtgtgtgtgtgtgtgtgtccaaatcctgtgattccagtgccaggatacactgtcttccgtgttcaacagtcatgaaagtattttaatgaacacctggccctgcagtgcctgatgtagcaaatgctgcagatactccacccaccgactcttggaccacccaaaatccactggcagcttcagtgaggctttcctacttctttctttccctgggctttgtctggctacagagtgctcagctcacctgcaggacaggccagaagtaccagggacttcctgctcattggagcaactttcaatcagtgaggggctacagctaaggtgtaaataacccaaccttcttgttccctgggaggggacacttcttatatgcaaatgtgttctgtaaagtccaggtgtaggatatgagagaaagtcatagtcaaggacgttaccaaaattgtttccttttttccccccactctgagcaattggaagaatagaattgtccttaacttagttgggaagactacagaaagcagtatttcagggtgggtgtagggagggcaggtggccggagtttagtttttgacatgtaagcttgagatgcctaaaagttactcaagtatgggtatagatcatagagctggagtgcaagctggtgtttaggggagaggcctggatggatatacaaatttaggagttaaagtcatgtggactggggagtatgtgagagcatagagggagtctgtgattcccagaagagtagaatctaccaaaggagagagatgttactgagtcatacaagtaaatcatcctagaccatgatgaatgttgggaaagggggttgcaatgaggatcccttggggtacacatgggtgcagcagaccctgccctgcagaagctcatagtctgaaattagagatgcggctgcacacagacagctggatgtaaagtgtgctcataggaggggtgccagaaataacctcagagaatgggggtggtctcagtcacttaaggctggtgggatggtggaaaactaaatgaagaaggctctcgatctggaccatgaaggataatgaccatgaagaatcctgactttcagagatgagaaggcaagggacattctacacaaagaaagaacatagagagggatttgggaaataccagaaacacagggtactagcaagaaataagcctagaaaagaaggttggggtcccatcatgaggggagagactgtccagagaaagagcttggactcaccctgtaggcagtggagagccatgaagtcaatgattgatatgatggagctgtcctttaggggaaggagcttttcaggatgaagagactggaggctgcaagaccagtcagaagggcttggcaaggaggaaggagagaacaacatggagaggaagacacttaaggagaaatgcaaattgacaagtaccaaaatgttaaacatgcatgacatttgaccagtattgttattttttatttttttttttttttttttgagagagactctcactattgcccaggctggagtgcagtgtcatgatctcagatttctgcaacctccaactcctgggttcaagggatcctcatgcctcagcttcccaagtagctgggattactggcgtgcaccacaacgcccggctaatttttgtatttttagtagagatagggtttcaccacgatggtcaggctggtcttgaactccagacctcaagtgatccacccaccttagcctcccaaagtgctgagattacaggcgcaagccactgcacccggcccatttgaacagtattattacttggaggagaacagtggagaaggggtatatataggaggtatttgatatacacagaagagtgatcactggagcattgtttattacagaaaaaactgagaaaaaaacccaaaaagatccatcaataagaaatggattaaactgtgatacatccatacagtggaatgctcttcagtgattaaaaaggatgatatatatctacattcattggcctgaaagaagtacacaatttattgttgagtaaaaacgacaggctgtgaaacagcatttgttgtttagccccatttatcaaaatgataccctgaaaatatcattcatgtatatacatgtagggagacccttgaaattatgttcatcaaaacatggatgacagttttcgttaggtgatacgatgtggtagcaggttgtttatttgtttgtttggggatggggggggtgatttctctttagatcttttctggatagcatgaattttcttccataagcttgtaatatcttaaacataagacaatgcaaattttcaaaaagaagtcgaacagttattgagttcttgcaaggcaaacagccccgagtctagagtgtgaatagttgttaatctgcattagctgacctctctaaatcagtaatttggcctttgagcctctctccaaagagggtaagggaattttagtctggcataaggacgaaggaacttaagggatcatgctcagacagtctggtaattttctgccctcttccagggtcttcctgagagctatcaacaagtttgcagaaaccatgaaccagaagttcctagaacacacgaactttgagttccaggtgagtataagccaccagagctacccttggagctgcccagggcgtctctgacattctgggctgattgctccatcagacacatcccaaaggccacagaagctgtcccagtctctccagggattcccacggggggttatggctggggagaaaattctcaggctttcaaccagggccttgattaaatagtcatcaactgatcatcatatgcaaatgtgacggtataatggcctcttatattaacaaggagatttgcattcattcattgtcagagtctgtaccaccttttaaaaatgtatcaccttttttttacttttctattctctggaaccaaaagggcagccagtcattgacaatgaaaaatgatttacaatcaaattctccagtacaactttgtggtttcctgattcctttgaaagtcatttttagtgctcagccaataactgggacctctaagagattcagggtcctaaaagtatgtgcctggggcaaacagaatgacacacctgccccaggtccaggcccaagaagcacaaactctgtgggaaagtccagattgcttcctctgcctggagatgtgcgagggaaggccccccacaaaaggatcccctccagggaagtctccgatccctagcatctatctcttccagtgggggcttagggggtagtaggcactgagctcatgaactggaatgatggtgttttttccttgctgtaggggtgggatgcccctccacacctgtgggtgtttctcgtaaggtgggacgagagatttggaaaagaaagagacacagagacaaagtatagagaaagaaataaggggacccggggaaccagtgttcagcatatggaggatcccgccagcctctgagttcccttagtatttattcatcatttgtgggtgtttctcgaagagggggatgtgtcagggtcacaagacaattgtggggagagggtcagcagaccaacacgtgaacaaaggtctttgcatcatagacaatgtaaaggattaagtgctgtgcttttagatatgcatacacatagacatctcaatgctttacaaagcagtattgctgcccgcaggtcccacctccagccctaaggcggtttttccctatctcagtagatggagcatacaatcgggttttataccgagacattccattgcccagggacaggcaggagacagatgccttcctcttgtctcaactgcaagagacattccttcctcttttactaatcctcctcagcacagaccctttatgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttgagattagggagtggtgatgactcttaaggagcatgctgccttcaagcatctgtttaacaaagtacatcttgcaccgcccttaatccattcaactctgagttgtcacagcacatgtttcagagagcacggggttgggggtaaggtcacagaatctcaaggcagaagaatttttcttagtacataacaaaatggagtctcctatgtctacttctttctacacagacacagtaacaatctgatctctcttgcttttccccacacttgctcatctaagttgttcagttcctctctgggctttcgcctctcagaagctgagcaacttcaggcaaggcctggactgtatccgtgcctcaagtgagtcatctgtaaaatgcaacaactaccctttctacttcatagggtttttccagaactggaatgtgacgaagggcttgctggaagaatccacttgtaaggtcccataagtttctgttcaaatacttcctccttaaagaggcctcccctcctgactcctccctgaggatcacccccactcactccacagtcattatgcaaaaccatgtggcttcctggagtctcttcatagcactaaatatcattagaactcatctttcttgtctacctgcgtattttctctttcctcccatagaacttaagcctcgtgagtataaagaccttgaacacacaacaactctatgctctgtacctggcacatagtaggtctccttgaggaggtgacgtctgggctgaggcctgtgagattcacccttctgagagcaccagcctatgagtagatgagtatttgctgagaggatgaacaggatctttgaacaagagtctcttgaactaccttgcattcaaatcaggcaactgagtgacaatgagagcgataataaaatgcgtagctgccattttctgatggttaataatacatgccagatctcacgagaagcactttaagggcattatcttttgcagtctttacagccaccctacaagttggccactattactaatattttttctgctctaaggaggcaggaagtaagactcagagataataaggagatagcatggtgtcaccgagcacatcaatgcaaagttgggaccagaacacagtggtggctgacaccaaagcccacccagatgactacagccacgtgcctgatatagactttcacccttgcagtgggttgactgcctgacagggtctgggtgagagtttctcctggcattataaatcttcgacacgggaacaaagcatatctctttagctggtttgaatcaggagagatgtttgattcccttccaaatgtggctgagaggcctgcaggctctggtcatgggtatgtttagggaagtttctgctttttgggaggggcaacttggaacaccatacctaggggccagaggtgacagggtttggtccatataactgcgagctagtttgttcatctctttccgtgggtatcggctattgcagcctcaaacttgctttcctgacttcactattttccatgctcttagatggatattttccaagagaagctcaacttcagtccttcagggcattcctttaggtttatatcctgttttcctgaaagaaaatctgtatttgagagatgctcagagattgagggtttcatacatgagaagtacgggcttgcaagctgagtgactttagacaaattacttcatctctatgtgcctcagtttcctcaacattaaatcaggatactaatagcagctatatcattggattgttgtgaggattaagtgaattcacgtaaagcatttagaacagtgctggggacatagcagccatttagtaagtgttagctcattataataatagtaattttattatttggataatgattatgatgatcatgcccctaaatgtgtcagggctgggaatgcatgtcagtccttgataaacaggacaggaggcctctttctggtcaccacaacattgcctggggctgtcacacccacaagattctgtaaaacagaagagtggccaacattacaaaataaagtaagtctcttttcctaatgaggcttccatagctatttattgaaaagtacccaagaacaggatcattttccaaccttatctttgttctcctacctcttcctccccctgtgtaagaatggatttgttctctgtaccctgcctggaacacgccttgtctccttcttacgggctcattaattatgcatttaatatcagcaggaacagcatccatcactgactgctgcctgtcttggcagccactgaccagaggagcagcaggtgcaatgagattatccctaatatctttcccagaactgtggttttgtgattcaaagggcagaaagtaagaagcttggtgactgccactctgtaggtgacaagaactgggaattataaaaatggtgttttctggttgcggctaagatcacttgcattccaggccctattcaggatgctggtccttggtgtctgcatcagttcatgtggtcagggaagaccaagagaggatttcaaattcaaatcagcaggtatttttgtttaagagcaattcttatgggcccagactattgcaacatgcttcaaggaactcagaagcaaagaacactgccctaccctcaaggatcttggaatcttgatagaaggctatacaaatccatcttccagcatccaggcttttgaagagggtgactaactttattgggcatctacttagaaaattttgattctcatcataatcttgtcaggttgtgatatacccatttccctggtgaataaactgagcttcagagaattgattgacttttctgttaaaggtcatctaaccaataaatggggctgctgcgattcaaccccaggcctgtctgcaaagcacatcctcttttcactcttctgctctgtttcttaggaaccgggtgcctctggattccaggagacagctctatttagatccagaagcactctctgccctttctagttcttactggcactgggatagagagcgctgagatgattggctggaagatgagactctccatgttgaaatctctgattggccctggaatcagagattatacttgggctccagaaagactctgtgttaggcagcactgtctttggtattgagatcattctctctccttggggatgctctaattggctctaggtgtggccatttctgcctaggccttgaggcatttttggattaccagcctatcctgggaaccagttttgatatcctgtgaaatgaaaaacttctagactatttctagccattagtagaggcatgagagccaccttggtctttataatgggaaatgtaaacagtgatgccaaaaacaggcgagggagagacacatacagagggagcagtcatcaaagccttgcaactgcccatagcgccaccacagggggactcatggtgggatggttggttccaccaggcagaacggtgggcacatgcttgggtgcagtttccccagccctgcctgcttcagcttttaggccccagacattctcttgtctgatatttctcacctgagtccacacctgggaccttccactccccaaatcagaagcatccccagagtggtcatgacagctgtgcctctgccctgcagaggagggcaggctgactgcatttcagcaccactgcatgctggttaatttttttttattgaaatttgggataaataatgattcaaggtcactgagaaagaatcctgattctgattaaaaaatcctggatctctctgctataaagactatagtctttataaacatcggatggaccagtgacaaccttaaccaacaaagctgaaaggacactgagaaaggagaagagcgatttcagcagaagagcagggtggtgaagaatacaagtcctggagtcagataaactggattcagatgccaccttcaccgttttgtagctctgtgatgtcggacaagatattgaacctctctgggcctcagtttcctgatctctaaaatggggagaataattatacaaatctcatattttttttagggaggatttaaccagaatgcatgcagtgtgcttggttcgttaatgaactcattcaaaaaataatttcccaagcacgtgctggctcagacgtgatgtgcgatactgtgtgaacaagagtgaatttaaaaagaaggttcttgcttgcttgatgctgacagccagtagaggagacagaaaataaattaattttgtttaaaatatgacacagatgttgtgaacagggtataatatgggtgaataatgggtgaatctactttgcttggatgaatggagaaggcttttgcaagactgagagtttgctagccagtgatttcctcatttagtccttacaaccataccctttagatactattgtcctcattttctagatgaagttactgagactcagaaaggtagggtaccttgtccatgataatggaactggtcattgaactgaaaccctggaaggcaacctgacagtatctataaaaacaaacaaagacaaaaaacaaacaacaactaaacatgcatagaccctgtgtcttagaaattccggttctaggaatgtatactacaaatgtagtttcccatgcataaagatgtttaaataaaggcgttgattacagcactgttgctagcgaaaaaaaaaaaaaaattggaatcaagctaaatgtctataaatagggaatttggttaaaattaaagtacatcgtcatagaatacaatgtagcaataaaagagaatgaagcagatctgtatatgctaatatagaaacatttgcaagatatattggtaagagaaaaaagccaagtgcagcagacttttaaaaaagatgtctgtacatacatttgtttatgcataaaaaaattctgaaaggctatccaaggaattgttaacattctcttctgaggaattagacttggatccaaggtaggatggaaaataactttctcccatttaatcttttctatcatttatttttttaactatgtgtgtatattacttttataattttttgagagttaattaaagtaactaaattctcattatacccactagcagtatgactttgggtggtcttttaccttatctggactttactgtttacctctgtgcaatatggtagtcagaacagatgacacttaaatttattccagttctaactctctattgtcctataatttcaaaatattaaattcccaatcggaaatcacctcatctcttccccagggcaaagagacctgtgcattttgctaaagacacactgtagcttcccctagtcagctgagctaggcacttagtagaaatatcaccagacagtttctagcagggcagaaagaaaaatctgggaccctttgaagaatttctctgacaatacggcaatagataaataaatattctcaggagcccagctgtattcgagtcattgtgctgagcatggaattagagatacaaataaatgggagacaaaatcttggtacttgtggagcttacaattggagaagacagggcttacaaatactccacaaccaatgctaccatcaacaccaccattccatttactgagcacttggtgtcaagcctatagtggatgcctcgttctcaaattattgatccagtaattacaacagtcctttatggtaggtaccattatgttgggtattttacaagtgaggagaatgaggctcagaaaggtcaagtcactagccaaaggcaacccagctaataagcaatagaactggttttcacaccctggtctgcaagacactgacacatgtgctcttgactaccagacagtgctgtcatgagaaacaaatggagcacaaggccaggtgcagaacagtggactaacatccatggttgcacacaataagtgctcctcaaatcaggaagtgatcaggcagacccaatatgccctgcagtctaggaaggcttcatgaaggaagcgggtcttgaacccagcttggatgtaagaataggacacaatccctgcaggtgtgagaaccacagtgagtgaagccatggagaccaaaatgctcctgtgatctccgtggagtctgagcagaccaggccacctaggtgggcagttgttgaaggagacagcactggggaccatggaaattgtatgagactttaaaagccaggtgggttcatttggatctgattctttgggaacaagagtgaagaaaggcttggggcagaggccttataagtattcagcaatatctagttgtgaccactgctcacctctaagagcgctacacagagccacatactgtgacaacctcctctgagttccagaagtcattcccacagagccccatggccaaaactgggcaggggctatgggtgaggtacttggatgtgccatttctgatccactaagaagatgaggcacagctacagcctcatggctcataaaggtcttccagaatggaagccaaaaccaaaacaaaaccaggtccactccatgagaattgaaacgtatgtccacacagagatttgtacaaaaatgttcatagcagcatagcgtcaatgctatgactcataatagtcaaagactggaaacaacccaaatgaccatcagtggatgaatagataatcgaaatgagtatatccatatgatagaatattattcaatgataaaaaaatgaagtacttccacaatggttgaactagtttacagtcccaccaacagtgtaagagtgttcctatttctccacatcctctccagcacctgttgtttcctgactttttaatgattgccgttctaactggtgtgagatgatatctcatagtggttttgatttgcatttctctgatggccagtgatgatgagcattttttcatgtattttttggctgcataaatgtcttcttttgagaagtgtctgttcatggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccgcatattctcactcataggtgggaactgaaaaatgagatcacatggacacaggaaagggaatatcacactctggggactgtggtggggtggggggaggggggagggatagcattgggagatatacctaatgctagatgacgagttagtgggtgcagcgcaccagcatggcatatgtatacatatgtaactaacctgcacaatgtgcacatgtaccctaaaacttaaagtataataaaaaaaaaaaaaaatgaagtactgatccatactacaacatgggtgaaccttgaaagcattacactaagtataagaaatcatacatgaaaggtcacatattttatgatgtcacctatatgaactgtcaaaataggcaaatccacagagacagacagtacattagtattcacagtttccaggcagtttgtagcagggcagacagaaaaatctgggaccttttgaagaatttctgtgacaatatagcaattgataaacaaatattttctggagcccagctgtattcaagtcattgtgctgagcatggcattagggatacaatgaaatgcaagacaggatttgggtacttgtggagcttacagttggagaagacagggcatacaaatactctacacccagtgctaccatcaacaccaccactgcatttactgagtgctcggtgtgtgccaagcctgtggtggatgcctcatgcttgtataggttccagggacagggtaggggaaggtgttggtggggagaagagggactgactcttacgggtagagggtttcttttggcgtgatgaaaatgttccaaaattagacaatggtaatggttgaaccccttgtgaatatactagaaactaaatcatacacttaaaaagtgaattttatggtatataaattatatctcagatttttttttaaaaaaaagaaaatcaggaatgggatgacagagaaaatgcttttttgatggattcattcagggtagaatagatactggcaagaggctcaaccatatttgatgtgtcttatgtgttagggggcatttctgaaattattctcacaagtaattgtaaattgacttgctttgttggatacctatttcccatgtaccttaattactcttttgctatcccctaaaatcagagatttctcactttcatggaaacactcatttccatgtcctgtggccacagttttctcttgccctggcttgttgtttcaaattcccatcttaaatgtgagaaggtgtaagctccggacataagcagaccaaagctgcacattttcaaagcaaagccctggagaaactgctaagtcactgggatgccgggaggaaaggcagtctgaggggatgtggacaggagacccaacctgccacatgtgtttacataagcaacgttgctacggaaacaaggagatttgattccaaatgttacaagaaactttggaggactttgaggaagggagtggcatgatctgatgtgtttttgtttttgttttgagatggagtctcattctgtctcccaggctggagtgcagtggcgtgatctcagctcactgcagcctccgcctcctgggttcaagtgattctcctgcctcagtctcctgagtagctgggattacaggtgtgtgccaccatgcccggctaatttttgtatttttagtagagatggggttttaccatgtaggtcaggctggtctcgaatgatctgatgtgttttaaaaggttcttctggtctctgcatggagagctgactttaagggggccatgagccaagaggccacttcactgaatccctagagcagtttgtttttttgggccctgggtgataaaggtccaagtaaagaaaaaagcattcactcaacaaaatgtaaactgcgtgaggccagggatcgctgtctgtgtaaccactgctctgtcaccacactgtggcaatgccagggcacctagcagatgttccagaaatatttgttaaatgcatccccagctgaatactgaccgtggtgtgttaaaagaaccccgaatgtcaatcagaaggtctgcgtgcagatcttagctctgctgtgtatacatcaagatgagagacttacgcaaaatactcaacctctccaagcttcagtctcctcatctataatagaggaataagagctgtcaagtgttgagagatgaaaggaagatgtatgagaaagttcctggcctatagtaaaattagattgcttgttttgcttctttcaaagactggaaccgcaaaccgatttgaaagtcatactctgggcagcaatgatgatgttatgttatcagtggaagagttgcctctttcatagtcttggccatctgcaaacacgaatgaacgtctttgagttaaggaggaaggtttcaatggcagtatgatttctctggctaatgttgcctatcctcttgctacatacactgttgagaggggcctaaagtgggtgggctttgttcagcaaaactgtctcccacatgctccttgcaggaccttggcatcttgcaataattgcccttgagcaccaaaaccctaggctgtatcactggctttcgtaccaaagaaaccactggaataaggaaaagcacaacagcaataaggctagcaaggatttttgagctcttactgtgattcatgtctttaaacacatcattttgtgtcatctttatcacagctttctgcagtgggtaccagagtcacctcagttttgcagacaggtttaccgaggctccgtgatgaatccatggattgtagatccatggtttggacctataatatctctggttctgtatcctgtatcaatattgccatcagtgtggctaatcttttgagcagtcaccatgtgctgacccctttacctgctctatttcactgcaggctggtggagtgggttagcaccaacagatcaggtacatgcaaaaatccttacaagcctgcatctcagctgggccagcaggggctgtaactgaaacatgcatcagaatcacctgactgcttattaacctgcagatttctaggtcccacccccagaggttctgattcagtaggtctaggcagcggccagagaatttgtatctctagcaagttcccaggtgctgctgctgatctggcaaccacactttgaaactattcaactaaggggaaagtaaaggcaaaatattttaagacagaatggattgcagtttggtcctccaagctgtcaggtgaattagggaggacttccagagaggcagtgaatccctgaactatcttacccttcgtcaccctctaattccagggcaagaaccagctctccacagcacgcagctagggcaaattatttgtctttcaaaaaacagaacaaagcacaaggacaaaaacaacaacaacaacaacaacaacaacaacaaaaaaaaaaaaacctaaaattctcctcctctcccaaatcctgttgtctgagagtggacgtggtagcgcctagagaaatccatccattgtcctcactttggccaggatgttaatttcagagtcagtgccagttagaaaattgcagtgggcacaattaaactggttcggcctctgtcttctgccatcttcataaattattcacactacccagcgcttatgccttcccgcttcagaccctctccataactgttctctgctctttcatttacagctgtggaacaactattttcatctggcagtggcttttatcacccaggattctctgcagctggagcagttctcacacgccaaatacaacaaaatcctgaataagtaggttgcatttttggatttcctgaagagggggaggtccatgagatcctctgagatggtgcctgaagcagaggtttttgttcctcctaggtatggggacatgagacggctaattggcttctccatccgtgatatgtggtacaagcttggtgagtaggcacacacatccagatactcacatctgcaggcaccaaactccttcttaaagaccatctgttggagggccacaggggttttagcagtgggagcatgaaataacagttcattactgtgtgtaccccagttcctaataagtgcctgattatactctgaataagaggggttccccatacccacttctacccccagccctgcaagcagctgtgaatatgcttctgcttgatgcccccaatgggttacagatccaaatggaaatttataagagggaccaggactgtcatgggaactcacgtgctcacacatgacacggatgcttgctgctgattggagggtccttctgcatcctgtatagcgtggtccacaaaacgtactccaacctcataaggagaattggctctctgaaagatgagagggtctttttagctgaaaagtgaccccagaagctgtctctgcctcagggagcttcaggaattctgtgtgattacctgaatgatacctgtggagggagagatggaacgaaggagacattattgagagtctgagtcaggcccatgctaagaagattatatttaatcttcacatcacttcctgtaagacggaattgttcccccatccttttactgatcaggaaactcagaaaaggaagtaacttgcttgaaatcaaacagctggaagcctccaagtgtggttttgattccacaaggacaggggctataaaccttgctcatgtcctgaatcctcctttataaatatgtgctgaaaggatggatgggtggatggatgaacgaacagtaatgaattttttatttttctgtccctccttgactctctgattctaaattgctctgccctgggtgtggatattgactttcctgcaagtactaacttgtgcccatctcttggatttaatttttgttccctcttcagactacgcttcttgcttccccagacctcttattatctgccagttcccatgggttttttaggcagcagttgcatgccccttccagcgagttctatccactgtgggggaagcatagagcagtggatagatgatcagtctgcgttctgtggttgctgatagcatcagactcgagctaagagaagtacatgctggataacagggaggttgcaggttggttcacaaagcccaaggcagagccaaggacccaagcccagaacagactgccacttctttgctttgggccttgctctgacatttacaggctgtgaggcctagcatcaccaggcctaagttggggaaataagcaccctcacagggggcttatgagggtcatcagagcacaagctggggcacgtggagccatggaggccaccacacccacatcagagtttttatcattattgtcatccttgccccatcaggatggaacctaatgtttctgttctccctggcctctaccctctaagatgccagtagcaccctccctagttatgacaaccaaaaaggtctccagacattgccaaatatcccctgggagaagggggtgccacctctaccctgtttttctagaaaggcatgtctttctcagtctatcttttgtttctccactctgggtaaggactgggatataggaaataattgacgtttcatttaccattgctttgcaatggtaggggaatgggggaacatggtgcaagcacaggcccacacgacagccggcacctggcctcagggtcaggaagatgagaaggagtaagggcctgcggcagagtgaaactgacatgcccaagcagagaaaaaagacagtcactgttcctctccagttaatagctgtcctactgaaatgcaatcccaacgttgtcatacctttcagtttttcaaaagaagccgggagactgggtttttcaatgtattttccaatttatgaatactaatgaaaactaattgaaagttttcaaaacatcagatgtgctcaacacatgatggacccagattcagttcacttccaagtttgcattcgttgctgtacaacagcagaggctggagaaagctgtggcgggcttccttccccagctcgacaccccaggcactgccagaattgcaaaacagggatctgtgctttgtttgtttcaagtccttccacatggcctgctcttttctgaatgtccttcattgccattgttttgcacacagaagattttatttagatatagattatgttttggcaggcattcctgcactcccaattatgctgatgaatgaaaagatgttaccaaatattccacctgcttagaatcacagaacatcggagctggaagggcccttcaaagatcatattgtccagcatttttcaaatatttatttttagctgaggaccaataaaaaaattctcctgcttaataagtaaattggatgaaagcagaactattgtaattgaagtgaggtgggagacccagagcccattataacaagctgctcttgaacttctcttgtagagggttttctagggggaagccctgagcactgcagagaacagttggaagcaactgatctggtccaattcactattttactaatgaggaaactgaagtccatagagaaggggtttgtacaagatcatgtagtgggttagaggcagaaactggtcaagcaccttagccagagtgtttgctctgaagcatcacagactccctgctgttagcaaaaacctgtaggatgaattaatgcaattaaaagatacatctgtcaggggttgagggttggttgcaaaaaaaaggcattgactgcagctgccttaatcagagaaggtatttattagaagggcaagaaagagccgaagaaccaggcttctcttgttcctggctacctgaacccaggattcagtgttttaggattgcaatgtgctcaattaacaatgccttgtagcagttaacagccacgtgtcccaagtctgtcccatgagaatcagcagaaacatacctgttaggtctacaggaaagtatttttttccaattaaaaacaaaacaagacaaaaaagaggcaaggagaggacagattgaatgaacaaaatgcatttttgcccacagccctcccctctctttctttctggaaaaggacaatatggctggaggggcagtagccatcttaaagccatgaggacaaaacttacattctgagaatgaaggagcaggtctggactggccatcttttggtttcttgttaaacaagaaaattaaagcttcagtttagtcatggtagtcagatttctgttgcatccttaactgatacatcatctaattcaaccctgccgattttataggtaaagttgccagacgaggccaagagaagcagaaggacattcctaaggtcaaaaacaagccagtgactgaattgaggctaaaagagcctgtcctgtctcttgatcccaagtgcaatgttcttacaaataatttttttcaaagtgtatgcatattgtttcaaagggtgtgaaatgaccaacgatctacgctttttcaaagtgtatgcatattgtttcaaaggatgtgaaatgaccaacgatctacgttttttcaaagtgtatgcatattgtttcaaagggtgtgaaataaccaacgacctacgttttttcaaagatgactgataatgagtaaatcataatgcatgttagttttctaaattttgttttaaggccagaagcaatcagggcatcatcatcaccatcatcagtatcatcatcttcttctcatcaagaacaacttgagcaaccctgtgtttataagatagctaattgcaaagctataatctcaggcttgaagattatttaacattcttcaggggcaaatctagacaaattgtgtgtgtgtggagaggaggtatgggcagggaggtcttcatggggagaaagacaacatgtggttaaggagccagccactcaggggttaatggcatttgttgttttggatcccgggcggacgccaaatggaatttacttttcccagtagtatagcatcgtaacacttgatttctgctcggcatgaagaaatgcacattttgctcaaaagactttgcacttaatcctcccacattcacttgggttaacactgagctgctgtattaacattcgttgtgggaaagaaggacacattctagcgcctggcatctcggcctcccatgtagggaggttggcctggccaagcctcgagggcaatttgtccattactgtttaagcgtctacagagtgctcagcttggtgcggaggtccagggagtggagctatctagtagggaaaagtgacaaagtgaaatgtgtagtggggactcaggagttcaggccaaaagggatataagtgaggactataaggatgattccatgtggggaaatggcttctgaattggaaggaggaccatgtcaggactgaaggaaagacagggaaagggcaggtattctaggggagcaaccagcccagcaagcatggcttcctagggttggggagaggctgctgggaataaataggaaatgggattagtgtggccatccgtccattcatttactcattcgtttactaaccaacatcgagcactgtggtaggctccccaaagatgtccatgtcctaatccccagaacctgtggaatatgttacctgacacagcaaaggagactttaaggtgtgataaagttaaagatcttgaagatggggagtgtcttgggctatccaagtgggctcagtacaattacagcatccttataggtgaaaaacggaagctggagaaaatcagagtcagagagcaatttaaagaagctgtgttgctggctttgaagatggaggaaggggccatgaaccaaggaatgcagggagcctctagaggctggaaaaagaagctggggaaggcaaggaaatagattaatccttagatcctccagaaggaactcagtcttgcccagaccttgatttagctccatgcaaccccttttaggcttctgatctccagaagtattacacttattacaaaataaatgtgtactgttttaatttactaagtttgtggtgatttataacaacagctgtaggaaactaacacacacatcctctacatgccaggtactatgccagtagctggggttaaaacccgaatcaggttagagatatagcccctgacttcatggactggtgatcattgcactgaatagttacctactaactgcagcattatttaatgacagttgcgaaggggaaatagctgtagaatggaaacttggggcacccagagaattggtgacagactcctacttagtgagtaagccaaggatggcctccatgaggaagagccagaatccctgaattggaaggaggactatgtcagggctgaaggaaagacagggaaagggcagatattacaagggagcaaccagcccaagcaagcatggcttcctggggttggggagaggctgctgggaataaataggaaatgggattagagtggccatccgtctatttgtttactcattcatgtaataaccaacatcgagcactgtggtaggctccccaaagatgtccatgtcctaatccccagaacctgtggaatatgttacctgttctttagaaataggatacaagccttctaattataaatgctttagtgtctttatttttcaaaaattaaaagaataaagttaattttaacaatacatttaacaccatattctaaagtgttatactaaacatgtaatcaatataaaatattgctgagattttgttttccttttttgggtatctggtggattttttacacttgcagcacatttctaatggactagccacatttcaagggctcaaaagactcatgcagcttgtagcttccatacagaatagcacagccctagaaaatgagaaagggtttacttgcagagacatgtgttggggggggtagactatggagggggggtccaggagagggaaggaagaagagctcgttggtggaggaaggcccaaggtgggaaaagcagtgtgccctggaggagtgggcagtaggcaggtggagggagggtggctaggtgagaggcacacaatgggtatggggagggagcacaggaccagacatgctcccaggtagtttatcctgagagcaaggaaagtcatagggaaaatactctgtgaataaacatgatccaactggggcttttcaaacatctttgaggacaaatgagaaaatatttcaatgagacagagaagagtggagggttgtgagtgtcagccatggtagggaagataaatccatctgaccctttccccagttcagctgtttgctttaaaagtgaacaaataaaatgaccagcctgaaaatttccatgaaatgcttcagggagctccatggggttaggccttgtcttttcatattgcttaatctaaaactcggcatagagctgaacccaaagtacttaccatcagcagcagcagcaacagcatcaacacttcctgagcttttgcaatgtgccggacactgtgcagggcccttcgtttgcacttaagcttcgacaattctattaggcagattttattatcttcatcttacagatgagattatggaggctcagggaaggtaaatgacaagcacaataccacacaaccagggagtggcagtggcaggacctgacccaggctgtcagactcgaagactctacggggcctggaaggaagctgaggctgggcaagtcctgaacaatgaggagagaattgattgcctgtttcagagcattgccaggagggagcttttccaagcctaagacagaggagcaaagatcggtggatctgtgttctgtcttccccttttgaactgattttaggttttttttgtttgtttgtttgtttgtttttaatcagctcagctttatttcaaagtcccccggaggcttgctggactctgaaatccagggagtcgtaacttgccctcatccttgttcattgcagcgtctgtgccagcctttggagagacctttctgttacatgtcagcctcagaagcccatggcttgcccaacttaattctcagccaagttcacaaaagcctccctccctccctcctttctcccttccctccctccctccttttcttctttccctccctccctccttttcttctttccctccctccctcctttcttccttccctccttccttcctttcttccttctttccttcctttcacctttccttccttccctccttccttcttgtttctttcaaggtcatctcctcagtgccctcagatcctttgcattttaccctacagtccactcctgggaggagtgatggaggaggccactgtacagatgagaaaccaagaccagagaattcatgggacccctttccacccacacccccctgagctcttctctgtgcttacattatcagcagatcctctcccaaagcctgtgtaatctggcatttggatttttcctgctggcttattggcactttaatagccttttctaattggtatctgttcccagtgaagttcagcttcaattacatgaaaaagaccctcttagtaaatgcccttccttggcttttctcgaatacagcagcaggtgtgtctcttgcatgagcactttttttcccaagtgagtttgtattcaattagccacaaatgtgttctgcgtgcatgtgtatgcatctatgtatgtaaagatatgcaaacacatatgcatttggatacttgaacacaaaatccaatgtgctgaaattccacttttatgtaaatgaataacatttctgaagggagcattgtaagggccattgaggtcacactgtatttggagatcaccatctctctctccgctttccctattctgccaaatatctcctcaactgactgtaaagaatgcagatcaaaagtatttaagaaatcacgggtctacagcatgtctgccctttattttaaaccatctaaaatttatccttatcatgcccaatgccctccagtattctaaaggcctttgttgcataagcaatttctccattccgtggtggcttatctgacagtttcccatttaccttctacctgtttttgcacttgactttgaattttaaaactccactgtggtttgaaaaagacttaaaggatcttgaaggatgaaatcagaaacctagattagcaattactataaacctgccagaaaggaagctgttgttgttattgttttctatttgggccaaagcaaagactctgaggcttaagtgtaatccaaatgcatcatataatgaagcttatatcctggaaaagtgtctttatttttcactccactctgcctgactccaccatttcattctcactaactgaggatattcctaggatgatgccttttttattttattttaatctgaatcctgggcaactactccaacattaagcctcatttaggttgaaagaaaattcattttcttactgctttccctctcagctccttgtctgagctttaatcgcaagcagctgtgccaggccacacgccataccacctgagtttctgcaccctgaggtgctctctgccccaggcgaagaccacaaatgttcatcctgacaatggatgaaaccaggatgggtgccaaaactcacaaggagaaggaggtagcagctgatgaaatatagaggtgtgagcttcaataatagggttgcttgaatatgctgaccctcacttcccaggaaatccctgcaattcctaagtgctcctctttattccctatctgctacttctgatgcatattttctgaagattctgctcagttctgctcaatacggctcccctttatggttcattttgaccaaacatcacaaagataatattaatagctaatgctgtagaaagtgggctatgtgccaagcattgtcctgggcagttgctaaataatcactcattttttctttgattctttacaataaccttataagataaatactgttattgttccaagttacagatgaggacaccgaggccccgagaagggagacaaacttgatcaacattacacagctgtaattgatagtggagtcaatttacacactcaggccgtctggctccagagttggtgcccttaaccactgggcaacactgcccttggcactgattcttctgcgctctgtgctaagtacatgcggacatatttttgcaagatcttctcaacagctgggtatcacttttgcatttttatgagacatatatacaagtcccatagccagggaatgtaggagctggaaaatttattttctcattcagcaggtgtttactgatcatctgataagtcctgtgctcagtgctatagacacaatgaggagaacagacatggtctctagtgggggaggcagatgttaatcaaacgattcgacatataaagatatcatttcaaaattggcaaaacatataaaggcagtgcaaggaatcttttctagctaagggtgggaggtgtagagagggggcttttctcccagaggaaggagtgtttaagctaagatagcacccatctgggggaggctgcgtggtaatgggtattgggttagggagcagacagggaaaagtattctcagcaaaggggcataatgtgcacaagccttgctgtgggggaagcaaggtgaaattgtgacatttgagcaaccccagctaggctagaatgccaggagccaggggaggggatggagggaatgccttgaaatgaggcagaagagacgagaagttgtggttcatctgatcctcaagctatgttttaaatctccccgttccactgaccacactattatagcgagttcttagtagcaaattttgcttttctcatttcataaaacagttggtaaaatcccatttaaaaactctcagcaacacggcatgtatttcagacagacataatttcaaatgtgctgtgctttgccatctctaacatattcaatcatggccctatttgcagagcagacactgcaggtgaaaacccttgtaaacagtgaagtgctttctacacgcacgcccgtgttattagccttaataatcgggcttgttttggataatgcatgcgctctaacgggagttaatatatgttaagtgttcaaaacggtgcctggctcatggtaaacaactatataagtgttaactattgtttttactattatgcttccctttttttctttccccaggcttggtcggaggaggacctgtgcgtcgccgaactgttttatgtgttcatgttcctcttctctttcaggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaaggtaaaaaatgaggccggaaactcatgccagcatgcctaatccccagcccatttccccataatgatatcctcattccatctccctgagcttcattgagaggctcggcggcaggatagggacatttattcatgggtccggaatgagctggcagatcagatttggtcggtattctatcaagcttttccgtccaaggacaagattaaaatgcagtttctggctgtgtatttgcttagcctctttctcaagaatctaagaaccccacatctctacctaatgattccctaaaaatgtgttcccagggcccacccgtcccacctgtcccactctctcacccactcttgtctagtacttcatcttctgggctgactctgcggatctacattatctagaaaacgccggccctgctgggtgtcacacttgtccacacaccaaatctgatagcagatggagttagggacgtgttgctcaggagggacctgtggatctgtgagggaataggacactggcctcagcatggagggcgccagaacctctgtgaaacacgagagccattggccaaatattgtcattgaatatttcgtcaaacttggacaatgaggtccatttcccgggcctggtcacactgggagctctggcagtggaagaagcaccagttgccacaattggctcccggtactgctcagtgacattaccctgtttaggaaggttggtctttaagtcccatcaaggctgcctgagccgttccctcaggcctcaccccctgtcctctctgccccacatcctcagttttacctctaactgagcttctcaccctcctctctcccccagtgcatctacctcttattcctaccatatcctgccttaaaatgggtacttaaaaggcagcagattccaaactgcctttccttaagatccttagggatgtttcccttcctttacccattaataccctaatccccacagaataaagcccacaccctctagccagcatccccggccctcccggctccagccttctgaagaatgtctcagccatcctctccaactctccccgccttacctcttctccaccatccccgcagcccacctgaatggcattgcctctgtgggtgtccttcgggcattttttttctttctgctacttctctgcacagtcacaaccctgcctctcaacaccttctaaactcttactgatcctgcgaagcccatccaaatgccatgtcacctagaaggtcttttctccccattcctgttatttgatgtctaaggtatgactattatctactgccttgctttatactcatttctgtgcatttttcatcttcctcatctgcatctaatgatgatgatgatgatgattataatgactgactttagatatttactacatatcaggcatatgacacctattttctatgtattagttcatgcagtctttttaaactacaactctgtgaagtaggtaacattatcttatcttacccactttaaagatgaaaagaaactgagacttagaaagctgacgtcatctgctgaaagtcacaatcaagaaagtagcagaacaaaggctgcagcaagcaggtcactgcgattcctaaacccatgctgcaacccgtactatccagccaccagtatctcccagtaatactggctgattggtatctgctagagcagtgctttccctaaatatgtccatgaagcactgatccaacaagatgctccagggaagagggtttcaaggttaaatacctttggaaatcactgcatattggaacccatcttagagattcccagtgcatattaatagagtcaaggcactgagacattccatggcaaacagatctgtcatttcttaaatttatttgtgcaagaaacatctattggattttccatcctattaatctcacatgggagaaagttgttctgagaggaataagagactagtttgctatgatgatatcactgtgagaggtagcattatagggactctagtgccagaagggctagtggccagctgcctttttgtgaagagcctgtaaagaaatctggctgagtaggtcaaatggagaaagaggccgtatctgagcagttgggatagggggagtggaaggtgaaagcttggattgagtgtttgaaggcagcttggaatttgctgccttttaagtgggagcaaggtctgtgcagcttgggaccacgtaaagggcacacgccatgagacgaagggcagtttacttaccctcagacccacttctgaggccagcgggtgccttagaagagttcctgggaacaggtgtgcaaaagaaacacaccaagtgcctgatggtgtacaatgtcccaaaaagaaataagacctggtcgttgcctggattgtgacctgacagatgtttggcagcctcagagagtttcactctagtgtgattttccttccctaaaggattctcgtatcttggtttctctgtggcatgcacccacctgttttctccgtatagagtcattccttgggctcctcactccagtgtgcattcattctgagcatgttccctaatcacttctcctcgcagctcccttatcaaaaaagacaggacaatcaggctgactaatgaggcagatgcccatgtgaaaaccagctggcgtgcttcataggagctcagctcggggatacgccggcccaggcatggtttttggttcagggtaagcagtcatggaaggtgtctccaggaaagggaggtgaatccctgctgaatcccaagcagccttgatggccagaacgagagtgaaccccaatactggggtctagaatccaggagggctggtgtgcaaagtggcattagtacatgatgccaaaataatcccatgagagaagaaccaggtccccagaagaccacattgttccctctctaaaatgtgggttgcttaagggaaatagcagagccaagaggaaactgagcaggggctttgctcccaggtcataccaaaccctctggcctgatgccagtttcttgaagttctctagctcttatgcctttgtatgggctcttccttttatatctttgcctgaagagatcctagacacccttcagctgaggctttactttttgggaaaggctttcctgcctcctggggcagtggttcatctgggtacaagagacaaagattttctcaagccaagtatacataggctggaactaggacaggaaggtgttagactctcagtggctcacggttctgggggctgaacaagaggcaaccccagggcaatctctttctctgctctgggtttcttttataagctctgtgccagatttccctgtctcacctctcacccaaatttcatagacagctgatgggtttgactgatgacatttatccctcatgagtgtagcacttcatcccagaccatctcgggggtctctgtccattgtctaggactggatgtcccacccctggtacaccacatgattcccttggtggggttgtggaaggacagtttcagcaagagggccttaggtggaccccattgtggccggcttggccaggacacatgctagtcagaatgaaacgtatcctatcctgcctggattgagcggtcatcacacttgtcccacacagcacaattacctgctcataggtctgtgttccacagcagactgtgagctcttgagggccaaagctggtctctcagtcctgaactcccagtccctgtcaagtgcctgagatgcacgtggtgggcacaatgtcagtgttcccagaatgaatggatggaggcatttagacccccatcccatgtcattcaggggaaccacatcggcacagggaggtgcattccagcaaatgtttttataaactagaataatgggggttgctaatgactgcttgagtaatccccttgccccgagtacaccagctgtcttgctggccaattctttgtggaaagaggggatgtaggtgttctggatgctattggtgggaatgagtgggagtcctggggtatagagaccttggagactggttggctagatgcagattgtagaacaggactgtgtaccagtcagcatggggatctgagccctcagcaggcaggagatcccagagagaattcttctctcagagaaagaagaggggatagcatctgacagcagcacctagaacagtgcctgaacaccgtaggagctcaatctttgctcattgaattaattaatagacggagatagccatgttagcagattccactgagactgcatcttggcgtggagtaagctggtgatttaaattgtttagaacataatgtggaaaagattacatcaattcaataaatctgtactgagtgcttgctgcgttctcggtactgttgtttggattcagatagacctacttcttataagctgaatcaatgtgggtaagttatttaacctctctcagcctcagcttcttcatctgtaaagtgggtatccaactgccattagaggttcccatcccaagctcttttgggggatgaattggaacgattagagacaactcaaaattagaaagccgcgctgacttccagacaccccttctcacgtgacattctcttttccaggttcctcccaactctacttctttccacccaggataactggcatttcataacagaggaggtcaaaggcagacttactggtgttgatgtcatccttgtcatcttcctgacatccaggcctctaataacatctctgctcttcccatgtcaatgtcagcaccagacgtgtgaggaagagcaatcactccccaaatctcatacttctacagggctggactccaatcagaaaacattctaggagaacaagatgataaaaatagccaagatattctaaagcagccaggagaggcaagagaagcaatgcagggaaggcatgaagcaaacacgaggcccatatcaggccagtctcctggaagagggaggcccaggcagaaggtttgggctcctggagtccactcctcctttctcgattagagcttctcaagatttgtattgggcctctgtagaatctgacttctgtagtggctcaatacaaatctgtggatactcattagcaaacatccacctcgcagcagtggggtaaggagtcaatgatgtgatgcagtcatgtagctgtggatgaaaatggaagtaatttggagaagccagagctacatcctcaactctggatggtgacagtgttgggggtaaggactgttgcagcatcatgatggagtgtatgtttgggagagcctttttttttttttttttttttgagacagagtcttacactctgtcacccaaggtcctacgttgcctcagcctcctcatttgtaacatggggatgatgacattcttctcccttggctgttgtaaagattaaatgagagtatgatgcctatgatgatgacaatgacaatagcatgatgagctttgctaacaattattgagcacttactatgtgccaagtgccttatacgtgtgtttgccctttaatttgttacagtaccactatgaaggagatgctatttcaaatctccatttaatagatgagcacattaagccttagaaatgtttattaacttggctaaggtcacagggctgggaaaaaagtcaaagcaagactcaaaccaagtctattcaatgccacagactgtgagcatagccatttctgagcacagtactgaccctgggatatgcctgactgagaccttacccctccagctcaccccaagggctcaggcatggtggtatggtatcatttgtctcacacactccctggaaccctgtaatttccctcctggcaggctcttttgtgatcctgagacaagtgcttatttacctcaaccacttctgtgctccaaagaaaagttcagctcaccaggaagaatcatgccagcatttcccagtgaaccactcagacaagaaaaaatgcacttttctccccctgcgctgctttctagtaacattcggcagtaataacaataacattagtggtgatgacaagtcgagggacacagcacacacttaatgttaggcactttgctagtgctttacatataaaatctctgtgccctatagctactccacactgtaggtactactgttatgcccattgtattgataaggggtagacaaactctggcccacagaccaaatccatccttccacctgcttttgtaaataaacttttattggactacagccatgccaatttgtgtatgtgttgtctagggctggttttgtgctacagcagcagagttcagtagttgtcacagagaccatctggcctccaaagcctaaattatttactgtctggccctttacaggaaatgtttgccagtccctgatctaaatcctgaccctgaggattagaaagacctaccagctttcccaagatggcagagggaagcggtgagggatttaaagccagacagccgcacagcagactcattgtatagccccttagctgtatttcttcctgctctaggcttggcagagaagacatctctaagcatgatagtccccaacccttgacattggataatattcaacacagacataatgcttgacaggatgcaccatagaagggacgtgattcatttgcagactggcagtctagactcttgccacactgggtctcatctaggtgtctgttccctccctccctccctccctccttccctcccttccttccttccttccttccttccttccttccttccttccttccttccttccttctttccttccttccttccatttgtccgtccatccattcttctctgctcaagctgaactgctgtcttcatttttctccacgttcccacctcgacagctttgctcacaccgtttcccccatctggaatgccttccttttcacatttatcacagtcctacccatttttccaggcccggtatatctccttcaataagtcttccccaactgaggcaactcaccggaaattctttggcatttgtgctgtatcagcacaagcttttggtccctcccttagatcctttgtgcacaaaagtgagggaacgatggcatcacggatgatgtgtgaaccagagggaagagcaaatgtggtccctgccttttcatcacctaaagattccaactccatggagctctatcctttatgcccaggaaagagcctgccaaaggtctctgccattcatctaagactttagacaggtcacttaaactccctgagcctctacttcttcatccgtaataataactgacaccgagggttgtaccaagcaagggctggctgctcttcatgcattgtcacatttaaaggtgatccgtgacctccagacttcatgaagtattatgaagaccgggtgtaaagaggtcaagttagaggtcaggactccccaagtcctcttttggtcttggtgacctttgcgaagctcccctttccctctccaggtgccagtttattttttaatggtaaaatgagggaagggtggactgcatgatttggatggactcttcagggtataatactaaaatagtaaaaaccattttgcaacaaaatcatgttaaaaagacgttgggtgacttcaaaacaatgcgttgaataagccatgcactccagtgggtgaaatgcttcttaacatggaaagtagggagacaaagcattctgtggcttcaatgcaacaagatttggtggaactgtaaatggatacttgctttctgatcacttacctaatctgatctctgatcattaccattgtcaccagtcttgactctctgagacctgacatttgctccatgttttatgagtatttttcatcatttctttggttgcagggaacaaaactccaattcaaactggctgatatatacacagatgagctcatatgaatgggaaagtgtcaggtgtggctgaatgcaggggctcacaaatggcatcaggtctctgtctctctgtatcttcccctctctgcttgccctgtattggtgtaattctcagacagactcgttcattgtggtcagcagcagcctgaggctcacaaccttccatcttcagcttgagcaaaaagactcattttgctaagaggtccaataaagcctcagatttagggtctcactgtctcagtccagacctttattaattctgggacctgggcaatgaaatattcggattaggagctaggcttgtgtcaggtttccacatctggaactagggagggatgctcagcccaccagagccccaaggactgtggttaggactggtgtgatcaccaaaatatggagaaaggaatgaaggaatgccaagtgggcagaaacaatagctgaccaggaaacatggcattccctgaagattctgtgttctgtcacatatctccatgcctgtgcacatgtggtgctgtcttcttggaatgtcctttccctttttctgtttctgcgaaatttctatttaacctttgaaaacaagctcaaataacatgagttgtgaaaagtcttccctgactctcctccctctctccctctcctgcactcgcgctctctcgcacgtgctctctctctctctctctagcagttatcacccatggctccccttcactctctgggcactccaaaaaggcagacatagtattctgttccattttgcattcccagatcccagcactcaacctgggagataaagagtgctccctaaagctttggttgaaataatgaattgactaatttcagccctcagccttctgatgttattgttgatttttgtctcctacatcttcagtttgaaaacgaaatcatcctgaagctggaccacgaggtagaagggggccgaggcgacgagcagtacatgcagctcctggagtcaatgtaagttcagtgccctgtgtgtaggaacagcctgtgaaggtcaggtgaggcgggagggctcagaactccagggggctccgagtggctctgtcctcccctggagatggatctagaggctcatgggtattggcaaaactccatttttggaagaaacctcacatttctctctggagtggccatttctttggaactgatagaatgggccaggtgaaaagaatctttgctgtgttgggaagagggaaataatttaccaaaatgtctactttcattacttcttaactgtggaatgtgattgctatttttccttctatttaaatttttgacagatgttggtcatgccctacgtttactgagcacacttaataacttagcatgctattgtgcaatgtgctgtgtaatccctcctttaatcacacttactccctttgatgcccatttcacagaggtgggccctgaggctgagggaagtaagcacattgttcaaggaaactaggacgagctagtggggtggacaagctgcatcctgaacctggctctgcctgactccagtgtccaggccaggggcagacagtggacagagaacagtgcccaagaccactggacttggagtcaggacatcattttaacagctttatcgagatgtaatttacatgccatacaatttacccaaagtgtacaatcattgactcttagtatgttcacagagctatgtaaccatcaccacaatcaattttacaacattttcattactcctaaaaagcaaacctgcaccccttagccactgctctgccaacacacacacacacacacacacacacacgcgtgcgcacacacacccaaacactcccccatctcccctagccctaggccaccattactctgcattttgtcttgcctataatgttttcaaggttcatccatgttgtagcatgtttcagtacttaatgccttttaattgccaaataatatttggtaattaaaatatttggtaccatatggatgtaccccattttgtttattcatctctcagttaatgtatatttaggctgtttctacttttttactattcgtattgattcttctgtgagcatgcaggtacaagtttttgtgtggacataacgtttacagttctctggggtatatacctagaaattgaattgctggatcatacggcacctatatttgaccttttgaggaataaccagactattttccaaagtggcagctccatatatatttctaccagcaatgtataagggttccaatttctctacattcttgttaacacttgttaatatctgtcttattgattacagccaccccagcgggtgtaaaatgatatctcattgtggttttgaattgcatttccgcgatgtgtagaattcattgattttcagtacactcacagggctgtgcatctttccatgtgcttatgggtcgcttgtatatctttggagaaagacattgggttttgatcctggctctaccacttagcagctgcaagacttcacacaaatcacatgagtctggcctcagtatccccatttctgaaatgggaataataagctcctgtggttattgtgagaactgaataattataaagcatctggcacacagcaggtaaatgcttcataaatattcttccatctccaggacttgctcccagtttctgtctttgacagcttggtaattgcccccttctcccgcgaggccttctcctaaggcttaggaacatgacccagacatccccacttctcgctaagtgcatattctctgatttctataattctctgagatcactctggtttggattctttcttcaatcctttttgaatgttttaaattcaataagaaaggcaaactgaaggccttgctctgaccccctacaatgagcctctcgaccctgcccaagcaggcagagcccagaggacaggatggcgccccaggcagtgccatctcagctggcccctgtccccttcctgtcaccatgcatggccctcactaaacacttagaatgcaaatgccatttggccagaaggagaaacccactgtctgcccctcaggtggatatggagactgatgtatctggggggaataaacaatattctggctgagtcagtgtttatcttaaagttctaaacaagaaaatcaaaatattgaccagaagtgaagcaatgtacagtgctggcaatttccatttttataagcggatggggctctgcggcggtcttcagatgatcagcagggttttcaaatccttcctgagtgattatttataaaaggagtccttagaggtcaaagaaattaaagacagctcattatttttctcctgaaacagaggtgtgaatgatttttgcacaaaacaaatcaagcccgacacagggagccaggtccccatcagaacatccatggggcccctgtgcctgctccatcctttcacctctctgagtctcagttttcttatctgaaaattggggataaaatattatcgagcccttagagtttttgttgggagtctagcaatattaattattagtagtacagattgattaggccttatctgaaatgcttgggacgagaagtagtttggatttgggatttgtttttcagattttgaaataattatacttaatagttaagtgtccctagtctgaaaatccaaaatccagaatgctccagtgagcatttcctttgagtgtcatgttagtgctcagaaagtttgaatttcacattttcacatagaggacagtcaatttgtattacttacaggtggatagcattgcgggtttttgaagccatgagcctgcctatcttttctcccctaggctagtcatctcagttcctccagcctttcctcccagcccctctttcagggcctcactgatacacagggcccccactgggcagatacagtcctgtgggcacatggcttggatggggccttggtgaatagagcagagctactccccctgtggcaactgcagccttgcataggaacacaaggtttaaggcatggagtggggctgaatttcagtcctcatgtgctctgcgcagtgcacaagctatataaccttacacagcactccagttctccctaccctcagagctctctttggagcccacgctcattgatccacgtatatctgaaagtgtaagtctcacattgaatggattcataagacacaccgctgcctttctgtatttcattcctgcgaatagttctagaagtggtgagggaatcggaaggttgaagcagatagatgtatgttcttgggcctttatcctacccagaccctttcaatccctggaaaaggacctgtcacaggtcatttcatttcatttcaaggaatgaaagaaagtccagtttcattagcactgacagagagggggagtctgggatcctccctctaaaagcctccaatgccaagtgaaaatcaactgcagggaggagtgagccccctctagtcctcccacaacaggagcagaagcagtgtggcaagtgtccaccacccttcattccactgcgtgaggaattacctatattttcttatgattcccaaagcttttgtcatactctgttgtgggattacaaggtaaacaattaaacaggcttagcatgcggtctggaacacaggaagtactcaataagtggtagtatcattatatattatggttaatttttatctatgtttcccatgctagactgtgatctcctggaactctgaatccctagtttctagaatgccacatgttgagtggaaggatggatagtggatggatgggtcatttctagccaattttcccatccatttcaccaatcctagatggtttgagcacctttcttgctccatgcataaagaataggaaaagaaagaaagccaagacctttttcttctaaaccctggtttctccaagtgtggtccattgacccgcagcactggtatcacctgggagattgttagtaaggcagctgctcaggaaccagcccagatgtgatgaatcagaatctattaacacaatgccccagtgatccccatgcacatggaagtttgcaaagtcttggacaaaaccagttgttctttttttttttttttttgagacggagtctcgctctgtcgcccaggctggagtgcagtggcgcgatctcggctcactgcaagctccacctcccgggttcacaccattctcctgcctcagcctcccaagtagctgggactacaggcgcccactaccatgcccggctaattttttgtatttttagtagagatggggtttcaccgtgggagccaggattgtctctatctcctgacctcgtgatctgcccacctcggcctcccaaagtgctgggattacaggtgtgagccaccgcgcctggccccagttgttcttaatgttagttccatgttggaatctcctagagaatgtaaacaataaaatactgctgcctgggtcccaccctcaaagattctaaggttattgacctaagttgagcattgggctttgtaaaagctcccctggtgattctatcatgtgaccagggctgagaacctcaggtctggccaagctcagaccccgagatgtctcctgccctggaaagctttaaaaaatcacacaccaaacactgggaagaagctttgttgcattgtcattagggtggcacacagggctagaagtgactgtcccaggaggaggcatgcacagctgtggctgagccagacaggtctaaatcacagggccatttgcatctcccattgagagccagggaacaggtgcttctcccagagtgaagatggatttgtcttatcacagccacagtttgagacgtcgccttcttgcagcttggcttggcttcttggaggaaatgaccctcagaagtccttgcttttcttacctttaccctcctaagggcccctggagagtttcagttccatggggagagtagacagatacaaatcacgtggcctgcataatgtctacttgagatacctgggaacacgctctggtgtttctctgtgggaaaaatatctcccctaaatttaacaatgattggcttgattcaacttactatcacactgatactgggaaggtcctttaatctttctcagccttcattttctcacctgcaaaatgggggaaataattctcacttatcagaattactgtgaggatttcttaagaaaagtgactagtacagtgtctggcacagaataagtaattaagaagaaatagtcatcaaacaaaattttaacccatctgtttctccccacctagtctgtgggctgccagacagtaggtgtggttcttttctatattgatgtctttctctctaccacacaatgcctagcaactaatagatgcttaaagatgttacatttttatttttgtttttaaaatttagaatataaatactaaaacaaatattataattttaaaaaataatttacacatacttaaatagaaaaatggaggcttttctttcctattttcccacctaaagccttgttggaaacagccatcactacgagtttggtgtctatccttgctgactgtacatggcactttataagcacatagagacacatgatggccatgtacacttgcacacacatgcagtgttcggcagtagagacacggatgctggggccagactttttgatattcctgaccatgtgaccttggacagcttagtggacctctccatgccttcgtttccctatctacaaaagtcccatctcataaaattgtgacaggaggttaaatgagttaccatttgcatgaggtttagaataacaccctggccatgctaagctctatgttagttggttaagtgaaaagcaaatattgttctgagacttacttttctcacctagctctatattttatagagcttttcatgcccagacatattgaatctctccaatatttttaatgtcttcatagaattccatttggtgaatatactgtaatttatttaggcctttcccaattgatgagcatttaagatggttccatctatttcactattagacacatttgtgagtattatatctttgcatacttctgagaatatttctgtagaacagattctgcaaagtagagttgtggggtcagaggatatgtgcatttacaatttttacagatactttgaaaattgcttccccaaaaaagttttcttgatttattctcagcaggggtgggtaaaagtgaccatctcccccaccatcattatctatattggaaactattttatttttattttttcccattctgatgttagaaaaaaaattgctgcactatatggataaatacatgaataaatgaacaaaaggagcagtcagggaacttgggttgactgactgattttgcatgtgctccatcccaccgcccactggccccagcacagtctttctccccagccatgagctcactgccctctggtctctgccgcagcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcaccgtgaacctgctggtgcgtggggctggcgggtccaagtcagaccagaaccctgtgggggggcttgggcttggctttgggtctcacgattgttcttcatagggaagcagtgcttaagggctttggaaagcagacaaatgtggaatggaacgtctgctgcgctttctgctagctttgtgtcttgaggccgtcacttcacctttctatgcctgcctccttatttataacatgagattaatgcatattccctttagcactcaacacatcacatggaaggaagatgacagtatagactggctaagagtatgagctttggagtcacacagcctctgggtttccatcctatatctgataattaatgggatggacaagctaaggaaatgttctgaagtcttagtttgcttatctattacatggagaaaataatggttccaatttcattaggttgtgttgccctggcccatggttaaatgctcactacgtattagtttccttcttcttatagaatggagtcacactaataactagaattgctgttactatgaaccaggttaaccagagaagctaaccccagacccaagttcttaacccctatattccatgagctcccatgggctggctgccaagcagcctctctcacacgctctgtgattcgaccaggagacaggtaggtaagcagccataatgcttcatattcaccgtgtcatcccaccttaaagtggtttaaaagaatgaagttgaccaaaaggccacgtgacatccatcacatcaacctccctaccattcccaaggctcctgaaacacaaaacctgtccccagagctctgttgtgtggcctccctttaccctaaatagactttttttttcaacagcctagatattgccattgattttctagaatgccaaggagagtttaaaaatcccgatgacagcagaaaggaattcattgctaataactccaccaggcccagtttacataaagatcatgaagaggtgttttccacgagctgagcagcttctctctaaggagagacagagttggttgaggaaagtgacctttaacagccagctaagatcagggagaatgcttgggacagacagttctccaagcactgagacaccactagtttttagtgcattgcttaaatatggtgtcaaggaggagggtggggatggaggtggtatcaggacaaatgatgtccagtatgatttgccacccattgactgtgtgctctggaacatgtcaccacccttctctgaccctcaggtgcacgtgggtgtgctgcattaaaccaggatatacacctggtgtggctcatggattggaccaggaccacctggctcagaatctgtagggacttgtttaaaaaatgccacaggattaggatctctggtggtgaagtccagggcagctactaatctaaatggcccctgagctggaatagggacctagattcctacgtattgccaagtttaaatgttttggcgacagaatcccatataattcctgatagttctgcactatcaggaattctgatctcttactattaccgaggtgctaccactcactttccaactcaggttctttccagtgcaaggcctgagctttgaaacatcaagctgggctgcctttcaatgtgggcctggttaaagtagactaccccagtcttggcagcccacctctcaatgcagcaaaacactgaactgcccctcctgatatgtgatggctgagacacatcaagtcctctctgttcctttatagtctaagggtcagggaagtgactttcaaagcagaatcttccaattaggctgtttgatgcatctttggggcatccaggaaaataagtttcttattcctatctcagggtacccagatactagacagcaatcttcctctcatcttcatcaccacacccttgaccgctgtgatattgcagagaacaacactcatcattgtttttcctcccctacctagaatttctacaaagataacaacagggaggagatgtacataaggtaagattcatattttctaaaatccagacctgctgtgtcactttcctgctcagtatccatcgatggctccctgctgccttcaggataaaatttaaacttctcttcttgacattcaggccctctgtgttctgattcctgtcaatttctccagattcaattcctttcattctcccacagtcagccccataaaaccacgtgaaatcgtctggccttccatgctgtcctgttgttcccacagatcatattttccttaagagtgaatactttgtgatttgaactgttggggtgcatttgcattgttgcgggcctgaccttggataaattactgtgaagcctgagtccagacatgtagtaagaccattgactagcccagttttgaagggaaaaaaaagatactaagatgcatgatatctgcatccttgtaggcatttaaatgatattatttgaatatatcatgaaggttttttggggacattagcctgaagcaaagaactcctttgccagtttttctcagaatctcatatttttttctgcaatttaaaaattattgttacttttatttataataaaaaatatatacttattacaaaacaaaaataaacttataaaatatgggcaagcaacacaacaaatgaaataaattcccataatccatacatatttccaggacttttttatatttatatatacattgaattctatgcatgcatattttttgcaaaaatgggtttatattacttgtaatttattctttgctttttctaacttgacaagaactccatgttgacagatgtatatcaacatcatttttaatgaaactataaaattttttccagaatatatcatcatttatatagccaatcctatattgttgaacatttagattgtttccaactttttctacaataaaaagcacaaaaacaaattttttttttttttttttttttaaagacagagtttcgctcttgttgcccaggctggagtgcagtggtgcctattcagctcactgcaacctctgcctcccgggttcaagtgattctcctgcctcagcctcccgagtagctgagactacaggcctgcaccaccacacctggctaattttgtatttttagtagagacggggtttcaccatgttggccaggctggtctcgaactcccaacctcaggtgatccacccaccttggcctctcaaagtgctgggattacaggcgtgagccactgcgtccggccacaacaacaaaattcttggacgtatacctttatgcacatccttatgaggctggagcccttgaggtagagtcaaccagaagattgaggagcaaggtatttacagggcttttgtcacattctgtcagagggcagaaacttcaagtctacgctcactctgctattacggcagatatatctaggtacctagtttagcattactccagaaataggagctatcatttggagaaaaataattttataggttgtcctgagtttgggatatttataacatcactagtcataccttattgtagcagcacaaagctttggggtctgaaggacctcggtccttgcctcactttttctgtaaccttggataaattactcaatctttctgggttgaggttttcctacctgtagaatgtttccgtcctaccttctgttttgaggattaaatgaagtactataggtaatatggctgccacatggtttcctccctccaaccttgtttctccccttctcattttagaaacacagacggcaaatcccagacctccacaagctttggagatttgaggcccgtagtaatctaagaaaaccatatttatctaaaccagactgcaaacagggtatagtctgaaaatctgttctgtttggcaggcagaatatttaaaaacatttttaattggctgccaacatttaaaaatctggagattttacataaaaatcaaaatttcccttttctcctggaaaactcagaaggtgtgacaacactgggccctcgtcctattctgacgactgttagccgaaccgggtggtggcagccattctggacaggcctggagcactgtcatcacgacatcatctctattccctactgtgctactccccgtccacctcgctcaagcacctgccatctggaggtgcttgagtttggtatccctggttgagggacgtcttctttttactagggtgccttcttttgggttctgtagcagatcatcagacccttgagttaacaaggaagaggagagggtgccaaaggaggagttgaaagtagcagggaagctctcccctgggctgctctccccaggttttttgaactcagccatctaggggtctaaggcatcgaggatgggcaggaggagataaggcagaattaagccatgtgtgcacacacaggtgtttctaaattccaaactctctacatggaggtcatgtgcaatttcacggttaactccgattggcagaacgttaggcgggaggaaagtggaaaggctgtgtctgtgaaagcagaaatcactaagcttgaaatctgcttctggctctggctcttttaacctggatctcagttttctcatcttaacagagttattggaaggatgaattgataaaaatacatgataataaaacacccattttttgaatgaatgaatgaacaaatgtttctgcctgggaagctctcccaactcatccccttccccttcagatcaactgttatgccatgggaacctttttagaagcccctcttctccccacctggataaagcgtgctctcctagtaccatagaccactccttcacaacacatatcatcgctgtgttcttgctgttatgtatctgatgatttgattcatgcctgtctcttctcctagactctaatcccaaaccctgagaacagtgcctgcgtttgtcactgtttatctctaaggcctgttatagcctggatgcccggtacagctttgctgaatgaataagtgaatgaacaaaagactgccagggcatcccagcacagcagctatcaaatcaccactaggtgacctttcctcgcctcaaaatctttggcggtccctgccctgatttcaggcagcctacatttgacccactgacccattttatgtggcaggaacactgaacattcacttctcctttggtgagcttcgtgcagaaagcctttttcccaaaaggaaaataaaccagagcattgagacacgcattgagtggagatacccgagaaaccctgtgttccctggtgtgagacagtgggtcagggtagaatgctggcaccatggcaggcattccctgcctctcctctcacatgaagaaattagcatatcccctcaccacattacttagagttgggtttaaataaatcctgctaatgatatgcaggtcaccgatgcagtggttcattgcctctggattctgtttccaacggtggcaggagagaatgttttgtagaggaatctagttcacagtgataataggtaataactgtcactgctcagtgccggctacaggctaatcactttcagtgcatacttgcatttcttagcagcaatgcaagctgtcatgtattgagccttttgtaagacacacatggtctccttggccctttatatgcccagtcactttatagataggttctgtgaatgttgccattttacagatgagcaaactaaggcacagagaagttaattcactgccccttaatacctattatggatcagttatctaagaattttccaaagcgcccttcctttgtccttgttctcatcctcagtaccctcagttatattgccatctcatggttcataactgggatctcacttttcaaagggacaggaagttaaaatgtgactgcagtcaaatagctaactcttcctactgacagctcaaggtctacatatgaatatctattctccagccccgatccacttccttttattaccaaaaaatgcacttacttacacccagagaactctgcagagaggggtaggaactgccccttatagctgctgtggcttgttcatactccttcaatgacacagtgattaagagcaggcatcatgtcctgactcttctgtttattagcacagaactcctgataaattgtctctctctccttcctttatttctcttgcttgtcatattgcattggccagaccattcattatcaagttgcatgttagctggaatggcacctaacttatccaggcaatagttctctcatctgaaaagaggaattcctgagactcatctcatagggttgtcataaatattaagtaatctaagaaatttaaaatagttaacttagtacctgtcatgcactaagtaaccaacacacactaggtgctgtcattacccacacaaagttctggttatccagggaggaggactttcttgcgacccagagaggtgcccagttgttctctgggctcctgcttgtccctgccaggtgtctccttttcactgcacctggtagcttactgcatattttccctcaaacaggtacctgtacaaactccgcgatcttcacctggactgtgacaattacacagaggctgcctacacgctccttctccacacctggcttctcaaggtacagtcactttgggtgaagggcatttatgctgggatcctgacagggcctcacagcaagttgaagagtgaaaaaagaaaaaaaagaaaaagaatccaaatattttgttttgccctgtgtctccaaactcttgagctggcaggatactttttgcactgcttccctggtcacatgtggttttgagtgatctttacatttagcaaaaacaacccctcttcgagatacattttgcagctttatataatatctaaactgctattaacggtaaatcattggcatgcccactgagctgcattccttctgttgagaacttagctgtagctgggaaaaaaatcagaatgatttcctttggctttgggagagctgggagcatgtttcttaggggttcaatgtaaatatctacaaacaacacacagagagccaataaagagtaagataagtgcaactcaacaaaaaccaggagccttcacaagtggaaattgcagcccagcatctctctgactgacactggcacccaggacaggcagggggaagctagcagaggggagggtgtttgcagggcttcatctgactcctgatcactgtggttttaatatttcatgttccctcatttgtctgttttgggacttgggacattagtgctgcctggagggcaacctccaaatatcctgagtactcatgcctcaaaagggcagcctctccagtggtaccccaagtttccagaaataagctgagttcaagaaaggaggagagatggaaaggacagggtgtgtgttggcagggtggttcctgcctttaatcctaggaagacacctgctcttggcagcctctcggccctgtgtgacttcctgtgtcttctcttcacagtggtcggatgagcagtgtgcatcacaggtcatgcagacaggccagcagcacccccagacacaccggcagctgaaggagacgctctacgagaccatcataggctactttgacaaaggaaaggtaatctgtccctgcccaccccccgtggggaccctggccactggaaggatggttctctcccataccttacatccaatccatcctcagctctgtcagatatccctgcaaatcctaactctgatcacttctctccacttcctctccatctccattccttccacctccatgtaaggcaccgacattgctcacctggacactgcgatggatcctaaacaattttcctgcttcctccactacccccaacagatcatcctccatatagcagataggatgatcataaagcatagattggattatgccattcccccactcgcagtttctcaatggctctcccaatctacttaaaacaaattacacaatccttcccatggcccatgaggccccacatgagctgtgccctggctgcctctctcatttcatccctgctggggtccctcttgctcacgtgctctatgccaagctcttttcaaactcagggactgtgtacttgcttttcccagctggaagcattcctccaccatagctgcccactggaacgctgggctccactcagatgtcacatgctagggaggccttccctgaccaccactaggcaaaccagcagcaccactgccccaggttacccttatggcttcttcaaagcacttgttcctatgagacatcatcttgttcattttctttttacttgtttattttctggctccccaatttagaatgctatgagagcagagacttgtcttgcccactgctaaatgcccagtgactaggacagaacctaggaagttcccagtgaatatgtaggcctatgtcctaggttctgttctaatcactgggcattcataaatgaatgaactgaatggataaatgacatgcagtgtcatccttgatctttaaacagcaaggatgcttggctgggtttggtcaggagattggccagaccagctgctgctcagctccagcctctggtggaccttcaggaagtaccagccccaaaactgccatgcaccctatagagaacattgctcggtggccacatgctcaagttttggggccagatggcccatctgcaatccttgctcctctaccacctactcttcccttgacctaagagactccaattccccacccataacagtgagatgctaatagtaccttctttctagttgtaccgtgaaaatagagtgagaaaatgcacgtagagcaccctgcataggacctagtgcatagtaatagctggtgaaatgtcagtaaccgtcatcattatcctactccaccgcttcctctcccaagcctttcctgagtcctctggcttacctgcagccctccctctcctctgcaatgcaagacctcttacagttcatcaggacataatttagcactcaatttgggcctgtcctgtcactgtagtttattgcatctgtcttagtcggacccttctaccttctctggaaagataaaatgaggtaatgtctgtggaagggcttataaattcccaaggctcaagcagttggagagcactgttttcataatttacaattataagcctcttgagggcagagatgctgccatcccttgaacctcctgccctgctgggtgtcaagtcagagcttactatttgtttatcagctgattaagtatgttgcagtgtgagagcctaaaagtacacgttgagctttgtcctcagcaagatattcaattcagcccactctgtgctgagcagagaggaaaaaggcatgatccccaacctcaaaaaacttactgtctagtgagcaaaacagacatgccaataataatattttttgcattgccctttggcattgtgcaataatggggaaaaaggcaaaggaacagggtggtgccaaagtactttgagagcagagaggagggagcagatgggtacagcttaccctgaaagccactgctatggaagctcctagaaggaagcccaaactcctcagtgccccctcagctttcgttccctatacctcctcagggaggctcattgctccaggcacacatgctggctttctactccataagttcatcttgccatcacccgatagactcctctaaattcctcaaaaccaaacgatttcatctattgatgtatatcctttgtccacttatgttccatgagagtagagtctgtgtctcgtccatctttatatctgtttcattactgcacaccacaccatgcccagaacccaccgtgtgcttagtaatgaatgtgtaagactcagagaaattagtgactgttggaggtcccagtggccacacaggcagacctgagaggaaatcccaggcacctgacttcctgccccgccctttccctggtctcttagtgatctcttaacccatggggagagcgtttcttttccctgttcacattatggtgagaagtagacaaagacctatacttgagcccaacagtcccctggcccagcccagggggattaccccaaacttcaggttcaaggtgaagagaaaaccccagcctggcccatatacttgattcctcttcccagcacataaagcatttttatgctgcttgctgagctgtccgtgggtttacagccgtggcttctccactcggcacttggttttatttatttttatgcttggatgcagagagagcacttttgctacacagctcacactgcattttggcaacctcccctctctcctcctcctacctcccccagcttctccatttaggtgcattttccattttaaactgaaggtgaaatgtaatggctatccctagagattgccagcctccggtccaccctgcatctcccctgactctgcagaccgtcctgacctccttcggtctaagagagtgaggtgatctattgactctcgtctaagacagaggagagaagaattatccactatgtctagggtttctttgtttagaattttttctcttaagatggagaagacctactattaaaaaaaaagtcttaatttttttttaatattctagcaccaccccttccacctctatgctacctgactctacttccacacatcaaataatcccattaaaaagtgacaggattggcagagtagaagaatcccaggactgcatatcaggagaactggggcctggtcccaactttgtccctggaaactctgaccttgagccaccttgctcacttctctgtgaaccatttatctttggaaaagggggccaacacctccctgaggaggctgagggaatcaaaggtttccttcactaaacacgagcacgtgggaggcagggactgaagagcaaggccctggagacacacacgggggcttgcatcctgaccctgcttttagtgaggcgttttgacccgggacaggttgctgggcctctctgaacctctgtttctgacccggacaatgaagatgctgtcagttacctctcagagtggttgtgaagaatcagagcacgtaaataaagggtttagcctcatctgtgcctactcaattgtttatcaagaaactccggtgagaggccagaggaaggtcgtcctctctaggaagcccccggcccctctgtatgggggtggatctgggtcagagcaaggtttcccctcagtcccaggaagcacagctacgcctgagtcccttcctcagcaagcgctctgcaaacccggtggtgccacctcacctttgtccctgtgaccttcctgtagatgtgggaagaggccataagtctgtgcaaggagctggcggaacagtacgagatggagatctttgactatgagctgctcagccagaacctggtaaggcatcccctgggaaggctgaatgccctgcaggctgggtgctcagggcctcagctcaccccagatcctggggagatgggcatgagggccaggcggggttagggaaatagaaaatgaacggaagtaggacctgagagaggctgtactgagcatctcccttcccgtggggagtattttcaaagagagatgtcgtggggaaatgcttcggtgacagctcctcaaagggagcattgagtacctgcgaggggctgcaactgccaccgctgctgcagccccaataaacgctgtgttacatttgcagtaaaagttccacaaatcactaaaccaattaaataaaaacacaaatttgtgctttctgattaacagataaatcacattaaaatgctccccatctggttactcccattagcatctccatgctcaggatttggtgggggaagtggagagtgggggaagccagcccagccaatcctgcttgtactgcagaagcctgggtttggcggggagttggactctgcagggaaatgcagaactctttggctgcttccctcccgcccatcctccccacatgttttctggctgcctgagcagcaggaccccagggacccctcttagcccacttagagaggccaggccagcgacttacagagtcagaatgttaggagaggattgatagcttttggtggggggaaggtatagtgatcttgttaaaaacagctgagctgttaactgttttcactgtttgtaagataatacacaaatacacacacatgtgcttgcaccaagagacacctaatacctgccccgcgtgtacctccacatagatgtttgccaatgcctatgcccaagacacacacacatacacacacacacacacacacaggatacattcaagcacacactaatgtatgtgcacttgcctgcacagagtccacatcacacaggcccccgtctagatccacatatatcttccagattgtatcaaatggaagatgccatcgatcatacaccattctttttattgtgccatgtcatgattccttcagggccaactgcagttataagatgccattaggtgtaaagtaagattcagactgtttccagagatgttaaaatacgaaaaacacacacctcttagaatagatgaaatgtcttaggtatacatgcacaggaaaacatctgtatcagggggcatttattcattccatagcctcacaaatccatgcccaagtgtgcatggaggtgggagcagagatgcaatgatgggaaccctgaatgcaactaactgggttcagctccatgcttactggctgctttacgagataccatttctttatctgcaaaatggagatactcatgggattattacaagggtgattcaagtaaccacactagtgcaggtagagtgattaacacagtccctggtatactgtaaatatagctattactattgtgattatagacatagcacagatatgtaaatatgtgcacatggctcattggctctggtataatgaaaatgtcttcaccaaggcctctttgagttgaatgtgcctttgatacacatctgtgttgcaacaaaccttgttttcttcctttagatccagcaggcaaaattctatgaaagcatcatgaaaatcctcaggcccaaaccagactactttgctgttggatactacggccagggattcccctccttcctgcgggtgagtttgggggtgacttggacaccaggcgagagccccagggcctcggcatctcagcggtccttctatgctttgaggatttgcttgtgctcagaagcggtgctcttctctgtctgagtgctgcccccatccccaggagactccccagtcaatagccctcatcataatcaccagcatttctcatctactgtgtttctctaactacacagcaattacagctgcctcgtgaggtagtgagttccccgtcactggaatgaggtgttcaaagagaggctggaggatgtttgctggcagagatttgctttcaggagttactgtagagcagtcgttctcaggctttttggttccagaaccttctttctctcttaaaaattattgaggatcccaaagaacttgtgtgtataaagataatctctatctacatttactacatgagaaattaaaactaagaaaatgttttttgaagtgttcatttatttgaaaataacaataatggtccaggcatggtggctgatgcctgtaatcccagcactttgggaggctgaggtgggcagattacttgagctcaggagttcgagaccagcctgggtaacacggtgaaaccctgcctctacaaaaaatacaaaaattagctgggcgtggtgatgcgcacctataatcccagctatttggggcctgagacaggaggattacctgaacccaggaggttgaggctacagtgagtcatgatggggccactgcactccatccagcctgggtaacaaagagagaccctgtctcaaaaaataaataaaatcttaaaaataaaaatagcactaataaacccattacatgttaacataaactgcaattttaggaaaaatagctctattttccaataaaaaatcagtgaaaatcatgagattgcttcacatttctgcaaatctctttaatgtctgacttaagagaagacatctagattctcatgtctgcttctgcaatctgttgcgatcacacatcacgcagcctcagaaagctccatcgtacactcatgggagaatgagaatgaaaaggataaataacagctttcatgttattgtgaaaacagtgtgatcttgtggttcctgagagggtcttgggaacctcaagtgtccctggagcacagtttctgaaccactactgtagtggcctatttacccatcacgtgacgaattggattaggtcaccagtaggcttccttcagtctgtgagcctatggttcaactctggggtgagggaaatacaaaagaaatggctaatctgatctccaacctcacttgatttagtctagtcaaggagataaatcactcacaattattaatcaacaatcaatgtggaagtgagagtgggcctgcaggagtgattgccatgagccgcagagaggggtgcaggtttcatggaggaagtagaggtggcttcccaaacctggctgtacgtcagaatcccctggagaacttgttaaaagtgcagactcctaggccccactcccacagatccacagattccatttcttgctctgtcgcccaggctggagtgcagtggcttgatctcggctcactgcaacctctgcctcctgggttcaagctattatcctgcctcatcctcccaagtacctgggactacaggcatgtgccaccacgcccagctaatttttgtatttttagtagagacggtgtttcaccatgttggccaggatggtctccatctcttgacctcatgatccgcctgcctcggcctcccaaagtgctgggattacaggcgtgagccaccaggcccagctgggaatctgaatttttaaaagtgtcctaggctccttggatgatcagccaggtttggaagcactgatatgtagagatgtatgacagatgtgtgtttggacagaggaaattaggggccattttaggcagtatgggtggcacagatgtctagagcagagtttctcaacctcagcactattgatattttgggcctgaaaattcttcattgtggggctgtgctatgcatcgtaggatgctagcagcatccctaaccactaccccgtaggttctagtagcatcccccattcccagttgtgacaaccaaaaaacgtttccagatactgccgatgtcccttgggggacaacatcacctttagttgagaaccactgatctataaaagactaacatggtcaggaaggataaagagtgtgttttcacaggcttagagccagaagccaggtgatgaggatatgaatgctgaaccattccagcccacaggtccagcccacatggcccattacaggcaacggggaaatgttgtggccatgtatataggagagtgggtgtgacacagtgaaacctgagtgagtaattattctggaagctgtacataggatggtaagaagaagaaagttctcagcatccatgatcttcccttcctctagacccagaccctttaaagtagtgatggcctctgctaggtcagtgagttgagcccttcctttccctgtggggaaaccaagaggagagtgatgcactggacatccccatggaccgtggtcattttacaagctccccagctttgcttggcccctttcttcacacctgggtccccaaatctctaatgagcatcctttctctgcagaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtgtatccttggagaatgccctagccaaggggccagacctgagcagccctgccagggctgcagcccacaaagacccaccttagagctcagggctgctgccagaatcattgcagtggcgccatgttgcaggaacatgcaacatgttctttggatccatgttctttggatccttttctggactcttcatgatcctggcatcttgagctctgtttgctttggaaaatttgtctccctttggtgcttttcaaaaagtgcatgaatgtgagctagaatgtcaactgtataaggaaagacgcttgctctggcgtgctccaacttgctccctgcagtaagttcccatctcccacggtgcctggtacagagtgactcccagtaaatatttgagatgagatccaaagaacctatctcaatacattgtaaatgttgcatgcattgattaattcactcactcactaattcattcttatattgaatactctcaagccctgactctatgctaagcaaggtgcaagggactggagattttcattcacaaagtggtcctacgttcagggagcttacagtgtagcaagtaaaagaggcgttaagtgactaattgcactattccatatttatttacaaaaatataatctgtgccttgaggaagccatgcagagtactgtggttgggaaaggagagaaggtttccttgaggaaggtgatgtttgagattactagcaaccaaagcttagcaggaagtggggagaatatcccagacagaaggaagaacacttgtgtgcagaggcctttggcaggaaggagcatagcaggctccacaaactgaaatgacgccatattgccatcataataaaatcaaaactgctaagcaaggcctgcaaggccatccatgatctgacccctgcctgcctgtccaacgtcagccccacccccatccttccttccctttctcacatccctctgaccacagggttcttgtttctgttcctgtgatatgcccagcttgttcctgcctctgagcattcatgttctctgttccctctgctttggatgcccttcctcagctccttacatgactagctgtctcttacccatcagatcctagcttggcgtcaccttctggaagaggcctgccatggcctttctattgtctaatgtggccttctctgaactcttcatgaccctggtatctcaagctccgttttctttggaaaatctgtctcaatttgccattatctctggtgctttttaaacgtgcatggaggtgagctagaatgtcggctccacgagggaagatgcttgccctggcttgctccctgcagttaagtcccccactccctcgtgcctggtacaaagtgactcccagtaaatatttgttgattaatagaaataaaaagaaaacaacacagaaagaggaaagaagaaaagagataaataaatagagaaagggaggaaggaggcagagaagtagccagctcacttggagtacatagtacacagaagtcacatggggtgatattagggtgccgtataagtgggtgtcagtgtggccaagcatggtctttagtgggccagcagccagtgctgggcaacagacaggattcgcatggcagggagcatataaatgcaaggatagggccaactgctgagccagggagcacattaactcagcctaactcccagcattgcaccgtttagcacaaattaagttacagcctttaaaatggggttgacaggtcgcaagtctggtctgctcagtctgctgtactttaatccaaatattcttctctccggtggtaaatattcatctgtaaccttttcattatgcttgcctgccctgcgtacctgctctaccatggttatttgcaggatcaaatgcaactggtggtgggctgggctggttacaaatatgaatttggttataggcgagacataggattagttctaaggcttttctaagtggatctcctgggattgaacagctctgtggccttttaacatgaggcaagggagagagtacgtgttcctgggacacaacatctcccctggttcagtgccaggaggcaggtgcaaaagaaaaggggaagggctaatatttgctaaatgtccttttcttgagactgagggctttatatcctataaaaccctctaaggggagtgttaattttccctatttcatggacaagaaatatgtggggcagagatgtaaagtggtttgcctaaggttacaaagctagttagtgatggaactggtacttgaaccccatgatctgtctgtttcaaaaactatgttctagtacatcatcctttttaaaaagattgatgaacagcattctctttattaactgtttaccatgtactaggcattttacacgcattgttgttttaccctccaatacttatacaagttaggtattattgctttcctgcattttgctaataggaaaactgaggctcacagaatttaagcagcttgcacaaggtcacaactaggaagtgatggagcttggatttgaactcaggcctactttttgacaaaacattgagttcttaatgctctcttctcttgccttcacttgttaaaaagctgataagcagtctgagagggtgacagatctcatttctcacttaggtatccaagtaggaaatgataattgaaagccaaagtctctttgtagggagtctgcagttgcccagccctctggggccccagttccgcgcatacattcagcctgtggcataacaacctcaccagccatcctcctggtacaacttcaggggacttgtgtcacgggcttccctaggacagatttggattctcctcttgggccaacaccagtggctaagatcagtaaacatgacctagaaccttctctaaaacaggggtctgcaaactttctggaagggatcagatgggcagtatttgagtctttgtggcccatgcagtctctgtcacaactactcagctccgctgttgtagtgggagagcagccactgaaaacccaaaaatgcgcgggtattgctgtgttccaataaaactctatggacactaacatttgaactttctatcattttcacgttacaaaatactctttttccctccattgaaaactcttcttagcctctgggccttacaaaaacaggcagtgaaccagatttgaccgcagggccatagtttgccaacccctgccctagacttaatccagagtgattttcttcccagagcaggctgttggccacatggcttgagaaagaaaatggttttcctgaaaatcatagaaataccttcactgagatttattcattcgtgttaaacattgccatctcttaagaagagaaatctatttaaggcagaaacaggcatcagaagtaaatcaatgaaacacctaacttcttagcatagagtaagttcatcagacagaggcaattcaatttaatttggaactaggttttggtcatttcttatgtgtgaaagaaccatagtctctgccatgaaaaagctcacaatctgggcaggatggagggtgtgaggtgggctggggggatgaggaagcctacaaggagctggagggtggatcctaagagaagcaaagacgaaggctgtggaaagccaaaggaaggaaaacaactcctaactggggggtgaattgttttcatggactgtggtatttgacatctgtccaaagggttcacaagagagggatgctgataagggaaaatgttccaaggaaaggaagtagtaggatccattggatatccagataatgatgaaaaaatgggtgaaggccatactggcctagctttgaatgctagccagaggagttcttgattccttagttggcagacatgtcaggcccaggaaaagattttttggagtcatggtggtcattgggtagaatagagggaggaaagaccttgaatacctaaataaaagacgtgggtaaagaagaaatgggaggtagggaaagggaagaggggtcaggagtgggaccagtgaccgctgacttttttcattcagtttgccatattgtcagcttaaaaggactaaagacagacctagaagaggcatgacaagggtctgacccacatagtgcttttccaatatctgtgcctgttgcaggcatcactaatccaccatgggactcttttccactgtctgaacacagctccttaccatcctgccataggcagttgctttcaaattttcagagttggggtgcaaaatgacatttatttgcatattctatagcagtgcttcacaaattttagcatgcatatgtttcacccaaggatcttttacagatccggactcagttggttctcagatagtccagagtctccacttctaacaaacttacgggtaatgctgacactactggtcaaagggccgcctttgagtagtgagtccagagtgaaagaattctgagcttagagttagaagacctaaatacaaactcggatctgttcttacaagttgtgtgaccttcaacaagtggcctggcttctctggcctcgaaggggacaatttaggttaataaggcaactcagtggaattgaggagatcaaatgagatcatgggaagatgtactctgcaattgatttgagagctataaattcattcaatagtattattattaatgataatatagcaatgatgatgattaaacaccactagacaactctgtttgtaggggctgagccctggcataaggttgcagggtgacagcactgataaggacctcagtgactaactagtcattagtgcctagtgggcagccagcaacctgaggttcatcattcagtaaaaatgtggccccataaaggctggcctggaaggtctcagcaaggaccagctatacttaaaactgtccccgcagccaacagatataagtccttaactacagggattccagatatccagtgcttcactgtccagcctgtcttggatgaacatcccaggttcaagaataagccagtgcctgaccagattataaagtaagactcgttgtccacagggaagaaggatggggaagagaacccattggggccaccaaactgagctggtggcagaacagaccccagtgtctttctagttccttctctatcttagccagtttttccccccttttcctcttgggcaaagaatcaccctccaattagctgggctctgcccctgacaaggctgaagccaggaaggatgggagagccagggttatggctcagcaaatcctcagcaagcatcgagcatttgctcaactggatgcagtcagcctatttgttgctcaggttgatctcagagtggccccagggagtccacagacagagtgtggctgggcaagtgataggcagggtggagacagggggccttgtccatgctgagcacatgctcccagagggacatctcctcagcatttgtgaaggttgtacattgacaatggtgtgttcaggctctgataaaggaacagtagaggaagtgccgtgaaggctgatgtccacctgttctagatcagattgcaaagtcactgatgaggccacaaggtggggcctctgtgggacccaaggctgtatgcctcccagctgcccagctcattccccctaccccatgcccaggttgtaatggagcacttgagtgtcttagagtaggtcctcccctctggatgggacagtcagaaacaggatctgctttgcaagatgaaggacccttcagggagaggcagcccctcccagcagcctcacgaagtgccacagcagagcaggtggagctcagcttgggtcttaacctcccctcaccttctcaccttctcagacaggcacccatgagcaggggacaataactgtgcagctagcacggtgttctgctggccctgaagttagaatctcaccaacgattcagggagactgatttagggggttggctgggacacctaaagaaatcctttgaggacacctctgggaaattaggctcagacctcagctcctttgttgcagatcacaggaaatcatgacctaggccatcaatgttagaattccaattgcctggatactctaggggtactatgttctcaaaggggcacaagaccagtctaccttctaaattgccttgtcaggaaagcctgtgcaaaagtcactcttacggagcccagaacacagaccttgattttaaatgcaccacaagggactctgccaggcctgaagtttactgtaatgaacctccctggacagtgcagggtcagatcgggtgtcagcagccggggatggctaccaggagcctcagcctcttcctgtctttcagcttctacaaatccaactacgtgcaaaggttccactactcccggcccgtgcgcagggggaccgtagacccagagaatgagtttgctgtgagtatcttccctacccttgatcattccctggagccacctggaggaaccagagcatgcatcggccagcctcagaatgggaaggaacttgatagaaagccagagaaaataaagccaacctccatggataccatgacgtccgttccccaatctcttccattagggcctgtgtccttatttcttgagcctttttccccttaatacagaacccaggcctcatgtcagaggcactttttcaaccacagggcattcaggcattgccagcacgtagaaaccctcaggctaagaaggggtgttgataaaatcaaaccttccagcaaacaccagtaagaagccacagcaatgtagtcatcactgtcccctgagtgctagtctcctctgtgtgtgtccagctaggattcaaacaagactggattaaggaggtgtctccaagtctcagctctttggcctggacagtaattcttaatatttttggagccactgcctctttgagagtctaatgaacactgggaacccttccccgagaaaacaaatggacacattcaatattgcctaaaaattcagactgctaataaacccaggttagtacttacttggcctaagtccagggagagcttacacttaatgttgggaaagaattcttaagggtaaggtgagagcgtgtttctgggtcttgcaatatttattctgctttcgggtagatgggaggcccggggacctggctgggtttctgccaagcttctccgatacccaggtttcataaatgtgtttgttgctttcctgcccttgccacccctctgcccacggacagtccatgtggattgagagaacctccttcgtgactgcatacaagctgccggggatcctgcgctggtttgaggtggtgcacatgtcgcaggtgagtctgggacattcgtggcagggccacccttcctccgatgggcagggcacagccagtctccaaaggcccctttgactttaaaaaggagacatgtttttctttgaagctgctgtgtgagtcccagaattcccatgcaggcagcattcagaatagtgcctttcagattttttttttttttaagcatcagataacctttttgttccctgcaaatgaaactttccatggcctccagtaataaagctgatgaatggggagcttctgttgggtgggtggggtgtagcagagggcctggaacacaatcattaatcatttccatctccccctcatactcctctcatcacagcacccccttgggggcacctgtgcagtatcccaatatgaatccattttatagttggaaaaactgaggctcagaagggagagatcatttggctagaatccaaatgtttgatctcccttgtgcagataacacctattttgcttctcagcacagcttagggtctccacgtcctcagacagctaaagatcttgcagtccccaagatacagaggaatggtcagtgtggttgtgaggaaaccttgtaaatggacatatttaggatgtcttatttatttatttattcattcattcagaaaatacttaatgtgtacctaacatgttaggcactgttgtaagacctagagattctgcaatggagcttccattctagtgggaaagacggactaaaaagtcaaagtaaatatatgacaggtgataactgtgatggaaaaaattaaagcagaaaggtgatatatgagggattgctattttaagtagggtagtcagagaatgcttccctctatactggctgttgaggagaggcctggaggaaatgaggaaggggtccatgctgacattgaagagagagacattccagcagaggagacagcaagtgaaaagccctgggcccagagtatgcttgtgtccagatcagaacaagtgagggtgagtaacagtcatctgataccagatcatgtaggaccttgtagaccaccataaggactttgactttcccactgagtgacacagagccatgagcagaggagggacgtggtctgacttgcgttttcaagctattgtatcagacgatagcattgagaccgtttcacttctacccttaatgcccctctcttttcagcgaacccagcagctcagtagcccttcagcctcctttttataggcatgacctagaccttggaaaagtataacaatgatggtgatagcaaaaaacattgttttgagtatgggctcaactgttcatatgcatgatctcatttcaacccctcagcaaccctgtgaggtagatattattattcttcccattttacagatgtgggaactgagatgcagagttaattagtgcattgttcaaggttagtaaaagagatagggtatgactttaacctcccctgtcaggcacctggcttggactctttatctttttttccttaagaaaaagaagagcccaccccagcccaccccagcaagtagtacccccaaaaggaaggaagtgtctgtgcccttgcttcatggcacataagtttcaacaagtgccccaggtgctgtgtcaaaggtttatagctatatctcatttaattctcatagaccccagtgaggtacatactattatgagccctatttaggaggtaaggaatcagaaactttctgtcaatctgtagcctctgcccattagccctgactgagccctgtcacctggtggtgctcagcaaggcgcctcttctgtagtcattcctgccaaactgtagcaaactgagagagcccatccctgtacttcccattccctcagctactgtgtgtcagcccaaagcacttatctcctaatagcctacataattttcttgtttatttttaatattaagagaatattaaatataacagtagaccataagctccactagaatataaattccaagaagacagatattttgtctattttattttctgccatacctccaagtgctaagaatagtccctggcccacaactgatgctaactaaagaatacttacataaattaatcagtcaatcaatatgcagacacccgtaatgtctaaaccggttaccttattttataaactcagcgttttgaagttgggaaagaaatagtcaagatttttggcttgtttctttcatcccgatggcttctcatagatggcattggggaaaccttcaaaaagttggccagagtgaatttatctttaatggcctctctcagatgagttaccaggaatttcagggtgtctcagatgcaaaagttgaatgctcttctaagtgacttcatttccaaagattgtttttgtgttatatgaatttgtatcttgttcttggttatttcctccataaattatcatgactacagtaatgtttatatagacaggcattttctgatgagcttcaagtataagttctgcctattggggttttattttgttcttgttcttggccctgagaaatggagactttacaaggagccctgatctaggggtcagagatccaaattcaacgtggtcactaatgagctatgtatgttagataaggactgtatatctctgggtcttagttttaatcatctgtaaataggaattgcaaaatgatggaactttagggagcttaaagggaccttaggtgtcttttagtcctaaagctataaactggaataccttcatagcctagtaagggctgtggcaaagtgcagtagcaacagccccctcctccatctctgttgaattacatttttaaaggctagaatcaatgtgctagctaagtgacagacctccgccagcctggtttggcttgcagttctccaagttttttgtcctgattcttcctggttcttgtctacctgcattattttgtatatgagaaaactgaggcctagcaatgggacttgaactgccaaagcaatttgtggcagaactcagaggtcatgagagagcacctgtcctgtgcagctcataggattcctgggtagacttaagaaggcaatattggtaaaatggctttgaaaaatatgaaatgctggggtgggcgtggtggctcatgcctgtaatcccaacactttgggaggctggggtgggcggatcacaaggttaggagttcaagaccagcctgaccaacatggtgaaaccccgtctctactaaaaatacaaaaattagctgggcatggtggcatgcacctgtaatcccagctactcagaaggctgaggcaggagaatcacttgaacccgggaggcggaggttgcagtgagccgatatcatgccattgcactccagcccgggcaacagagcaagactccatctaaaaaaaaattaaaaaaagaaaaatatgaaatgccacctaattgccagggattgagatcactttctctttcatcttatgttccctcacccatccacacacacttttacatttttttccaaagcaccctcccctgataattcattttctcttcacagcaagcctggcaagagttactatgtcgataaagaaactgaggctcagcttagggaaaagaccagagatttgagggctagattaagtcccaacagcccgttgatagcaagtgtggtatcaaagcttgatttacgtgtagtagaagaagcctgcctttggaatcacaaatacccgagttgtctttccagctctgccccgtggctcagggataagtgacttaacatattgctgggggaatgaaatgagcatgggtgtaatgtggccagcatgggctggcacataggaggcaattgataagtgaggtcatcttcattatcatgatcattacttttattcctgttattagctaaaccgtgggtttaacttctgaaatctaggcctttcaccaactatacaacccctgtaatgacctgaaagttacatatttggtttatacaaatgcccgtaggcgagaagccaaaattattttcattctctttctctgttcctaatggctataatgaggctaacactttgggaatctaaaaatagtttcaaaagcaaggaggaaagccaatcaactgctctttccatttttaatgacttgtcttaaagcctgagtctttcagatatggcagtctattgttcaaatgcaggtgtgttgctgggctcaatctgagcggtggtgatagattttcagtacaactcagtctacaccttggcccctcagagcccccccagagttggtctgtgtacttgacagatactagaccgtgggtttcaccttggaggactatggctgcagccaagctggacattgttctccttcagttaacattatgtgtgtgcatgcatgtgcagttgtagggtgtgtgggtgtgcccagggtgtgcatgtgtggatgcatgtatatgtgtatctatgtgtgtatgtatatgagtgtgtgtgtgtgtgtgtgtgtgtgtgtgagagagagagagagagagacagagagagtgagtcagtcaattcccagggccttctcactgtagagatcagtcatcttcagaaacatccagactcagggtaagggagtaaggaggctataatttcacagaaatggttttaaaagatgaccaagaagacaattagcaacatagcagactaggaagctcctgggtctccctccacccccaaatgcaccagataaatatctactcatggatcaattccctctgagagaaactcagagatgaagtgagggacttctacctaccaggcactgagtaaacatccacattgaaccgatatgaaaagctgaggcacactcaggcatgcaccctgctctgacactgtgctataaaatcaggaaagaaattcccagtactcatcttctctccctgtggagaggagggcttggacctcacatatactaccctaattctaaggttccccaggagggcttggacctcacatataccattctaattctgaggttcttcatgggttggctcttaacttatcaactctgagactgcgcagagttagacatatgcaagtctctttagaccacaggaaaaaatcagtggttttatatgggtgcacatgaactttcaggcatcctatcccctgagaggagtgtagtaaagggtcttttaaaaatggaatcccctgcttctccccagaaggcatttatggcacactcttccagtggctacttggcagcctggcttctacataacttccactgaggagttaaggggcaaacaaatattaacccactggcagcctgagaagcaggctgtcacttctcaaaccttgcctcctggctcaccctagcaataactacaggtttattaatctctcctggaaggagtctgtgcacacattgagtttcccaacttttacagcttccacccaagggctatattctaaacaccttagctctgggagcagaggggactggcatatgcatgtcgccaaagaccacaggaaaaaaaagcagcagttttatacaggcatgaaagcacttccagggcttcattccctgagagttggtgcagagaaagggcttaaaaaattgcaaccccctattcctccctagatgaggtttatgctatgcattgaatgtcccaacttttagatctatttctaaaaggactccatctaaacctcttagctctgggaacagaagggagcaggcatatgcaattctccccagatcacagaacagagagatggttttaaatgggtgcacaaacacttccaggggttacatccccttggagcagtgcagaaagtgggcagaaattaacagctcccattttctttctggaaggggcacacacttccagtggctacttgatggcctggcagctaacaaacttgcatcaggaagctaatagggcaaacaaacaatagctctccagcagccagagccagaggttggcacttcactagcctttcctctgtctcaacctagtgataaatccaggtctatccattcttcctgcaaggagtttggccacataccaagtgccacactagagctcccacccaagggactgtcctcttaaggatatagctctgggagtcaatgggactttgtcttcctgagtggccctagaccacagcaaaaagaggtggatatacaatgggtccaatttcaacaactatatccccagaagcagagggtgcggcctgaacctgagtctaggcacttgccacagattctctccccagcttagggcagagagagtgagaggtaatcgcccatgctcagcttcaccatgaagatggaaaaaactggaacacacatttaatacccccacctttccagctacatctagagagtctagcccctgccttatctgtcactgggtactgacaggaagtggcacatcctaaactataggggtctacaaaaaacagagacagcagtctggacaaacagagagatttgagaggaaccctaacatttcacactggatggcttggtcagatccttcttctacacaaggccagtctgacaagactgggagagagagctgtcttatctaatgcagagaaaccaacacagacactgaaggaaaatgaagaaacagggtaatatattccaagtaaaggagcaagataaatctccagaaaccgaaatgtgtggagtcaagacatgtgatttactcagcagggaatccaaataatgctcatgaagatgctcaccaaggacaggagagcaatgcaagaacaaaccgagaattctaacaaagagaaagcataaagtgtaccaaacagaaatcatagagcttaggaatattataactgaactgaaaaatgccatagaagggttcaatagctgactagatcaagcagaagaaaggatgagcaaactcgaagacaaatcactggaaatcatataacctgaggagcaaaaagaaaagaatgaaaaagaatgagactggtataagagaattatggggcaccatcaagtgtaacaacatacacattattgaggtaccaaaataagaagagagagggagaaaggaacagagaacatatccaaagaaatgacagaaaacttcccaaatctagaaaagaaactagaaatctagatccagaaagcccaaaggacaacaaatcagataaatccaaagagaaccaaaagtatttctcaaacaaacaaaagctgagttaagcaccattagacctgccttataagaaatactaaaggtagttcttcaagctgaaggaagaggatgctagttagtaacgtgaaaatatgaaaatataaaacttagtgttaaaaaataagtacattgtcaaatccaaaacatgctaatactttaatgatggtgggcaaatcaattatctagtataaagatttaaaggcaaaaaaaatataaaaagacacctaaagctctaatagtttgttaaagatagaaattatttttcatgtaaattgtgacatctgaaacttaaaacatgggaggagagggagtaaaattgaagtttgtgtatgtgatcaaagttaagttgttttcagctttaaatagccagttatatgtatgttttatgtaagcctcagggtaaccacaaagcaaaagcctataatagatgtacaaaagttagaagaaaagacccacagcatatcactacagaaagccatcaaatcacaaaggaagaaagtaataaaggaaaaaaagaacaaaggatctataaaataaccagaaaacaatgaacagaatggcattagtaagtccttacctatcagtaatgactttgaatgtaaatggattaaattcaacaatcaaaaggaatagagtgactgaacaacaacaacaaaaaaacctaatgatattgtatattagtccgttttcacattactgatagagacatacctgagactaggcaacttacaaaagaaagacgtttattggacttacagttctacatggctagggaggcctcacaaccatggaggaaggcagggaggagcaagtcccatcttacgtggatggcagcaggcaaagagagagcttgtgcagggaaattccctttaaaaaagggatcttgtgagacccattcactatcacaagaacagcatgggaaagacctgcccccatgattcagtcatctcccactaagtccctcctacaacatgtgagaattatgggagctacaagatgagatttgggtggggatacagagccaaactgtatcagatatgttgcctacaagagacttacctcacctttaaagacactcatagactgaaagtgaagggatggaaaaatatattccatgcaaatgaaaactgttttttttttttttttgagacagagtctcgctctgtcgccgaggctggagtgtagtggcgcgaactcagctcactgcaagctccgcctcctgggctcatgccattctcctgtctcagcctcccgagtaactgggactacaggcgcccgccacaacgcctggctaatttttgtatttttagtagagacggggtttcaccatgttagtcaggatggtctcgatctcctgacctcgtgatctgcccacctcggcctcccgcaaatgaaaacttttaaaaagagagtaggggcagctatatttatttcagacaaagtagactttaaatgaaaaactgtaaaaaaaaacaaaacaaaagacaaggtcattatatagtgacaaaggggtcagttcatcaagaggatataaaaattgtaaacacatatacacccaatgttggagcacctaaatatataaagtagacattaggagatctagagggagacataatgttagtagggtatttcaatacctaacttttcaacattggactgatcatttagccagaaaaacaataagaaaacattgaacttaacctacattttagatcgtaatggacctaacagacatatacagaacaatccaccccacagcaacagcagacacatttttctgaagtgcacatggaacactcttcagtatagatcgtgtgttagaccacaaaacaagtcttaacaaatttaagatttttatttagtttgtttctgtttagttcatgggtcagcaaactgtggcccatggactaaattctacccgtcacctatttctgcagttttattggaacagccattctcattcatttacatactgcctgtaggtgcttttgccctacaataacagagttgagtagttgcagcagacaccatctggcctgcaaatcctaaaatatttactatctggcccttttacagaaaatgtttgccgacctctactttaggtttctactccagatctcatgctcttgcaaactgcactttttgccggttagcttttgatggcactctgtttatatcgccttctaagaggtgttggacaggtgttctgtttaattttcccaactaaagtgaatctaccttggaacagtgaacccctctaacaaccagtcttaggacctactatgtgccaggctgggtgcccacatcgcaagctgctctaatctctctggccaataactcacacatagtatctgcccaaccaatactgaaagggttgaattggcatgtgtttcacccagataataagaagagaaaaccttctctggggcacactcagcaggtacctgacacttcctgcttctgcctccccaaagaaatccctttctcactaagcagaaagccagcctgtctctccccagagagcagacagcccccagagctcagtaattacaagatcctgttacagccccttagggagcattgcctcatttgaattcccaccccaagtgaaatcaataccaataatatctgtttttaaagtgacttaactaaggccctttcttcttggtgatctcattttcaacagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggtgaggatttctgttctccaagtctaggggagctcggtgagcagagcagtggtgggaggacccagggggcagatgcaggtacatgtcacttatcctactttgactgtccttgtccccagagggaccctcagcttggttggccctcatgtttctatagcctcatgtcttagctgagctcctgtcttcctcccagcctcttttccataccctgtgctggggcagggaggggcaggaaggggcaggggtcataaggtccccttatctcactgggcagattcaggtggctctattaaggaaaggctctgggatgagtgtgagccagaccataaaagtacgtgccagttgtataaacccacctcttccacagaggatgtgaaatgatgtatactaatggaaagaaatgaaactcagaatctgtgaaaagccataaaaactaagagatcaactccaaaaggggagctataatctagatatcaaggtcataaggtccctccagaaagccccacatgtttgagccacagatttatttttgagcttcctggtgttcacggcaaaaaaggaaatagcatcacttatatgagttacattatccactggaaggaaaaatacccatttctcagtaaggatacgtagctgttcttggcattgaaatagagtagaaagttcttacttggttttcacctagcagacactgaaggaaaaatgaactcctcattctaacaaatcttttgatgaattccctattatctttcctatgttatccattgatgtaaaactaagaataccacacagtagtataatttggggacaataattccagtcacctaatcaatccttccaactaccctcagatacccatgcagtcatcattggtaaccctttgctcagccttgagcagtgatgggatatgtctgtttatacatgagcacacactaaggacatgagccccagaaaggggctgccagggtcacttgcaatgagggaggccatgaggtgagctggaacacccaccagtgagattccttactgaattattttccacagagcaatgttctcaaacttgaaaggagcatcagaatcccctacagtgcttcctgacacacgggtcctcaccccacccccagagtttctgattcaggctgtctgggctggggctagagactttgcatctctaacaagttccaaagtactgttgctgctactggctcaggaacctgactttgagaacagcttccccagagtttgcagcccattcccactgggtgctgatctgagcctcaaagcagataaaacaatgtcagtctctccagacctgttactcttgttccatccacatgcctgtgacctcatccttgcccctttcaaattgaatcttctcccagtgccaaagagattggctgtgaaatgccacatgaacaggaaaccctgacctcctatctgtcctccccaggccttcttcactgaagagtatgtcagggaccaccctgaggaccaggacaagctgacccacctcaaggacctgattgcatggcaggtgaggcagcgctggccaggggagcatgctgctctccttcctctccccccaccgtggttcacttgccccacgctaggctctagctgaggcagcctgaattcacatgccctcctgtcccttgcttttcagcccctcttccaactctgtatcacacctgagcaggttcatcctggaacagagatttggggcatcgcactcttgggtgttgcatggtgccaggcagcaatgctatgctggatggtgccaagattatcttatttgatgttgaattcaggggatggcttttcacagcgggatgcaaataaacaccaggcccccacactccaaaccagcaccttcccccgacacccagcacaggccaatctgataatagaagacttgagcccctactcccacttctcctccttttagagctgacccactttgttgcaataatgctcagatggatatcaggttttgaaaataattgaggcctttgtgtgggtggttgtgagtcaaagggtctacatcccacacaagccgctgctcagcccacgggcttagaagttaccaccctgctgtttcgggctggccacttacctgcctctccttccattctctctttgcatccctcttcttcctgtggactctgtctttcctcctttctctctttctctctgtgcatctgtctgtctttccctctctctcttagaagcctgcacttctattccttgcctctctgtcttttgccccccacccccacacatcttactcctctcttggcttctcttcctcttctgtctcattctccatctccctgcagaagcaacagtcggctagatccctctcatagaggcttacacagggctaggcttccctccaggcccagagcagccccctcctcagacattcgcccactctgggctctcagcaaaccacccatcagaacacaggggtgggctccggagggcaggagctggcgggaggtgagcagtggatgcaggggcaggtggtagcagcttgcagctgcctgccctccctcgctttcttcttgccagtcactgtgcaaagaaaagcaagcttttgtggttgggagtttttgttactctagggaaatcagggaatgagaagcattgggtgcagcctcttttcttaaaataagaattcctaattcaggtccttctctgcctctgccaatttatgcaaagtggggctttaaaaatgaaacaccaagcactgcacagacgcgcttttcccgaatgcatgttgtgtgtctgtctggaattttctctttctttttaccttgtgccacctgtgaagcccaaatatcccccaggtccccagccttctggggtcgtcatgccctttattattcaaataatgatgttctcccttagcatccccagtttgggaagcaggaaggccaggctttgactcgttcccatcctcagatattgctgggaggcctcagggaaggctaacatgtcatacagatttgcttagttgttggatgtcactctgaatctatacaattgccctggtcctctccactggggacctcttctcctctggaaacagcttctccatgctgtgtttactgtacccaaagaatgaactgcagcttcacagcacagcgaataccaagctgtaccttccaagaaaattctactactgtcttggagcttactagagggacattaccaacaaagccggaaggctttgaaagcatgtactctattagatgtggcggcttctgagaaccgttagctaggcgccttcagacaccgccccctagtggccgccttctccttagcaccacccgctgctcctgagaccacctatacagaggcccacctaacccccaaacgaggttgacctcagccatatccctcccacccagcgcccaggcaccctaactatgggcacccgcatgcaaaagatgcagtcctgctcatagtgaaggcagccttttaacattatcacatgcagcagattagctcttccctacctgtttcattccgtttgttcttgcaacttatatttattgagcctctgttgtgtcctaggcaacagtaatagtgatggacaaaattgggcctgctccctgctcacttggagcttaattctatgttggattttggttttgcaaagccaaatacactttgaatttacttaaaacacgagaaggttagatttcaaggggagtgaatgtatttgtacctctagcaaccgaacaaatgctgaagccttcaaagtacatttggtgttcaacgtttttgcagatttcaagatcgatagcttgttaatttattttctttctgaagactttctattttttggcataaaaagatgtctatagtatgctcttcttttaaagcttttgttgtgaaatattatgtacagaaaagtacacataaaaatatataacccactgatttatcaaaaacatacatccgtttgaccaccacccagatgaaatagaattctgctagctcccctaatcctatcttaggcctccttccctaagagtgagcactgttctgtttttatagtaatcatttccttgctttaaaaaaaatactttaccacccaaacactcattcttaaacactatagtttagatttgcttaattttgacctacatataaacagaatcacataatatacagtctttcgtatctaacttattttgcccaatgttatgtttgtgaaagtcattcattttgtttatgagtcataactatgattcacattcattttcattgctatatagtagtccgtacagctggcttatgtaactataccaaaatgcatttatttatttttatactaatagagaattgggtttatttcagcttggggctattataagtaatgctattctgaacttccttgtgtgtttttttggtacacatatgcaaaatttttgttgggtatatacctatgcattgatttgcttggtcatagcatgtgaggatattcagctttcataggtactgccaatcttctatcaccataggttaggttattttgcctgttcttgaacctcttataaattgtattatacagtacagtatgtactactgtatctgtagcttctttggctcaatataatgcctttgagattcctctgggttgttacacatactagaggtttgacttttttgttgtttctaagtgtcatctattgtatgtgtatctaaattaccaataatatatcaatttatttatccgttctgttggacatttggatgttttcaggtgttgtatattatgagtaaagttgctatgaacattcgtgtttgtgccttttggtggacctaagcacccagttccctcagtatacatgcagtagtggaattgctgggccatgcacatttaaccttactggacacaagaagcagtttttcaaagtggctaaatcaattttcactcccacacaacttctaagtcagttgatccacattctccctgacacttgatactgggagtcttttttaattctagtccttctggtggatgtgtaatgatatctcagtttagttttaatttgcatttccttcatgagcaatgatgttcagcaccttttcatatgcttactgctaattggattacccttttgtgaaatactttttcaaatcttttacttatgttgttaatttagttgtctctttattattgatttataggagtttatatattctagatatgcatcttctgtcaaatatatgtattgcaaatatcttctcttagtctggcttgtctgtttgctttcttaatgatgtattttgatgaacagcagttgtaattttggtcaggtttaatttatcatatttttaaatgattagtgcttttgtgtccactttaagaaaccgcaactaccccaagatcatgaagatattctcctatgttttattctgagtttttattgttttgtcttatacatttaggtgtatgatcctttttgactgatgtaaagtaagaggcagattattttcttacacagatttccaatttctttagcaccatgtgttgaaaagactattttcccccacttttgaccccccaaattgaccatatatgtgtttttctattctggactttctattctgatccatcggtctatgtccatgcttataccaataccacaccatcttaggtcttgaaatctaatagtcagtgtaccccaattgttgcttttcatcaagtgtgtcttgcctcttctaagtcctttgtatttctctataaattttaaaataaccttgccaatgtttacacactcctcccaaacacattgagatttggattaattgtacattaactattagattaaattggagagaatggctatcttctcatccatgaacatggactagctctccatttatatagttctttaatttctctcagcaaaattttgtggttttcacatattttattttctttcatatatcttattagatctgctctttggtatttgatattttaaattctattgtaaatggtattgtttttaaattttattttctgtttgttaactttttgtaatacactcatcttatgatcttttatgtttgtacttcttgtaattatgtttttcaatcctaatattggttattagtaccttgtattttcttgattagtcttcttaggagtttgttaatgttgtatcttttcaaagaaacaaattttggctctgttgatcctctctgttgtaaatttgttttctatttttattcgtgtccactctcacctttattattttcattccttttctccctttgaatttagttcgctgttcttttactaatatcttgagatggatgcttagctaatttattttctgtgttttctaatatgtaaaactaaagccataaatgtatctccgtttacaaccttatctcactactatttatatgtagtttttccattagcttccttttttatataaaatctttgtctttttcatgaatgaaggatcttttctgttcctatatattagttaaattttttagaaaaacatgttttcttaggctctctttattctatttcttccaaattcattctgttttttcttcctttattctttccttcttttcttccttatttgctttcttccctatctgttggtctggtctctgtctttcctattggagactttcctccagtgtctggtgatacttggcattctcttcatagttaagagcaaggctaaagaaaaagaaaatctgagtacaagagagagggccttggcaactgggtagcattgctgtgtggcaacggaatgacccacagacgtctctctctacatgggaccattcacattctccagagtcagacccttcaagctgttatatagaaagataatcccagctgctactctgctggccatttgggaattgggaagtggagctctcaggacccaaatgcagactttctcttcaacttcttatttgcagtctggcttctgcttctgccttctgttgtgcctgatgcccctaagcccagagctccttgttctaattgttctagaggataaactcctccttcttgggaaaatgggaaaaaagaacacttggctgcagggtgaggcagtcaggcaatctaactgctcctgatacagaacttcaacacattcctctgtgtttggcccctcagctcacccgccttctctgtagtacctggtgcctccaatctctgaggccctcctggcttcatgtaggcagattggcttcttatcaccacctccctcctctgctctggaagctctggaaggtcagttatgtcctcccacctcctggcacacatattgtgtggcaggtttatgaatgtctccaagtttcactgaagatttcagtttctccttcaccttgtcatttctgggagacctccaatagaagtaagcagaaatatctttatgtcaccatcatgaaagcaatttttcccccaagtaattcataatctacccctttgctcccctggttatgtttccctgagaccacacaactaaagttctcagttctctttctgacagtgcccaccatggctctgctactctcccttaaggtagctgacacttagacagtatccactgacctcctatggggacaaataagacttcaactccctcacatcaatcctctcttcttccctcatcttcctaaggcttttattatcatttttcagagctccctactggggggttaactttatgatattagcacattcatatccttcttcagcagctgtatgaagtgcaattggctccatgtggtaagatgaggctatgccccctcctctgttttctctcagctcttgccttcctctatctctcagcttctgacattcatcctttcactttagtattgccaagaacatcttaggcaaggttttaaatcaatgcaacagagattcccctcctctgatccccacactctgcccccaagtagattctttaagggggcaattttcccaaccatgtggcctttcatggggaagaggggagtccagccctcctatgaggcaagggaagctgggggtctttctctcctttccagagcaaacctcatgtttgcaactttccccatttcccatggctggggaccgtgtgtgcaggtttctgaggaccctgaagcccttgatgaattcttagcaggcagacttgactgcagctgccttgatgggcggggtgccaggctgaggcccaccggtcagcctctggctcattctttaccactttctctccagatccccttcttgggagctgggattaagatccatgagaaaagggtgtcagataacttgcgacccttccatgaccggatggaggaatgtttcaagaacctgaaaatgaaggtggagaaggagtacggtgtccgagagatggtatgggtggttcctatggcttggaggggtgggattgtgcagggtggggcagggaagcatgctggaggctgaagttggaggggatccagcaaaggaagctgcttccaaagagaagataatgatggccagcattgctggatcccatccaggggaaccctcctggaaacttggtccagcaaaagtaacccccagacaaactccagttacaactggattgtgcagataccaactactcaagggactgtgtaataataatgaaagctacactgatgcagcatctactatgtgccaggcctgattcaagcacttgacatctactaggtcatttaatcctcaccacaagcctgagaggcaggaaagatttttaatcctttgtatttcttctgaggttcagaaggtcaggcaacttgccagaggctatgtggcaaatgaatgtggggcagaatttgcatctggctctgttagtttaaggccagtgattttgaccgctgagctccttggcctaaagaggccatgagcctggtgcttacggggtgcttcttcatccttttccttattaactggtgttataaaatgtcaaggccatgcaattcctttaaaaccatctggtccagccttcccattttacagatggtaaaactgagacccagagaagaaaagtgaattactggaagaacctacagatgcactcaggtctcttgattcaaagatttttttccatgaggcagtttgtcactttcaatactccctacatgaagtccctgtaatgcaattctggtgctaactccctggagttaggtcacatttcacaggttagaagcacagtcttagacacttcccacttcaaacaccaaccataagcttcagggacccaggccacccacacttctgcctaactggttacaaactgggagattcccactaccccatcaggtttcataattcactagaataattcacagaactcaggaaagcatgatacttatgatttcagtttatgatacaaatcaagaccagccaggtaaagagacacagagtgaggtccaggagggtcccaaacatgaagtttccacgtattccagatgcatcccccttctggcacattgatgtatgattaccagccagagaagttcactagagcctaatgtccagagtttttattggggttttattatgtagtcatgatagattgaaccattggccatgtgatggaaatcagtctctgggcctgtccactccctggaggttgagctgataccacatggcttaaagccccagcccagccctataatcatagagctggtctttctggccatcaggagccatcttattagcataaaatcaagtatggtcaagggggccaccatgaataataacaaggatactactatcacataggaaattccaaagttttagatattaccttccaggaaccaggagtaaaggtcatccacattcttcattctacaagaacgccctagcctcagccagccaggaacttttgtgctgatgctccactcagccccacaactctgccctgcctaggtggaggaagaaggtgacaggaaggctggggccaccttccccaggctacagctgctaaccaccctgttctcccaccacagcctgactttgacgacaggagagtgggccgtcccaggtctatgctgcgctcatacagacagatgtccatcatctctctggcttccatgaattctgactgcagcacccccagcaagcctacctcagagaggtcagtccctgcaccccaaggagccccccacacccctgcctccctggctctatcccccctccttctctctcttctccggcaacatcccttctacctttcccttcctcctttcagtttaaaagccttttcccatctgcagtctcacaactaccccaggaggctcatggttagtaccatttttaggggattatcagaggctcagagaggcaaggcagctttcctgaggacccagcaggagtcacctgcagcccccagacttctagtccagtgatctctgtcagccaggcagagctcctcaccaagcctgcatccttctggaatattgtcacctctcatagggatctgttccctttcaaggaagctcctcccaaccacgatgggatgtctccattgcagagctcttcctcctgcaccacctacccacccctctgtcgggggtcttccctcccttgccccttccaccttcctggagccctctggccatcattgttggaccctccagaaacttccctgcgggcctcagaggttactcttgcccagagggaaaaggatggaaacgtcttctgtttcacagttctagggggcatcattcacaattctagggggcaccattcaccctgcccaactcatctgttctaatcatagatacatgagcaacccagcacttaccatatgccaagaatatgccaagggttcctcagacatcatctcatggccactctgcaaggtctctgcgaagacctccatttactgaaaaggaaatgatggcttgaagaggttgagtgatttacccaaagttattcattcagctaagaactggccgtgcctggatttgaatccacattcatgctttcaaccagtcttctctcctcaccaccagtttcttttctatggctcacttctttcaatttcattttaccacgaataaaataaagtgaactttactcatcacatttaactgtttgtgcattgagcaagttgctccccaaatcctctgccagatttgctgatctactccagaccctgtagtgacagctcaggcagcccaaaggtccccttcagcttcctgggtccttgcaaggcagttctactgaagctctaactgcagtttctattgctgcccctctggcctttcagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcgggtgagtggctgaggcagattgcctctccagcgctgttagcacatttccactacatgctgggcacaaaacccagggcttccagatatgggcttcctgaagcctgccactgcggtgctatgggtattgcagaggcggcacctgaggagctgagaggtgaagtgcttactcgtgcccaggcagctggggtggctgggacatgacagagctgggagttgagccctgacctttgcacttcagagcctgtgtgtatcctttccaccatcacacagggcttttccaggctggggagaatccacctgttctcccaccaaaagggagagcagcccacttggtactgagctaggtgtttctatagcccccagccccaggcctattctaaccactgatgtctcagacccctgcaagcccctcctgtgtgccaggagtccaggtggggatacagggatgaaatctcactgtcctggctttgagagtgttggtcttgtaaactaacgattatttaaaaatgagacttggtttcagacagccctggattcaatcttagtttccccctggaaaagaggtttgttggaagtgttctgggaacctgggagtgggagatggattaactgccctggcaagggaggggtgccaaatgaaagagcaaggggccaaccaagatgccttagtgaagaaagggccctccagaaacttcccagtgggcctcgcaggctactcttgcgtggatggataagaatggaaatgtcttctgtgtttgtcgattctaggggacaccatttacatgatagtctaaatgaatgtccgccacccccgcctgtagttgtgtagtgtgcaacctgtgcaaccatatgtggcaggctggcatggaatggtataatacagaataaatgaacttggagccagcttcatagaaaccatgccacgccctcctcactgatctttcagagacccagatctgcctcatgctaagcctctgtctttgtgtgtgtgtgtgtgtgtctggtgtattcctccagctttccaggaagcatgagttcatgagtgacaccaacctctcggagcatgcggccatccccctcaaggcgtctgtcctctctcaaatgagctttgccagccagtccatgcctaccatcccaggtatgccccctgctgccaccagcatgagggagtagagatagtgcaggccaccagccttgtgggtggaggatggatgggaactgtgtctacacaacaaagtgggccaggcatcctggagtgagaggctctgctcatagccacccaccctctaatctctccccacacccaccacttcctgggggtgacaccatcccagcaagctccagcagggacaggggagaggcctgctgtcccttgggccctcaggattcactgagcatccatttgtcacactaggtggccccttgttctcagttagccaggcctccccaggggccagaagtttgcccttggtatgtccctaagacctgtggcttctttgtggacctggaagactctttctggctttacagaaatggccaccacatcttatagctgcaaagtgtttggtgcatagatgctacctatctgccaccgtcgtcactcactcactgtccagtgaggaggttagagcacagccgatggtcctaactcacagaagggaatctgaggccctaacaggggacatggcatgcctgagagcactccatctggtaggcagaagtccttgacgtctgctgctatgtgcctggctctgtgtgctaagggccaggtcagaagggaacaagacaggaccagtgctgccctgtggaactcagcaggccgatcatggtgaagacgcttgctgtttcctgaacattgagggtgccaggccctgcgccaactgctactccttctttatttcatttactccactgcgcatacccaggaagtagttcatgttatccaccccattgtatggatgaggaaactggggcactgagaacatcactctcttgcctatcaccagccagcaaatggcagagactgagttcagacccaggccctcttccctggaacaggcacctacccactgccccgccaccacccccaggatagcctgaacacagctgcaacatttggcccaagccatttcactggtatctgctcagcaggtctcaccacaccctggcggtctgggctctttctcccatttggccaatgtcaaaaccagcagtcagagagtaactaatttttcatgtctctgtgacgccaagctggggctgtaaccactaggtcatctggcccctccaccaggtgacacgtgggtttgagactctcttcccgctgtctcctgcaatggggagagaaatccagggtgttggtgttgggagctggaggaagagtaagctcacactgtcccctgccttggagcagaaggttctgtttcctggggatgtcagggctttggggcaaggttttgaccaggagccaggaggctgaacccttgtctgtagggtgggcaatcttcactgcaagaggacagcttcaatgtcccctggcacggcaggaaataggcatcctgcctcctgcttggcacatacaatgtgtgatccctggatgctggctctgtcccccagccctccccctgtctacctcccccaaggcactgcccctcctctacccacccattcacaccccagctctgctctccttccagccctggcgctctcagtggcaggcatccctgggttggatgaggccaacacatctccccgcctcagccagaccttcctccaactctcagatggtgacaagaagacactcacacggaagaaggtcaatcagttcttcaagacaatggtgaggacattgagggtggaaggaaaggaaggcattgggaggagaaagggaagagagcaatgcagagagaagaaaatggggggttgtgtgtgcatatgtggtcattcctagggaggcatagtcaggaggccctgagttctgggacactgtgcagcaatgcccagagggcagttctcctctggggcctcaggcagctcctctgaccaggattgaccccagctagggatgtgcaggacccagggacctcagaagcagtaggtggcctaccctcgcctaaactgccccttagtgctccagcccttttttattcaacctatatcacaaaatcctacaaattgaacattagtttccaagcgctgattctgcaagtcccatctcctattgttacttgttggcctttgctcaagatcaagaaggtaccataacacatctgatcctcaaggtaatatgaaatcaggactctgctactacaaatatctcaagtttaccatgagcacacgatgagtcaggcaccatgctaagcacttcccaagcatggtgccatttgagctcccactcttaggattttatatgggaggctcacagggtttggtaagtgaggtgcccaagtccacatggctagtgagcctgggctcactctactgtctaccactgcctttctggccaaagccaagggcatagcagctcacattcactgggctttgggcaggggtcagtgttgaggcccttgtgattaggactgggaagctccattttggtgcttaatctgataatcgcatcttggttttgtgcttgtttattctctcaaaagctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgaatgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaataa

SEQ ID NO: 1687 - DNA, 250395 bp, Homo sapiens
  source 1..250395: mol_type = genomic DNA
gacagacgaggtttgcgcttggctgggcatgttccgcggctactctgcggcgcgccaggcccccgctttccgcaccccgcgaccctagaagccaccgaaccgccggcgggccatggccactctgccgagcgcagagcgccgcgcgttcgcgctcaagatcaacaggtaagacgccccccgcggcgcgcaggttgcggccggacagcccagcgctggtgtgaagcggagcttcgctgcaggggccgaggccggacgagtccattcgcgtccgcggcggggcgcgcctgagacctggggcgcccggttcccgaggctgcggcggtggagccgctggacgcgcggcggctcctgcgctgggcccggcgaggtcctccccaagaatctcggtgctcctggatgtcctcagccgccggggatcccttccccgaacaacctcgcccgctccgccctccaggttcttacaggtggccgggtcccagaagggtgataggcgcctgggtaaccgtgttgggcgcgccacggagtgtctcataaacggctccttcctttgaggcaagtctgagcgcggggggaagaagtgaagtggctgaaattagagttgcgtttgaggcaggctgcaagccttctgtcgtcctgagcaaggctccgtcctcgcctgcttcattattccagaaagagcttggctcctggtggcatcgctatttttataccctggtccaaaggagccatgaagtggaaaaagtgattttttaaaaaatctacacttaaataaaccaaaagaaatggcctgtggctgacattttgagatttacagaactccagcaaaaagctaaggactgggggatcccaactcaccatccaattcctaatcaaagttgcacaaactaaatatgtaagcacatttactgctcaaagttctcagtaaaggtgctttaactgcagtttttcctccactaaaaactgctgacaagtaattgggacatttttgtcttgccctgagaaagctagactgtctagttaaaagataataggaaactcattctaaagtgtcaacttattctattgcccacagggctgtccgatttgttaatcttcacttagctgagcctgtgaaaggtggattccaccgtaggttcatctttgtgctgttagtgtgtgaagaggtttgaacaaggaattaaaagcctagaaaaacaaggcgataaggtcttctagagggcatatcgagctttattgacgattttatttccacttgatacgtgactgccagcaaactgtttctcttaccttactatttcgtcatctgtaaaatgagtttaattatttatgtatattgcatattaatgttggaggccaaaaggtactagtcaaaaggcataaagaggctgggtgccatggctcacacctctaatcccagcaatttgggaggcccagatgggaggattacttgagcccagagtttgagaccagcctgggcaacatagtgggacccctgtggctacaaaaaaataattttaaaacattagccaggtgtggttgcatgcacctgtagccccagctattcaagaggctgagacaagagcatcgcttgagcccaggaggatcacagctgtgatcatgccactgcattccagcctgggtgagagagtgaaaccttgtctcaaaaaacagacaaaaaaaaaaaaaaaaaagcaaaaacaaggcatgaagtatatcagggatctccctatgggaatttttttctacattaaggttcatagctgttgcatgccaggaggggtaattcattcaaggagtatagggaatcaaactgaagttactgatgggtgtattatttgctatagctcctgatcctctgtctttgtgaattttagatcaggaagtgtgactggggcagaaagatgttagaaactatggggttgggcagggttgatctggggtgagtggccgagacccggactaatcctacaggcagtcttgcaagcaactgcggggtcggtgtcacctgggggttaagaataaaggccctggttagtgtctgatctgcttgcaaattggctctctgctacaaagtcactgtgcaacattggacatgttacttaacttctctaagctttggtttctttatgtgccaagtagagttgatcatagtacctacttcttatgactgtggggaggattaaatgaataataggtacaaagtccgaattgccaagtgctggatgtgtaacatacacattggaatttagagacagtacagaaaaaataatgcaaaatgtcttgttaatgattttcatgttgattgcatgttgcttgtagtgtctggctcagaataaatggtgaataattcttagttgccatcattaacattacaatcagcttcactgctgtcattatctccatcatcaccatctttgagagcctaagatagaaaggtaggaaggaaagctgaagttggagagcttcaggcagagatcagtttgggttaggtatggagatgccagtggctggctgggagctttcttggggccagtgtttctccgcctgtgccttccatctggtgctgagaacccaaaacacattcaatggaagaaaatatgtgatgaaatctgatcaagaagagccccctcaagtttaataaagtataaaaggttctataatcctcaggcaagaaaatggattggaaattcgtattcttagagttctgttttcctttttgaagcactctgtgtgttgtgtgggagagttatgctaaggagcttggcagaaattattattcaaaggagcagattaataaggacatacctagtattcatatatcatttaatttcaccatttattgtttacttattgtgtcccagacactatattatacagttaatggattttatgattaaattctcacaaaaagcctatcaaactcatgaagtcttgtacagaagaggaaaaggaatcttggagatacagctgcacaaggccatgtaattttttcaagaccatacaaccagcaatggcagagctgggattgcaaactgctccaaagactgtgctcttaattgggccgattgttattttgatgcatatgtatcccaagaatttcctttaaagcaagaggggaattaatttttaaaaaatcatcattttggtagcagcattggcaaagtgttctgtttctgattagtgtttaatatataaacattaacaatgtgatgttttgcaatgttgaaggtggaaaagaaatgttttcccttacgtgcctacctattattttttttaaataggtcaaattccaaaagtaagactgtgttgaaatatggccattagtacattcagcatgtgctcatgtttttcaccttactactcagaatagtgtaaactatctcttaaaaatatttgtgggataaaaccagtgtgcttcctgttaatgaagtattcaaatctgatatattaaaaatattatttgtaaagcgttcagttctgaccacaccagtctccagaaggagtgagcagactatctcacagtctgagaagaaaggtgaaattaattttcttgtaagtgctatatacttgtcttcatttccatttttttgttgctgacttgcgtgccaaggaaagactagatctaagttaggcagttcgtaataacatttgcgtttgggatttcaggtgctgctgcattaaatgtcataacatggtacttgtgggaacatctagtcttgttaattgccttttttcttactggaatttagtgcctttgtagattataaaaattattactagtactctgaaaatttattaaacaaaatcttagtgtctttcaaatacagaatagatgtaaaatttgatcaaatattaaagtaaaataagaaccttggataaagaggacgaaagtgtagaatgcagaaaaaaacattaaccctcttgtggacagtcaggattgaaaggaagaaaaaataatggcttacacttctagaatgctttctatgtggcagagacagttctaaatatttacatatcgtaactcattcacctctatgagataggagcaatgactatctccgttttacagatggagaaactgagtgcagagaagatatagaaattgtccaaactcacaaacaactaattaaggtcacagctgagattcaaatgcaggcagcctggctccagagtcttctcttttaatcattataccatgctgccatctcagttttattttaaaataataataggtaacatttattaattatttactatgtgctacatattgtgctaagaactttatataccttcatttcgtcctttcagaaaaggaacaaacagagctgggtgcactggctcacgcctgtaatctcagcattttgggaggccaaggcgggacgatcacctgaggtcaggagttcaagaccggcctggccaacatggcgaaaccccgtctctactaaaaaatacaaaaattagccaggtgtagtggtgtgcacctgtaatcccagctacttaggaggctgaggtgggataattgcttgaacctgggaggtggaggctacagtgagctgagatgtgccactgcattccagcctgggcgacagagtgacactctgtttcaaaataaaataaaataaaaaataaaaaaggaacaaagtattaggcataataatcatcaccagagagtgattttatgaaagacaaaaacaaggtggcaagaagagagaataaagttacataaagatagcatttaagaacaaccacaggctgggcatggtggctcacacctgtaaccctagcactttgggaggcctaagctggtagatggctcgagcccaggagttcgagaccagcctgggcaacatagcaaaaccctgtctctacaaaaaatacaaaaattagccagctgtggtggcttgcacctgtagtcccagctacttggaaggctgagatgggaggatcactcgaacccaggaagttgaagctgctgtgagcagtgattgcgccactgcactgcagcctgagtgacagagcgagactctatttcaaaaaaaaaggaacaaacccaataattttgggcataacgaccagagcacaatgagctacagagagctttctgagaagtatttgctaattttatctgcaaagataatacaagcataaaaatatatgtattcaaatgtatagatgtgtatctgcagtgagagcagagctgttcctcagtagtgggggtggctggcagagtgaggtagtgtgctttcaggaattgctttatttgtctgatgtgttctagaccaaagaccaacagaggggcttgggcaatcagacacagaatttttggcctttcacatttagaatcggttccttccagattcttggaaaaggtccatttgtgctttaggcatctagtgctattctgaagatgccttacaaaatgtatgctgaaataaccttctaccagggtgaattttcttcatttggagttctttgagttctgaccatttatgtatattgatgaagctaatgtttacttcttcatagaccagtggaaagaaaacgtagtaacatgtagttgcccagggaaagatgaagaactcaggggaccaagtctcccatctcaactccccataaaggtagtgatggaatgggatgatgttaaaaacacctcaactttccgtcctctttaagggaccgtgagaaggtagggatgttaccatactcagacttcttgctgagaaagctaagaaacaaaagcatttagtttttttcagtggcaggtgcttattaacgtttggcctatttgataaagggttaaagcaacaggaatgtgctactgctgttcccacaagcagtagtctaatttctttctttttttttttttttctttttttgagacagtcatgctctgtcgcccaggctggagtacagtggggccatctcggctcactgcaacctctgcctcccggattcaagcgattctcctgcctcagcctcctgagtagctgagattacaggtgcgcaccaccacgcccggctaatttttgtatttttagtagagatggggtttcaccgtgttgttcaggctggtctagtcttacccagtcagcagcagaaaggctctctgggctctaggtaaacacatgaaatttatatagtgtgtttaagtgtggttcctgtgcttctggagttggcacagtagtggtaccatttgctgtatcgacaacagtgggggtatagacgaaaaacagattgacacctctgaaagtatatatgaacacatgtcgatgcagcatttctggtgaaactaagcaaattgataaagttggcctagggtacaagacattatgtcatgtcccactgcattatgattaaacccaagattagaaaggagaaatgatggcaacagaaccagtttctccagctgtctattctcatgttcatcatcacagataggaaagggcagccggccctctgcatctgtgggcacatccctggattcagccaaccacagatcaaaaatatttggaaaaaaatgtagatagttgcatctgtactgaacatgtacagacttttttcttgtcattattccatacaaaatatagtataataactatttacatagcatttacattgtgttaagtattataaataatctagagatgatttaaagtatacaggagggctggccaccgtggctcatgcctgtaatcccagcacttttggaggccaaggtgagtggatcacttgaagtcagaagtttgagaccagcctggccaacatggtgaaaccccatctctactaaaagtacaaaaaaaaaaaaaaattagccaggtgtggtggcaggtgcctgtagtcccagctactcaggaggttgaggcaggagaatcgcttgaacctgggaggcggaagttgcagtgagccgagatcgcaccactgcactccagcctgggtgacagagtgagactctgtctcattaaaaaaaaaaaaatcatgaacaactctgcatgtaaatcaatacagagctgcattataatttacataggctgtataaaatcctgttgattagatgtaaaatgatttattaaattaattttctattattgggcatgaagataggttccaggctgggcacagtggctcatgcctggaacctgcctcccggtgctttgggaggcagacacaggagaatcagttgagcccaggagttcaagaccagcctgagcaacatagtgagacaccagctctacaaaaagcaaacaaaacattaggcagacagggtggtgcatgcctgtggtcccagctacatagaaggctgaggtgggagggtcacttgagaccaggagtttgaggctgcagtgagctatgattgcgccactactctccagcctgggccacagagtgaaaccctgtctcaaaaaaaaaacacaaaaaaccaaaagagataggttctgacttttcacaatagtgtatagagtttgatggagcagtcttatacatacttttttctgcgctagtgcaaacacctccttacaaatttctaacagtataattggtcataggaaagaaacatttttcaagcttttgattgccaaattgacgcccagaaaaggtatacctgtttctgctcctaccagtggccctacgaatgctcctttccccacattcacacccccaccgagttttatcattcttttaaatctttatttgccagtgttgacctcttctcttaaatgcctgtaacctcttcctgtttagcttctctcctaggtcagagagtgaactctgaagtcattctttagggattaaaatagtcatgcatttctccttttttctttgccttacatgcaaccataaatggtgagaacttctatcctttttcactttctgcttctgttcctttaataggtggattaatgataaaggtagattgttcaaacaacttagttatttcttaattttgttgtaagctctagttgccagactttaaactgtgctttttactttgcttaacaatgtaatccaatctacctcctcctttgggtgcctaagccatagcccttttaaataaaatagcaaatggaaaatcagaatccctttctatcgcaaaataagagtccagattacataactcattgtatgtgttttcacttggatgagagaatagagagtatggacctctttcatactttttttttaatgttccttttcctctagaattggtttctggggctaaaaggaaacagtagttagtaccactctgctcagaaacctcaaaaaacttcgacttctgtcattctcatcaaagggcaaaattcattgttcttctgtgatagagaccaaaaatacaaatagctaaactggaactaaattaagaaaaacagaagttaataaactccaccgcctcactcccatctcttcgtaagttagtaggcttgtaagtcctaggctggttagttcattcatttgttcactcatgccagccattgaggattattgtgttctaagtgctgtgctaagccccagaaatacaaagacaagtgagtcatgggcctgcctgcaaggagtgaggagatttactcaaaattgagagctggaaaaagaaaggcactttccctggcctcatagccctccgtgacttcaaagtattcctctctggggtcatgccactagggataatagcattatccaaaaacatttttggaaatccttttagaattattctcagggactggagtacatttatttttaaaaagaaacttggtgttttaaaatctttttttttttttagggagaatctgctttattatttgagaagtttcaaaaaatatagaaaatacagatgataatatggcaagtatctaaaggtctccacttaacagaattaacatctgttaacattttgtcacttttgctttagttgttttttttttaattaaaaaagagaacattacagataaatgtgaagtccctgttattctgttgcccatttctgttctccctgctgctccctgagagtactaacacaaaggtgtacttctggggtgtgtgtgtatatgcatatccataaacaatatatggtatagcttctggagggatccaaagtcattagcactcaagcaagcctattaaataaaataatatcagcttgagttaaagataacatatagccgtgaaataacggagctgatttttaggtaccttgtcaaatagttctgaaagtaattgcaaagaggagttccaaaagtgagttcagaaagacagctttatcagaataaattgcatggtactgcatacaggaaactataaagaacaacggttatttagaactgttcattctgacagtgtttttcaattactccttaatattataaccacttactcatttcctgaaatcaccaggaaatttttcaaaaagatttttctcccccgatgaatatacccacgatttgcatttgacccaagataagcagttgagtcgataacatgttaatttttaaatacatggttttaaaacacagaataaaaattctacctcattgcttggagactcaattaaggagagtatgcacattagcaaaaagaagatgtgatatttgctcagaagtcttgaagtggatattttggccttcgtatggctgaatggtcaagcttgactctctcgtttgctcagggaggcccagtccctctgctgccacgggtagaaatactttttcctaaatcgctgcttcttctcactgccatacagagcaatattcaggacacagccaaaaccttctttggcagacctttttgagttctctctactcagctttctgctgtgtaatatgagcactctagagaagttgggctgtcctcaggaaattacacttggggtctgtggttccccaggaagacaaactggagctccctaaggggtactagtcatcatacggcatttatactagcattgcagtccactttcacctatgcaagtagaaaaactcaggctcaaagtccactgacaatgcaggagtcccttatctgctggttaacataaatgttgttttaagatgatggccatctgttgtctgtgagaacaagactatcacccacctgttgacatgctggctggtttaatatcttactctttcattccaaataactacctggtctcacagatccccttagatggggtatccaatttacctcctgtaccttattctctgtccaataatttcactcaaatcaacaagatattttattgcctatgacttcctctaggtattacgggagattcaaaacacaaacagacaagcagcctatgccctcagaatccagctggggtgagtgggtgactataaatgcaaaagttagagagcatggggaacagtgtttgattgtgtggctggggaggggtaaggacaaaaactcagagagagagaagcctgtagccctggctacagaagggcaacacctctgaggagatgagtctcagctgggccctgaagggaggtgactcacagatgaaacaaacctggtgggaagaatagttagcagtgtgcagaaggcattggaagggattccaggggaggagtgaggagggagccacagtcattccgatgtgaggtagtgagatctgggattagactgggtcatcagaatggaaaaaaagggcctgcttctgcagacagtttaaaggaatcagctggatgtgggaagcaactacatacttattcattcattcatttcatgcatattgcttatagcctactatgtgcctagcactattctaagtgctgaggatagagtcatgaataagatagacagggttcttattctaaaaaaagtaatataccagtggggagacaatgaagaaataaaccactaaataaacaaggaaacatcagataaaataagtgtgatacagagaatgtaaacgggccattgagagggcatggattctttagatgggatggtcaaggaaagcatctcttagagaaaaacctctgagccaagatcaagcaggggaatgacgaagcacatgactgaggcaggagtaaatttgatgtgttggaagaaaagcaagaactggtctgtctctagtggagtgaatgaggggagaggaggagagctgaagagggaagttagcaaagaacgaatcacataaaagccttaaaggcaatggaaaaaatttaaatgttattcaaagtgcaatggtgtattagtccattttcatactgctatgaagaaatacccaagactggataatttataaagaaaaaaaggtttaatggacttacagttccacatggctggggaggcctcacaatcatggcagaaggtgaatgaggagcaaaggcatatcttaaacggcggcaggcaagagagcgtgtgcaggggaattgccctttataaaaccatcagatctcgtgagacttattcactatcatgagaatagcatgaggaaaaacctgcctccatgattcaattatctcgcacaacatgtggggattatgggagctacaattcaagatgagatttgggtggagacaaagccaaaccatatcaaatgggatggtttatggagcagggcatgatgcgattgacttttgtgtttaaaagatctattgtacaaagaagcaaggaaaccagctgggaggcagtggagaatccaggggaaagatgacgatggcaaaactagagagcagagctgagaaggagagaaccaggcagctctgggataacattctggagctagggctgacgaattagatatggggtggggcaatgaaaaacaaaaaaaaagagaaatcaagatgtctccagggttggatattgatgcttttaacagagattgaaaagactggaggagaagcaggcttttagggtgaatcaagggtttaactggggacatatggagtctaagatgcatgttagacattcaagtagaattagctactatgcagttttatttaggaatctgaaactcaggggagaagtcaagactggatatttaagtttgcaagtcaataccaaacatatttttacataagaaggaaaaaatattgatatgattttgataagtttttaatagccagaaagctatatgcgtaatatggtatcattttaattaaaaaataaatatatgcataactctctgcagagataaatgatcaatacatataacaaggagagaaccagaaggacatacgccaatatgtcatgagtgttatctctgggtagtagaattattgatgacttttgtgtacttgggacatgcatgtatgagtgtatgtatgcatgcatattttgcaagttttcctcaaaggatgcttttgtaattggaagaagaagcaattataaaataaatggcacaagatttccatcctggtcaaatgggataaggatgatgccaatgagaaattatgaaaattggaaattagacttagttttggggggatgattttttacttccctcgtagaggttttgtttaagacgatgtagtagactgtacctttacatatatttgctgtccctcccgatgggaggattttacttttcacctgttgaaggtgatgtggtcacttggaggtgaagagatagcctggactttgtcacattatctttctcctattctaaacaatctgcagcgttccaggtggtggatgatctgtcatcctgcatcctggagtaaagatgattaaagcagagctgcagctgccctctgaaggcctttgtttttgtaaaccactgagatttttgaattgtttgttatctcaccataacctagcccaccctaacacagatgaacataaaatacagaacatttctattgggcggcttgaaatacaggcttggggcatcagtggtaggtcagcatggaaaatgttgattaaaaagtcatctgtgaggtggagattgggactgaagaatggataaattttctgaatggaaagtataaggggaagagaagaggaatgggcctagaggaagagtcactgtcaatccatacaaaaagaagagatacgaaaagataggaggggggatttggccaacacatggcagaccgttgtagtatcagaaaagagagctaggagggtagttacaaagatcacatgccaaattatgagggcaaagagccattggatttaccctgaaggtggtcattgaaaacctctgaattagcagttttagcggagctgtggggaaggaagtcaggtttcataaggttatagagggagtccatgcagaggaaatagaggaagctggtggaggccactcctttaaaaagcctggatgaggccgaagagaaatgggacaagtggtaaccagaaggcccctacaaggctgtgacttttacacaaatatgacatacaatgctgaacaaaggatgtgctgatcttacagaggaaggatgtgttttattcccaaaaaaaactttacatatgggtaaagttattcaagagaccctgtgctgtctaatatgcaacaaatttttctttgcaccagcattaagacttctaacaataagtaaaatattctatttagatactttttacaggagattttgaaactctgatgacactgacatactacctttcagaacatggtactgtttaaaattttattatttttatatttatcttcatatgtttaaatttgaaaaattacaggaaagagtacttttataattatgtttttctgtttacaaaccacctcctgtgtgctgaattttgcctccccaacatttttcaggggagcatggccctactcgcactttgagttcagatttctggccttcagaactctgagaaaataaatttcttttgttttacgctatccagtttgtggtagtttgttacagtagtcctgggaaactaacaaaccaccccaaagtttagtgacttaaaacagccattattatttctcacaattctgtgggttggcaatttgggctgggctcagctggacagttattctgctggtcttcctgtagacattcacatggctgccattatcgggtggctcaagtgaagctgtagggtctaagatgggctcactcacaagtccaggaccttggtgctgactgttggctgagctttccctcttcacacggtctcttgttgttcagaaacctagctggtcttttttgcattcttagctggtaaagggaacattctaagagaaggaaggtggaagctgcaaggcttcttgaggcttaagtctagaactctccaacgtcacttccaccacattcattggttaatgcaagtcataaggcaactcagcttcaaagagtaggagaatagaatcaacctattgaaaggaggggctgcaaaatagttggtcattttaaccaaccacagcacccaaccaaaaaaattaatactatcccgtttcagatttcagaatgtttaatcagaaggccttgtctttccctacgtatatcacaatacccattttagtggcagagaaactgagaccaaataaaactgactcctttaaagttaccaagtgagtcatgctttgtgagagacatgaagacaactatatgtctggaagagctaaacatagtcctgcctggaggcaggtatatgaacttaataatcccttgagatgctcttaaatcccataattacactgatggactccagattgcagagctgtctggtccagagataaagcagcggtttgagagtatcagagagagaaggtgcctgaaaattgccacatgtccccaaaggcaggatttgaggctaaattaaatgataaagagttaccaagctctttattctcaagagttaccaaataagcttagaaactcaatgactgctgctgtctagtgttagttctggaatgggagaattaaaaatgagtagaaaaagaaaatagagacagagagactaacatatctgaaagataggtgctgtgggcagtcttagaaggatcacccctatatcaattaggattgcttttagctgctgcaagtaacagccaaccaaaccatccaatggtttaaacaaattaggggtttatttttttcttttcatttatttatttatttttaaatttaattttattattattattatactttaagttttagggtacatgtgcacaacatgcaggtttgttacatatgtgtacatgtgccatgttggtgtgctgcacccattaactcatcatttagcattaggtatatctcctaatgctatccctcacccctccccccaccccacaacagtccccggtgtgtgatattccccttcctgtgtccatgtgttctcattgttcaattcccacctatgagtgagaacatgcggtgtttggttttttgtccttgcgatagtttgctgagaatgatggtttccagtttcatccatgtccctacaaaggacacaaactcatcatctttatggctgcatagtattccacggtgtatatgtgccacattttcttaatccagtctatcgttgggcatttgggttggttccaagtctttgctattgtgaatagtgctgctataaacatacgtgtgcatgtgtctttatagcagcatgatttatagtcctttgggaatatacccagtaataggatggctgggtcaaatggtatttctagttctagatccctgaggaatcgccacactgacttccacaatggttgaattagtttacagtcccaccaacagtgtaaaagtgttcctatttctccacatcctctccggcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtttgttcatatccttcgcccactttttgatggggttgtttgtttttttcttgtaaatgtgtttgagttcattgtagattctggatattcgccctttgtcagatgagtaggttgcaaaaattttctcccattctgtaggttgcctgttcactctgatggtagtttcttttgctgtgcagaagctctttagttgaattagatcccatttgtcaattgtggcttttgttgccattgcttttggtgttttagacatgaagtccttgcccatgcctatgtcctgaatggtattgcctaggttttcttctagggtttttatggttttaggtctaacatttaagtctttaatccatcttgaattactttttgtataaggtgtaaggaagggatccagtttcagctttctacatatggctagccagttttcccagcaccatttattaaatagggaatcctttccccattgcttgtttttgtcaggtttgtcaaggatcagatagttgtagatatgtggcattatttctgagggctctgttctgttccattggtctgtatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaacgtcattggtagcttgatgcggatggcttgaatctctaaattaccttgggcagtatggccattttcacgatattgattcttcctacccatgagcatggaatgttcttccatttgtttgtatcctcttttatttcattgagcagtggtttgtagttcttgaagaggtccttcacatcccttataagttggattcctaggtattttattctctttgaagcaattgtgaatgggagttcactcatgatttggctctctgtttgtctgttattggtgtataagaatgcttattatttttatacattgattttgtatcctgagactttgctgaagttccttatcatcttgaggagattttgggctgagacaatggggttttcaagatataaatcatgtcatctgcaaacagggacaatttgacttcctcttttcctaattgaataccctttatttccttctcctgcctgattgccctggccagaacttccaacattatgttgaataggaggtgagagaggacatccctgtcttgtgcccgttttcaaagggaatgcttccagtttttgcccattcaatatgatattggctgtgggtttgtcatagatagctcttattattttgagatatgtcccatcaatacctaatttattgagagtttttagcatgaagcgttgttggattttgtcaaaggccttttctgcatctattgagataatcatgtggtttttgcctttggttctgtttatatgctggattacatttattgatttgtgtatgttgaaccagccttgcatcccagggatgaagcccacttgatcatggtggataagctttttgatgtgctgctggattcggtttgccagtattttattgagtatttttacatcaatgttcatcaaggatattggtctaaaattctcttttttggttgtgtctctgccaggctttggtatcaggatgatgctggcctcatcaaatgagttagggagtattccctctttttctattgattggaataatttcagaaggaatggtaccagctcctctttgtacctctggtagaatttggctgtgaatccatctggtcctggactctttttggttggtaagctattgattattgcctcaatttcagatcctgttatttgtctattcagagattcaacttcttcctggtttagtcttgggagggtgtatgtgtcgaggaatttatccatttcttctagattttctagtttatttgcaaagaggtgtttatagtattctctgatggtagtttgtatttctgtgggatcggtggtgatatcccctttatcattttttactgcgtctgtttgattcttctctcttttcttctttgttagtcttgctagcggtctatcaattttgttgatcttttcaaaaaaccagctcctggattcattaattttttgaagggttttttgtgtttctgtttccttcagttctgctctgatcttagttatttcttgccttctgctagcttttgaatgtgtttgctcttgcttctctagttcttttagttgtgatgttagggtgtcaattttggatctttcctgctttctcttgtgggcatttagtgctataaatttccctctacacactgctttgaatgtgtcccagagattctggtatgttgtgtctttgttcttgctggtttcaaagaacatctttatttctgccttcatttcattatttacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttactgccaactatgtggtcaattttggaataggtgtggtgtggtgctgaaaagaatgtatattctgttgatttggggtggagagttctgtagatgtctgttaggtctgcttggtgcagagctgaggtcaattcctcggtatccttgttgactttctgtctcactgatctgtctaatgttgacagtggggtgttaaagtctcccattattattgtgtgggagtctaagtctctttgtaggtcactaaggacttgctttatgaatctgggtgctcctgtattgggtgcatatatatttaggatagttagctcttcttgttgaattgatccctttaccattatgtaatggccttctttgtctcttttgatctttgttggttgaaagtctgtttcatcagagactaggattgcaacccctgcctttttttgttttccatttgcttggtagatcttcctccatccctttattttgagcctatgtgtgtctctgcacgtgagatgggtttcctgaatacagcacactgatgggtcttgactctttatccaatttgccagtctgtgtcttttaattggagcatttagcccatttacatttaatttaatattgttatgtgtgaatttgatcctgtcattatgatgttagctggttattttgctggttagttgatgcagtttcttcctagcttggatggtctttacaatttggcatgtttttgcagtggctggtactggttgttcctttccatgtttggtgcttccttcaggagctcttgtagggcaggcctggtggtgacaaaatctctcagcatttgcttgtctgtaaaggactttatttctccttcacttatgaagcttagtttggctggatatgaaattctgcattgaaaattctttcctttcagaatgttgaatattggcccccactctcttctggcttgtagagtttctgccaagagatcagctcttagtctgataggcttccctttgtgggtaacccgacctttctctctggctgcccttaacatttttcccttcatttcaactttggtgaatctgacaattatgtgtcttggaattgcttttctcaaggagtatctttgtggcgttctctgtattttctgaatttcagtgttggcctgccttgctagaatgggggacttctcctggataatatcctgcagagtgttttccaacttggttccattctccctgtcactttcaggtacaccaatcagacgtagatttggtcttttcacatagtcccatatttcttggaggctttgtttgttgctttttattcttttttctgtaaacttctcttctcacttcatttcattcatttcatcttccatcactgatacccttttttccagttggtcacatcggctactgaggcttctgcattcatcacgtagctcttttgccttggttttcagctccatcaggtccttttaggacttctttgcattggttattctagttatccattcgtctatttttttttcaaagcttttaacttctttgccattggtttgaatttcctcctgtagctcagagtagtttgatcgtctgaagccttcttctctcaactcatcaaagtcattctccatccagctttgttccattgctggtgaggagctgcgttcctttgcaggaggagaggcactctcatttttagagtttccagtttttctgctctgtttttttcccatctttgtgtttttatctacctttggtctttgatgatggtgacgtacagatgggtttttggtgtggatgtcctttctgtttgttagttttccttctaacagacaggaccctcagctgcaggtctgttggagtttgctagaggtccactccagacgctgtttgcctgggtatcagcagcggtggctacagagcagtggatattggtgaaccgcaaatgctgctgcctgattgttcctctggaagttttgtgtcagaggagtacctggctgtgtgaggtgtcagtctgcccctactggggggtgcctcccagttgggctactcgggggtcagggacccacttgaggaggcagtctgcccgttctcagatctgaagctgtgtgctgggagaaccactcctctcttcaaagctgtcagagagggacatttaagtctgcagaggtaactgctgtctttttgtttgtctgtgccctgcccccagaagtggagcctacagaggcaggcaggcctccttgagctgtggtgggctccacccagttcgagcttcccggccgctttgtttacctaatcaaacaactaactcggcaatggtgggcacccctccccaagcctcgctgccgccttgcagtttgatctcagactgctgtgccagcaatgagcgagagtccatgggcataggaccctctgagccatgtgtgggatataatctcctggtgtgccgttttttaagcccgttggaaaagcgcagtattagggtgggagtgacccgattttccgggtgccgtctgtcaccctttctttgactaggaaagggaattccctgaccccttgcacttcccgggtgaggtgatgccttgccctgcttcggctcacgcatgttgcgctgcacccactgtcctgtacctactgtctggcactccccagtgagatgaacccggtacctcagttggaaatgcagaaatcacccgtattctgtgtcgctcacgctgggagctgtagactggagctgttcctattcggccatcttggctcctccccttatttatttttttcttacataacaagaatgccagtggttggccctgcaggcttggtgtcatggcccccaaggtaccactggagactctggttctttgtgtctttgtgtcccaccaaccttagtgtgtggctttcatccttatggtcacaggatgactcctaaaactctgtacagtgaatcagtattggagacaggaagaagaaaggaggtaaaaaagacatgccagctaactttgctcccattaggaagctcttctagaagctcacagaattacatttgtttatgtatttcattattcagagctgcgttagctttgtctacaagggagattggcaaatgtagttttcattagcccagcacattgtcacccccaacaaaactagggttgagttagaatgaaggggctagtgcatattgataggccactagtagtttctacacagcctccaacaattgctgtggatgtagattagtaacagaacttccactatggcatcatagcacctctatcccactagtacctgtagtaggtccaaatcatctaattccaggagcctggcttaaagaagaggaatattgaggcttctaggtccagtattaatcaaggtaagctagctgtgagaacaaacaatctcaaaatctcagtgaacgaaaccaacaaaaacttgtttcatgtttatatcacagtctgatgcagatcgagtggttctcctccaagcagtgactcagggacccaggctgcttccatcttacagctctaccatcttgtgactttcagattatgttggcatcattcagccagtgactaggaagaagagagaatgaaagattgtgcacccaattcttaaatacctccactcaacactgggacacatagcttctactcacacttccctggggaggactgcttacaagattcatcaatctgcaaggagggctgggggaatatattatagttcttgcctggcggcacttccagcaggaacacttcactatgaaaagggagcacaagtctttggggggacagctagccttctgtgccacaaaagcccagtcacaaagaaaaagccattaccaaaatgttccataaacaatgtagacctactgtggtttgctgttgtctgatagataaaaactgtgttgttttagtcacaaggatttggatgtgggagctgcaaggaaagcaaaagccaaacaagtacagctgaagcacctgagatcctaggaggagacaagaagaatacaaggtgccattgtcctatcagccaggcagaaagatggtaggaaacaaggccatttaaaatctaattgcaattgcaagggctgggtgctgtggcttacgcctgtaatcccagcactttgggaggctgaggcaggtggatcacttcagctcaggagttcaagaccagcctgggcaaagtggtgaaacctagtctctacaaaaaatacaaaaattagccaggcatggtggcatgcgcctgtagtcccagttactcaggaggccaagatggaaggatcaattgagcctgggaggttgaggcttcagtgagctgtgattgtaccactgcactccagtctgggtgacagagcaagaccctgtctcagaaaaaataataataaaataaaatctaattgcaggcaaggccacaggaagtggcaagtgcaactaaagacttcctagaaatcccacacattgataagcagccgggttgttcagccagtttttttttctgagaacaaccaattttaaaatattttaggaaaaaccacaatattgagatatttttaaacagcttatatttaaacagcatatatttaaacaaagtgattaatttagaattcatattttatttgagaaaaaaacaagatgttcctggtctggcagatgacattctaaattattcactcccacttgtggaatagctgagttatagtccggcccctcctctgtagaggaggatttataggagaagatgagtcacgttactttttgtgactatttttctttgcatttgttgactcctcttgttttattcaccttctaatcattgaataatctgtacaatcagactgccttattcatgttggcagttgttttaataataacaatgcacagagccattgctactaacagaaagcagggcagacctttgagtctgagtttggggatacaagtttgattccatcccagctccactgattcccagcgagatgtggttcaacatcataggaccaaatgaaataaaaagcgtgaaaatgctacacaaatcaaagagtgctaaagacatattaatgaaacatctgtaaaatgggaataagtaccacgtttctgaggtagcatgtaatacaactggcacagggttccacacttggtagatactcaaaaaagaaaataaaaagttaacatggacaaagtaaaataaactggaaataggagatggagaaatgttaaaacaacaggcaccataataatgtaaagtaggatttcagctcatttacaagcacagaggttatatggtaagtcctcacttaatgttgtcagtaagttcttggaaacagtgtctttatgtaaaacaacataaaggaaaaccaattttgccataggctaatggatataaacaagagttaagttccagtacatatgtgatggcatatttccagttacaaaatatcaccaaacttctaaataaagaccaaaagactcctaatattaaacattgaaataaatgtgagctatactttcatataagaaaaattaatgcaaacaagtacaataattatttactgagttattccagttcggggtcgtggatggccagagtctatcccagccgtccagggccaagtttggaacccaccctggccaggacgccatcctatcacagcttgcactcacacacactctcactgggaccatttagacacaccgattcacctactctgtgcatgtttgggatgtcaaggaaaccggagtaccctgagaaagcccacatgggggaacatgcacactccacacagacggtggctccagccaggaattgatttattttctcatcaatgttataactaaatgactttgaatgaaacaatgttatttgataacctgctgtatttagagttcacaaaatttatccctctgaaacacatacacacacgcatggccgcacacacacgtgcatgcacacactgcacacacttaatgctaaacttgaaagagatttaaaggctaaaaggaaagttggactttaaatttcccctggagctcacattttctgggtactgaaagatatggtagatacatatgattgccttttccaaaaataacttctatggaaaatcctgagagttataagagactacaaaggtgatttgatagagccacttaagtaatgtatgcaatatgatcaccaggtatacttgtatgagagatgggaaagaaaggaaatattgaaagagcagaaccatgaaggagaagaagcaattgatcctgaagaatagcaactgtagtcagggattagagacctgcaaacaagtttcctattcttttcaaaaatgaagaatagcttcttattacaaaagctgtatatataaattatagaaaagtcagaagtgcaggtaagcaaatactttaaaaatcaaaattatctctaattctttgacttattaatcattttaacagcttgattgatattttttcagatacacacatacatacatacttctacaaaactggaagtatgcttatatattgtatcataacctgcttttttatttaaaaaatatcatgaacaacttttcatgtcattaaatattgttgcattacatttctaatgaatgcataacattccattgtaaggatacagcgtaatttaactcagtctgtattgagctacattgatttccagttattcacattagaaacagtacaccactgaataaatttatgcattcatctttgcttacctctttaatgattcttcacgataaatgctagaaatagaaccacagacttaaaggtctccattgatatgtgtggctcccttgttttcctttgcaaggttttgtgtggcatctgcctttaaaaggttaaagatatttttacttataacatccctgaactttacctcaagtcttggggaaagttattgaaaagtagtttgtattcaaataagtacaaactggcaaggtcaatcttttatacaggttatcagaaacaaatcaacctcataagatggaactaaacccattattatgattgagtcagcaaacttaaagatgtgtttggtttggacaaatactattaattccttaagttccctgtggccacagtttttttttttaatgaatgtttttctgagtaatcttggtcctatttgaggccatcttcatatgcactaccaatatttccagctatacccaacaggtaaactagccctctgtaggcaattaaatgtatattttcctgaagaaagtaaggttatatagaatataagtataaggtcacctagaagagctattaatgtattatggacaatttctttttattgccagagctacatgttacttatatttaagtctgatatttaattctctattatattcccttattattgaattaattaattcatccattcatatgacagatatttcttgagcacttacttgtgccaggcactgtgttagactctggggatttggaaagaccctgcttccctcatgaaacttacattccaatgatggaaacagatcatctgtaagtgcgtaaactaatatatcatgtcagataatgtctcatttccttatctcttaaataaaaaaatattctattccatagggctgttatgagaactgagtgagactatgtggaaattaccatacacatgtttaaaaaatattgtttctttttcctcttatcttttagaaaagggaaaatgattattgtttctttttcctcttatcttttagaaaagggaaaatgatttgtataaatcattaaatactcccttgatattacaaaactagcaaattgttttttgattttattttttaaattgtcacataataattgtacatattcatggtggtacatagtgatgttttggtacatataattatagtgatcagatcaggacaattagcatatccatcatctcaaactctaatcatttctttgtattgggcatgttcaatatcctccctttaagtatttgaaacgacacaatacattattgttaactacctcatcccacagtagtatagagcactagaacgtattcctcctatgtagctgtaatttcgtatcccttaacaaatctctcccatctttcccttccccctacccttcctggcctccagtaaactctgttctactttttacttctatgagatcgaagttttttagcttctgcatgtgagtgagaatgtgaagtgtttaactttctgttcctggcttatttcacttggtgtaatgtcctccatttccatccatattgctgcaaataacaggatttcattttttaatggataccattccagtgtgtatctatcccacattttctttatccattcatttattgtcagacacgtaagttgattccatatcttggctattgtgaaaatgctgcaggaaacatgggggcgcagatgtctcttcaatataataatcttttcctttggataaattcccaggagtgggattgctagatcatatggtagttctaattagcaaattctatattccatattaaaggaaggaataggtaaatttttttcaaattttttattttgttaaagatggagtaatcctcccacttcagcctcctgagtagctaggattacagaggtgagccacagcacctggcatgggataggtaaacattttttaaaatgtttgttttgtttcaggcaaaattaggtatcaactgtttctccacaaagaagagcagcttaagccttcacagcacatagttctgataattcaggtcttcttttgccatttctcaaacatagctatcttgtgttggtacatgcgatctgcagggccttagacgaatcatacatttcatctctctgggcctcagtttcctgaagatgaagttatgttatatggttcgtaaagttcatttcagggctaacttcactttgtccttgtaaaaattatctgcctagtgggtccactccccacctcaccaccccccaaaaaatgactgctgtgctccaacccaagccaatcaaaaatgataaacacttgactgtgacttttttcaagactctgttttacagagaagtggaaaggtctactgtggaatgcttatattttaatttgtcctcattgataggagaggacaaatgtaaactaggagaaatggaaaaaccagtgatacatgtcttgttatgttaaaggaaaaagctagagacaatatgattattaataattattttttaaaattaattcttgcatttattgagcacctgctgtatccctcatatgcattaccttgtataagtcttgtaatagcccaaaaagttaagagtgttcttattctcccaaggatgcagatatggaaactgaaactgagtacggttatgcagtatgtgaggggcaatgctgccacagaaactcaagtctagctgagaccaaacccatgtttttaaccacttgcttcttgcctttgccaatcattgccaccaacgagtcaaaacttacttgttgctggaacatggtttcatcctggccttccacggaatctgttgagcttgttttttttttttttccatatgccataatatgtttagtttcacctcagatgagacagaggatttactttcaagaaagttggacgctgtccactctaaacagtaccagaggtagccttacagcatcagaaaatcctgtggtagtatctcttcatcggaacttggaatatgattttaagagttttttctatcttttcattagagcaggccaacactgacttgatttttctctgaaattagctgtggacaaagattccttttcaaactaaagattctaagcttattttcccccatcactttatcaaaactagaaacaatccattaaaaacactgcccagccttcaggggcttaatcaactcagtggtataaagcatgaaacttgattctgagatccaggagagaatatttggattgccgggaggtgacctttatatgtttctttacgtgtataacaaatacatttcaattcgcgtctagccccttaaaaccagtgcatgtttctgaccctgagtgctactgacattgtgaatcgcactgcaaacagaacacgggtcactgttgttttcctgatctgggaagacatcatggtgtggtgaaagggacagtgcgctgctgatcagacttgggttctgtctctcctctgctaccagtgaaatgaatttcagatgcaaagtggaaagatcaattgtttcttggcctctttgctgagatcaagggaagaagaaagatcagattagttccgtgacagtccaatatttactgactgacccatgttctgtttcatctcaggatttccagggggctccaatttggaccactgcagcggtcccaactgccaacctatgttttcccttcttccctacctttcccctgcagcctcaagtggttccagataaagtgttattccatgtatctcactgtctgaatctagaggactctgatacccaaatgtgtttctcagagtgtgtcaatgaaagggactctttgacccacaatccccctttttcttcacaactccatcatcggcatcctcaaagacaatccatggtgcctactactcctcatcttattgacatgattttaatgtcagctctcgccgggcgcggtggctcatgcctgtaatcccagcactttgggaggccgaggcgggcagatcacgaggtcaggagatcgagaccatcctggctaacatggtgaaaccccgtctctactaaaaatacaaaaaaaaatttagccgggcgtggcggcgaccgcttgtagtcccagctactctggaggctgaggcaggagaatggcgtgaacccgggaggtggagcttgcagtgagcagagatcgcgccactgcactccagcctgggtgacagagccagactccgtctgaaaaaaaaaaaaaaaaaaaaaattttagctctcaaagttttcctccatgttccatgaaaatacactttacaatctagtattccccccaccacacacacacacacacgcacacacatatatactgaaacgaaaccatatccaacttcatttccatttccaattcattcaacattttctattctgttctattgcatttaaaaaacgctggtcacaagccactaaactgatctcagatcagactttaataaatcagactcccccttttatacgcacagagcactctctactgtttcttcctagtacttgtcacaatttgtaagtcctaaatcatgtgattgcctacttaatgtctcccgcaacctgcccctggtgttctgtaaacttcaagaggatatgttttgctcacctttgaatttttagatcccatacaacacctatcatatcataaatgtttaataaatatttattaaaagaattaataaatgaatgtggccaaacctattcaggtctgcatggttcctccctagagttccatcacacttcacagatctaaagtttcctcccagttgtggaggtttgaagctcaaaactgctggaggtgcttcccaccatagctcgtgaaggccctattggtgttttcttcctagtccgtctctagttgatcatgacagatgggccagtgtgttttgaagaagactggctgatgcctcaccaaattctggggacaggtgcctttctccaggggaattcatgaagagactctccaggggcagggcagaccactgggaaaaacaagacccttgggttttctgaccactggccacttgtttttcccacatcaggagagtttatcatctgtgctcatccacctcctgaggttgctttgctggtgctgatttcaggtcccaggcccctaaggtctcacactcactccacaagccacctacacagctgtagttgttttcagccgacagctaggttattttgccttccaagatattttcttttatttatttattcatttatttattttttgagatgaagtctcacactgtcacccaggctggagtgcagtggcacaatctcagctcactgcaacctccacctcctgagttcaagtgattctcctacctcagcctccccaatagctaggattacaggcaagcaccaccatgcctggctgatttttttgtatttttttgtacagatggtgtttcaccatgttggccaggctggtctcgaactcctgacctcaggtgatctgccctcctcagcctcccaaagtgctgggattacatgcatgagccaccatgcccggccaatagtttcttttttgataggcagctcttaaagccctcagaatacatctctaatgatgaaatcatcaggcaacttgacaaagagtgaagaaattgaagggttctctcaatagcatcccaaggaggctgacccacaccctactgcctaccataggctggcttcatgtgctctagtgctgtgaataaaggaaaaaactaacatgttgaagcatttatttagtgccaggaggcaggtactttctcagataccctttttcttctcacataattccaggtcattggcagaatagagatgcaaaccaagaacttgggcagcaccaagatgtagatgctaaaactttaaacttgctggacaaaatgataggggactttgaaataattattcagacaatttaggcaagcaaacaaaagcaattaaaaattgggcatctggctgggcatggtggctcacacctgtaaccccagcactttgggaggccaaggagggtggattgcctgagctcaggagttctagaccaacctgggcaacatggtgaaacctagtctctactaaaaatacaaaaaattggccaggcatagtggcgtacctgtagttccagctacttgggaggctaaggtgggaggattgcttgagcctgggagatggagcttgcagtgacctgagactgtgccactgcactccatcctaggtgacagagtgacacccatctcagaaaaaaaaaatgggcatctggccaggtgtggttgctcatgcctataatcccaacactggaaggccaagtctggacaattctttgaagccaggagtttgagaccagcctgggcaacatagcgtgaccccatctctacaaaaaaattaaaattaaaattaaaaacagccagacatggttgtgagcacctgtagtcccacctactagagaggctaaggcaggaggatcatcaaaactgcagtgagctaagatcgcaccactgcactccagtctgggtgacagagtgagaccctgtctcaggaaaaaaggaggcatccaaaaaaatgttcccttagatccattttttgtctgacagagacaggagaggtgatgaaagggaatgtaagagtatttaagggattatttctttatggtagcagaaggacaaagacatgtttgaaaaatttttaatattgtataaaatgatgatattttcttagtggtcttgttgttgaatccagagattgtggtcatgtagttcataggtaatttatcagttattatttattttttaaagcttttatttatttatttatttattttagagatgaagtcttgcaatgttgcccaggctggcctagaattcccgggctcaactgatcctcctttctcagcctccctagtagctgggactataggcacacaccactgtgcctgtctaatttgtcaacttttaaatgagatcatctgcaagttcaaggaagttagataaagggtgataccacagaaaaaaaatgagatttttctctttaagatgaatattgaatttagaattccttaattaatattgaggatcacatgcgagctacagatagggaatattgagtatttaaagcattctgaatgacctgagtgttttccttctcatgcttattaaaaacatttaccacttacagctgaattggaatatagttctacataaattgttatttacacctgatacacagaaagaaatgtgtttccttatttatcatactattaatttgaatgtgctattctttttttaattgctttaaagtcaattggggaatcagattatgaatatctattttactgcttccacatttcctaagttaatcaaatacgacaagttagtgagcttgtggaatttacttgaatttcctaatcttttaactgagagggtattttcgacagcaaatattttgtagcatccatttgtcattttttaaatattcaaactagttttttttaaaataatgccaagtacacttagtgcctagtaaatgctggccactgttattgctgttatcattattcttttttgtttgtttgtttgagagggagtctcgctctgtcgcccaggctgaagtgcagtgacgtgatctcggctcactgcaagctccgcctcccgggttcacgcccttctccggcctcagcctcccgagtagctgggaatacaggcacccaccaccacgcccggctaattttttgtatttttttttagtagagacggggtttcatcgtgttagccaggatggtctcaatctcctgacctcgtgatccaccctcctcggcctcccaaagtgctgggattatggcagagaaatgtttgtttcaaaagtgtgttagtctctaaggaaatgaatacttccagactaaattctgtttatagtattatcattaataaataaactaaaacattacttctgtttcattgccccaatgtatattgtattaaaatgttcttttctgatcttctctaagttaaaaaaaaaaaaaagaaacaaagttgagtaaacaagctgagcaaactttgtgttgaaactttaatatgtccgaggaaaagaatcttgcattaagtccaatacagagagtctgataatttggtggagcagagagcctcatctgaggtggctttccgtgaacagcatctctgaggtgtcacctgctaccacattcactgtccaccctgggctttgcccctcaagcaccagggctcaggtctcttgttttgcctgtttctccctatagtctccctggcctgtgccttttagacaaaacagattaacatcacctttaagccgtcaatactgaacattctgtctttataaggcctgactcattaccaattttatttggtcaattttaccttccttgctttcaaaggaacaccatttgcctatgtcaagtgttctctttcttttatttttcccttccttctgtctttcccctccttccttccttccttcctccctccctcctctctcctctctttcttccttccttgcctccttccatccttccctccctctctctctttctttctttctttctctctctctctctttctttctttctctctctctgtctttctttctctctttctttctttccatcttcttttctttctatctttcttacttttgatgtagctgtcacgacctaatgaaaatactggcatgagtgatgccacctttagattctccaccttcctgttcctgtcctattcaccaacatgaattggtttgtggctgtaagtacttggtgggttattgctcatagattcagttgcatttttgctgagatagtgctgttaccaaaagcaggggtgctgcttgaagaagtaaacctaactctgaaaaatagagactctccagaaacatcataatcttaaggatggacatttgtggcctgttattgttacttcattctaggtgacagagtgaagtgagtgagggcaaaaatgactgcacacttatggaaagagggctgcctccaccacagacaggtagtgggaggtcccactcttccaggttgaacccaatatcctatcttctccttccgctcttggtacctgttgttgctattgtaaacacttccctcacctgggactgcatatagatgaaagattgctggggggtttcccaggatcttgggccagtgccaacaaatggcaaactttcaagtctagagatggtcctatggcatgactgggggacaccacttccttcaccagaacattcacatccttcccaaggtgccacgcccagttcttttgtccaacaataaactctgcgaagtggagtgaagtcaccacccaagccttagcctacctctgaccacagcctgtgactccacaaagataaatgaaaagaggaaagtcagtgatgttttctatactgtcagcagcaatctcacagcctcaatacattttctttcaaaagtttaatatgtaataactggcatttcttcttcattcctagttggttagactgcatcacatctgccatgccaaactattaagagtaatacaattcttactcttagtttattaagagtaaaaactattactcttaatagtttagcatgctattactcttttcttattttttaatttttttaattttttattttttgagacggagtctcgccctgttgcccaggctggagtggtgcagtggcacaatcttggctcactgcaacctctgcctcccaggttcaagcgattctcctgcctcagcctgccaagtaactgggattacaggtgcccaccaccatgcctggctaatttttttttttttttgtatttttagtgggcaaggggtttcaccatgttggtcaggttggtctcgaactcctgacctcaagcgacgcccccgcctcggcatcccaaagtgctgggattacaggcgtgaactgctgcacctggctgacgtgctattactcttacagcatctggacaatccctaacagtctgaaagctctataatgttgcaggtagtccaaaggccctatcccttattctagaacacaggctttatagcacaggctttggcaagtctgtaacagtctgaactcctccactgtattccacatactagggatcttttaagttgtcattatgtcctggcacaagcatttatcatatttctgggagcatgtagggttcaagatgcgagggcaagagagggctgagttgtttgttattaagctgacaggaaatggccaaggctcatgtgctactgcttgcagttgggcaaaagaggataaattaattgctttgtagaaattcctttctgcattctttagggaaaatttttccatgtgagctaaatgagtcaaagggggtggttttgggctcaacagctttgacattgtcccttcaaggaatgaaacaattaaagaaactgatctcctctgagaaaaagaccatttacaataacctatctactctacataaaatattcccagtagactcatcaaaacaagaccctctgataccacaccatactgggtttttccttattgggattcccccatgttttttctttaatgcttccccatgttttagaaacagatttgcttacccggaaccttccacactcaattccaaatttatcatagtactatcatttgggagtaaacaacatgtaaggggcctacacgggtggaaagcccattcaagaaactgaggatgatcaaatagtagagttgatagtatgtgtataatcccagggaggagtttcatgacggattagaaggtcaacactgcctgatgcagccgaaagatcacattaaaacaggacaggaaggaagtcctggctgtccagcaaaaggtctttagtggctatatcaagagaagcttttacagaagggtgagggtggtagcctgcgaacattggattaggagtgagagggactgaaggaagtagaaactcgagctcaggggaaggggagagaatgagcttgaggaaggccctctgatgaagggaaggctcttttctgatgccagtgagttgagcagacttataggaagcaaagaggagtctagggacagacagggattgtccaggtaatgtaggaaacatttgacaaggacagatctcgaataaaaacatgaatgcaatttctgtttcagatgtctcctttgcctgccccatcccacattctagaaaaatatttggtgcattaacagattttggacttcacagggcttcacttttattgtgcttaatatttgttccttggtgaaacacaaagagacaaactacacaaaaagagaatcatacttgatgaaaaaaatcaatgtttagaagttgctcttaaatcttttacccattgctaacatgggtatttggatgccatttggaacgtattccaggactacttatccatgaaaggattaatgatattggagccaggttcaaagtctcagcaacaagctaaaacctgctctttttagtagtcaggggcaaagcttagtatcctttcttctgaaagctttcgcatgctaagctttccattgccaagcccccgggaaggaaaataccagaagtttcactccgatagcagctttttctgagatgcgcctggtgataacattttccagtagggctatcttctgtctccttccttctctgtgtgtaccagtaaagccttgtacaagtctcttaacctttcttggcttcagtttccaaatttgtaaagtgaagataataatacctccctcatagagttgttgtgaggactacatgggctaacgatcagacagaaagcactcattaagtgtgactagcattgttaattgcagtaatagtagttctagtagcaggcttttccaggttataaggattaaagatacgctcatgttacctaagttaatggtgcattattttaagggtacaccaaaaagtaagaagaatgggaaactacttaaccagcacatggggtgcagaagcgagagcaattgtgttttctttttttttttttttttttgagatggagtcttgctctgttgcccaggatggagtgcagtggtgagatctcggctcactgcaacctctgccacctgggttcaagtgattctcctgcctcagcctcctgagtagctggggctacaggcatatgccaccatgcccggctaatttttgtacttttaacatagacgggggtctcaccatgttggtcaggttggtctcgaactcctgacctcatgattcactggcctcggcctcccaaagtgctgggattacaagcgtgagccaccgtgcccagccccaagggaattcttacagcctgacaggtttggaactctgagtctctctgtgtgtctgtgtctctgtcactccaccatatgtttagcagggttaattaatttgcccaagatcacacaattagtagatgattatgcaagatttgaaccagttgttattcattggaatatgattactgtgtaagttagcatgagaatattgaaaataaatgtcttgttagattcatttattttttaaaaaattcctatgtaggtcgggcacagtggctcacccctgtaatcccagcactttgggaggccgaggcgggcagatcacctgaggtcaggagttcaagagcagcctggccaacatggtgaaaccccatctctactaaaaatacaaaaaattagccgggcctggtgatgcatgcctgtagccccagctacttggtaggctgaggcaggagaattgcttgaacccgggaggtcgcagtgagccgagatcacaccactgcactccagcctgggcaacagagcaagactccatctcaaaaaaaaaaaaagtcctatgtatacttcttcacatcaatttaggcaggctttatttgttaacttttgttggtagccaacatgcatttaaactacttattattgtcctaatctaagaaaaactgagaaatggatgaagttggtcctagggtatcccaaagcacagagtgttttattctgtccttgggacagaggtttgattcaaaatgttttttcggaaactagccttgaacacctaattttattaatattctttttacactccatccctcctggaaaaggactggaccccaattcccaccattgcttttttgggacccattatcttccttagcttcctatgcatctacagggtagtctgggcttcacttcctcagtgtccctgtatgaaattaggtggatatagattagtctgatgtaggaatatcacactgtactaaggtttagtttgtatgttattctctcaagtaactgatctttcaatcgaactaaacacttcctatgtgctttaaggtggtgggaattacaagcatagcaagttatgattggtcacggatttctttcctctttaaatggtgacctactgcccattgtacctactcaaagcaactttctttaggaaaaaagaccacagtctactttcctaagcataaactcagttctcattccacctctaccacctgcaagatttgttaggcttaagcagtcccttaacttctttgagtgtttgttgccttgcctacttcattggaagtaaggctctggaacagggaaggtttgcctccataagactaaaagttatgctaatataagagactagcaaaatgggagacatattcagctctcttcttgtggggaataccttgcccttgaccaaaagccttgtcccagaaagagccgtgtgggtgttggctttgtgcccaacatgtggctcctctgccatgattgatggcttcatttaagaaacaggttttaggattttttcccctaaaatcttattcctgttaattatcatggatcaactttaccttagctcgtttaatacacagtcacctggtataaaagcatgtgaaaacccccagggatcgtaaccacatttatgcattgagaaaagagagtgaggccaagattttgagatgtgttcaaatgcaagaagcttttaaaatgcaaagtattctaaaactgttgaaagttgaagctaactgttgttcccttgttgaaggtaaaaagtaaagcatttttaggaaagcacttttccttatgtgtctaatatttgggaactgcataggagaacagtttaataggaaccctgatattgacagtaagatatattcttaatgtagtaaccagacccagggcagaatttgcaaacccatggtaggcatacaggtggctgaagaagaatcgggacagcaagatctcactgagatgcaattccattcctccatttgatacagattaagatttctgaaaaagaccatcctcctaaaccctcatggactctgcagataatatgaggccagaaaatgaataattcccaactcttgctatctcgttactggccagtgtgtctggcttcgctgagtgtgtgccttctgaagcgtaccctataattattcagcaggtatagtccagttcgtcctacttactttagcaagattacctttcttttatttttcctgtgaaaatccttctcttccttctttcctcctttgtctttcctctttgttaactttttaaatctaaagtgccttgaaaaacttgtttacatagtagtaagaaggaaaatgttgacttgtgctatcctgggaaccttgaccttcctgcattatggataaatcatttccctgcaggtggaagtggaaaattgcagatagaaccacattgactcacattctccttctacttccatttgagtgagcaccaagtatgcatcacgacttgagattataaagttggcttaatgatgagacaggtttctcagtcgggttttccattggctcgaagttcacaaggcagttgttgcttgtctcagagtgtccttaggtggactacatctgaacccttggcgttattataatgcagattctagctgtgctcaaaccaatgaatcagaatctcaggagggtggcgctcagaaatctgcatggttgatcagttctttagcagattcttatttttgtatgctaaagtttgagggtcaccactggagagattccagaacagggcctgcaagggaattgttcaaagtttgctcaagttaactttgttgttacagcattagcttgaatatcaggaggttttgtatttaagttctctaaaaaaagaaaaagaaaaaaagagaacagtctcaatatataaaaggaaaggttttcatatatgtgcccaattataagtatcttgagtattctaggagtctaaacagaatgtctttagatcatccttataacgatcctgagactcttttgactgttttgagttgaagacaggtaataagaaagaaatcaccaattaatgcagaaggaaataaatttctgtatataataatattcacatttgccatgtctcttttaaaaagtccaaataacaggcagagcgcggtggctcatgcctgtaatcccagcactttgggaggccaaggcgggcagatcacctgaggtcaggagtttgagatcagcctggccaacatggtgaaaccccatctctactaaaaatacaaaaattagccaggcgtggtggcacttgcctgttgtcccagctactcgagaggctaaggcagtattatcacttgaacccaggaggtggaggttgcagtgagccgagatcgcgccactgcactccagcctgggggatagagcaagactccatctccaaaaaaaaaaaaaaaaaaaaaaaaacagctcaaataactttaccgtacataactttaccatacatgtcctctagtctcttatcatttcttcatatgaagaataatttatactcattgatgtaaattttgctatattttatacaacaaacatagtattattttaatattgcacatagagaaaaatacctcttcccctcaaaattagaagggttggtatttttattcaggcttattgatttaaaatacctgcttgatccgtaattcaggccatacgatttcaccaaaacaaatatcctaatagttgtcatcttgaataactgtttagtgcacagaatgtagtctcatttattaagaagtgatttaagagattattacttctgcatctatcacactaacatgaccaactctttagtaagggaagagtaagggaacttattttatatctagatagaaattttattaaggatacagtattaggattcataggggaaatagtggatagatcacaagaacgaggctctttctgagccctgcaggaaagaatatttgcagaacaataaaggacatggtggcttcctggagaatgttggccgaagactgagccttacttctggaaaaggctcagtgctagagccaagtgagcatcgatatgccaatacaggcaagaaaatcctgcaagaggcagacttggttcttaggtcggaacaggctctgcttcagaacttgatccggtacccaattcgtttctgcttcagcttctttttctataaaatgagggtagtacttatcccatgagggagctgttatgaggataaatttggctttattgaatgtgcatgattcctggaacccataaagatgtcaaatttagaagcctcagagagatttcctttgctctgtgaataactaaatttggttagctggggtggggtctgggtacttttccttgtgaagaatttttccctcattctggtcatctcctcccctcctatagaggcaccatatatttttcttgtctcaggtacctatagtgataaaacaccctgagctgaaaggatcgctggatagggcagtctcaatacaaaagaatgtggcagaagctcaggcttcagtgcacatcagaatagaagcttcatgagggcagaggcttttgtctgctttcctcattgcagtatccccagaactttgagcaagtgcacactcgatgaatacttgaaagaataaatcaatgtcagacatctgggcttatgtctcatctttctactgttctcaactaagagattctcgtcattctacaactttcctgagcctgctctccttctccaaatattcacccttccaggcactgactccacctcccacatcagagctttttcttaaagtaaataacagtcaacaattaatagcttcataactttggaacagtgcagtgtctttggtttaagaagcattgtttccatcctccaaactaaaataaattttgagaaaagatggagatggtttgggactggggaagaagggaatggaagaagtgattatttgagggcacattaactatttgtacaaagtagaatatcttagttaaatttggctacatagcaagcaggtatcattaaatggatgtctgttagaatcttgattttcaaattaactagatagtcagcgttagttagactgagggagggtgattacagtcctatgtcactgagggagaatggtgaaagggcaagagaaggctggcaggtagagctggaatttttctgccagcaatagaccagtggttcccaaatgtaagcctgcaacagaatcatctggagggcttgttttttgtttgttgttgttgtttgtttgtttttggttttgtttttttgagacagagtctcactctgtcgacaggctggagtgcagtggcgcgatctcggctcactgcaccctcagccttccaggttcaagcgattctcctgcctcagcctcctgagtagctgggattacaggcatgtgccaccagcccagctaatttttgtatttttcgtagagacggggtttcaccatgttggccaggatggtcttgatcccttgacctcatgatctgcccacctcggcctcctaaagttctgggattacaggcgtgagccaccgcgcccagccaggagggcttgtgaaaacacagatagctgggcccatccctagagtttaggattcagtaggtctggcggaggcctgatagtctgcatttctagcttggccaggggatgttgatgttgctggtcccaggaccacattttgagaaccactgcaatagagagtgtgcatgaaaatacaacaacaattacctgatggtccttagcttagttcagttgtcccccacaggttgaagcagtgttcaagggcaaacaaaaactttctctctcagccacctccataagttccatagtttatttaacaaagcaaactcacaaagaaggaggaagttaggactgctccatttccccttatagcaaaggcatgtgtatttcacaactgcaatcagcttgaatagcagaggctggaaggctctccatgtctttactgaagtcacgtcactaagtcacacagacatgctgctaattcactgccttggccagcacatctgaaaataaatagcaccattataggccctttcatgaatatacagcatgtggcctctaaattggccaaggagctggctatgctgggacaaataacttagataaatcacaaatcagagtggagaaatgaggtgtttttaatcaacagcatccaacaatgtgtgttgagtttaactgaatccaggtagaggagggagtgggtgcaagagctcaaagtatgctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcctcagcctcccgagtatctgggattacagacatgtgccaccatgcccggataatttttgtatttttagtagagatggggtttcaccacgttggccaggctggtctcgaactcctgacctcaggtgatctgcccgccttggcctcccaaagtgttgggattacgggcgtgagccaccatatctggccctgaagagactcttaagatactttcataatagtttaaaaagctgtatgtgtgtttacaatttctgtcataaatctatggtaaccacagcacaaacattttagaaaaagaaaaaaaaaaacaactctcggttgagtgtggtggttcatgcctataatcccagcaatttgggaggctgaggcaggaggatcacctgcatccaggaatttgagaccagcttgggcaacatagcatgacccatctcgacataaaattaaaaattaggtatggtggtacatgcctgtagtcctggctactctcaggggactgaggtaggaggatctcgtaagtcctggagtttgaggctgcagtgagctgtgatctcgccactgcactcagcctgggtgacagagcaagaccctgtctcaaaaaagaaaaaaaattctattttcccacctctctaacataactgtgaatagtagtatttccttctagtttttaagtacactatttaaaaacatggaaggttttcaaataatgtacttagatttaaatgcatttttaagcttatacccatataataagcatagtaactaacagaatgttctttggagtcagatagtcttgggttcaaatcctccagacatttccagccctgagttttgcatttgttaaatagggatgataaacctggttcatagcattgctgtgtggattcactgaggtgctcatcaagtgctcagcacagagccctgtgtcatgtaagcactcagtaaatagtggcatcattttctgttttcacacacaaaaaatgagtcgaccttctgcaatcctaataatcagtaagttcttcttaatggccagaagtatacctatttttagtctatgcatttggcaaaatttcattccacaaattgtttggtggtcccaggagctgctttcaagatcttctctgaccagcttgtcgagagcttttgttatctgtgttttcctcaaagattagactcatgaaagatgtgtgaaagccaaaacaaaggaatgaccactggtgctcagagtgagagagattggtttagttgtttagccaggctatgtggctttgttcccagaccacagattataaccacaccattgtgggcaccacatatagccattttggtaaactagatatgggttgctagggacatgggcaagaaaccatgggtggggaggtgtggacctctcagccctgccctctcaagcctggccaacttcacatctgcaactgggactttgtttctgttccagacctgtttatccaactgccaacttgacagccacttggagtcctcatgagaacctcaaacttagtatgcccaaatgaaattttcagctcaccagaaggtaaccatactgtcttgagtcttacagttaccctgtaaacaaagggattaactttactagatagcaacttcctgcccataaagttaagaaaagagcccctcaatgcaaatgttggttttgcttatcaaataaatggattcttggttcttcaggatagttacagataacaatgggcagaatagccagtaaattcagtaactccttaaaattgttgaaagtattttgtgcactttctttatatcgctgcttagagtgttaattggtaaaatactctgaaggactaatacacaaacactttcacccagcaattccaattctaggactttattccacagatatatttatacatgtatgagttcacatgtacagttttctgaatttttttgtgctggcagaaaactagaaacaacagaaatgaatgaaagagactagttaagaaattattgcccagttttatagtagaatacatatgcagctgtaaaaaaagaatgagggaattattatgtatttatctattaagtgaataaagcaaaatgaagatcaccagcaaacagataaagaaattgtggtattcatacagtggaatactcctccataataaaaaggaatgaacaatgggtgaacactacaacatagacgactctcaagtactgtattcccatttgtgtaaataaaaatgtgggaaagaatgtatacatgtatttgcttataaactctatatgcacagaaggaaacacaagaaattattaccccgggaggcagagcttgtagtgagcggagatcgtgccactgcactccagcctgggcgacagagcaagactccgtctcaaaaaaaaaaaaaaaaagaaattattacctagattgtctatgcagagggaactgggtacctggcagacaggagtaggagggagacattgtacaatatgcttttttatactttttatatttaaaattgcaaaatatcttacatgctcaaaataaaaatagaatagcttatataactatgtctaaatattacatgtagttttcttctctggctattttctttttggtttttatataattttttaaaatccacttacttagcccaggcacataaatggaaagaaagatatgcttaaaattatgttatttgcaaaaacaaatatttagatgttttagagctagtatgtttttgttggtttctagtttagttctacatggcatcagactagctactctatatgatttctggacctttgcaatttgttaagatttgttttatggtcggggatatggtcaatatgtaaatgtttaatgtgtgcaagaagaatgtgtactctgaagttaggcatagtgttttctgtatatgtcaattagcacaagtctgtttatcatgttcaagctctgtgtatctctgggtttttttaatctgcatgatagaacagaagtatgtttgaaacttttattgtagttgtggatgtaatatttttcctctacttttgcagttcttgctttatatattttgagcctatattacttggtacatacatatttagaattgttgtgtcttcctggtggattgccctttgattatttaggaaatgtctctctcttcggtaatgcttcttaaagtccattttgtctgatagtactatagctacctcagctttcttttggctaggtttcataactttttaaattctttcactgtcagtctttttatgtccttatatttaaaatgtgtcaaaagaaagaaggagaaagaaagaaagaaagaaagaaagaaagaaagaaagacaccgcgatttacctatgttacaaacatgtatatgtaaccctaaacctaaaataaaagttaaatataaataaataaagtgtctcttcatgaaaactttcttagcatcattagtcattagggaaatgcaaattaaaaacacaatgagataccaccacatacaacatgtctagtataatggctaaaatgaaaaatactaacaacaccaagtattgttgaacatatggaaaaactggaacactgattatgggagtatacaaccatgttgtaaaacactttaactggtcatttacccaagaggaatgaaagaatgtatccatataaagatttgaacacaaatgtttacagcaactttatttgtaataggtaaaaactgaaaacaactcaaatgtccatagacagatgaatggatttaaaaaaaaccatgttatatccatacaaaggaatactcctctataataaaagggagtaaactactaatacacagtgcaatatagatggattgcaaaatgattctgttgaatggaagaagccagaccaaaaaaagagatatattgtatgattctatttatgtaaaattctcgaaaatgcaaaggatctacagtgacagaaagcaaattagtagttaccaggagacggagggtaaaaattaagaaggggcatgaagaaacttttttattgtagtaatggtctcatgggtctatacgtatgtcaaagcttatctaattgtatactttaaatatgtgcagttcattgccagctaattatactcaatctgtttttaaaagtaaaatgtgcttcttataagtaacaattttttaaaatgtagtctgatgacctttgtcttttaattagagaatttaatctgtttacatttaataactgatataggcagggcacggtggctcccgcctgtaatcccagcactttgggaggccgaggcgggtggatcacctgaggtcaggagttgaagaccagcctagccaacgtggtgaaaccccgtctttactaagaatacaaaaatgagccgggcgtggtggcaggtgcctgtagtctcagctactcaggaggctgaggctggagaatcgcttaaactggggaggcagaggttgcagtgagctgggattgcaccactgcacttcaacctgggtgacagagggagattccatctcaaaaggaaaaaaaaaaaacctgatatatttgggtataaatgttcaatcctactgtaggtttttttttccattttgcccacttgtttcttgttgctatagtcattacaacaatacatgtttgacttattagaatcctagtattaattagtacttttaccatttcccagatgatataatatgggctttaaaacacatgaaatccgtttacccctcaaaccttttgtgtatcattgatgttttaattctatgtatattttaaacttcacattattatcattattatatttatattgcacagtcactatcatttagatttacttatgtttacccttttggtgtatttcaatgctttcagcacttctgtgtttccctttgggattgcttttcttctgcctcaaaaactctccttactatttattttagtatggctctgctggtgataaattctctccatttttgtttatctggtaaaatatttttccttcattacttatgaagaatattttcactaggtagaaaattctagattgttagttattttatttcagcactttgaagatgtcattgcattggtttgtggatttcactttttcaattgagaagttaattttgttggttgcattattacactttgaagataatgtgtcttttccctggatgttttaaagatttttctctttgactttcagtagttctactatgatgtgtctaggtttgatttcctctgtattgattctgatgggcatttatagaactttatgaagctgcgtctggtatttttgccagccagtatttctttaaatattacttctgctccagtttcatctctcctcctcctttgggatccagcttacacaggttacatctgttactttatgactcaacacacttttctggaaagactctcttttctttaaacacaagacactaaatggttacaggtgttcttttaggtgattatgctgcttcatcagcagatggtgattatatcaagaaggaaacttatatgatgacatataaaagctggggagaggagatgtctctgaagacagtgagaaatccttctctagtcttgctgctggaaccctcaaacacttaagtcatctaataaacattctactgtcttcagaggaattttctcagtgaaagggatttgggacacccctgtgaggaagaaacataagttccatgccttccaaataaggggcaaacttttctttgtagtcatgtttccacctgttgaatccgttttatggaagttgtacagttatggcttgtctgtttatgagaagagatagagaatatgagaaacgataaaacctgaaataatccattgtgaggccacaggctgaagaacttacaaggaatttattctagactttatggctgaaaatatgtatgcatatatgtatatgagtgtatggagatacagttatggatagagatctatagatatatgtgtagatatatagatacataaagtttgctacagaaattcattttgtacacttttaaaagtgcactttactaaaagcatccaagaatgcatctcagaaaaagccttagatttcttttatgtggtcaactccaggaactactcactcttgagatagatgtgtgttttcagagcttatccatgccatgcacaatgatctaaccctttgatagctgcatcattcaaagtcagtttttctacatgcaacaaatttttaaaccttgatttttatttatttatttattttgagacaaagtctcgctcttgtcccccaggctggagtgcaatggcgtgatctcagctcactgcaacctccacctcccaggttcaagcgattctcctgcctcaacctcccgagtagctgggattacatgcacctgccaccaagccaggctaatttttgtatttttagtagagacggggtctcaccatgttggccaggctggtcttgaactcctgaccgcaggtgatccacccgccttggcctcccaaagtgctgggattacaggcttgagccaccgtgcccggcctaaaccttgatttttaaaaaaatactaccctgccctaaccttgtaacttaggaagtttggggagaggggtgtgtaacaacctttcactgcttatttgatgtaaatcatttctagtcctgaaacaatggctattttgcaaggtttaattatactgtgtgttgtggttgcatgcataggtacacccacaaatgtctgtcattaatacgtatcactagctttgtactttacactgtatttttggagtgttttacagtcgttcgttaccaagagtaaattatatatttgcttttctttaccccacccctttcactattgtttaaaacatgtcagattcaggaaaacctcaagagacccaaacctctttcaatacttatagacaaagtttttttttccttaaatcagttttaaaatccatccagccattttggctgccggccataccagcagataatgaaagaattttccttgagggtcaaaagccagggagaagccttccagggctgtttggtttcctagcacagctgctggagtagctcgtggtgctgattgatctgcttggagattcttgtgcatcttcacctgttagagctggaaagatgctcaggactatacagcccagcccttctggtttacatataatgaaactaaggcccaccttagtcaactaatgtgcttaaactcaagcaaatggcaaatggcaaaactcaggactctgtcaatgagttttcattctttttctttattcttctagacacatattttataaagaaatgaggcagcatgatgtttaaaatacttaaagtgagaatgagaaaaactgatgtctacatatcatgaaatggttaaaaagtttaacgtgcattgtcttctccattagaacttcttttacgaatttttttctcaaaatctggctcagaaatcttgttttaaaagctccctaaacattcctaggcagaattagtaacgccttcctctttgctaacaaggaactgtgcatattcctgtaatagaatacttaccatattatattgtaagtattaaattattcatctgccctcctcccacctacccactggatcaggcttcccaggaacagcaacagagagcccagcaatttgtgtgttctcagtgtggaatgaatgaatgaatgaatgaatgaatgaaccaaccattccttcacagtcttgcactatcagtgaatcttatgctttattgaacataaaaatcacctggaattgctgacttaaaatacagttttccaggctataccacaagagatgctaatacaggactggggtaggtccaggaattcgaatttttatctaagtagctgatgacttaatgcaaatgatccagcagccacactttgcaagctctacgctatgattagttgtggtttgtagtcccaattgtatatcataattatctgctgatctgaaaaaaacatagagcttctctacccactccttaccaccagtccatcaccaccattctgactccttagtcacaatgggtattgacattttaaataaatcccaaggctcccttccgggagaataaagaggataatatttataaactattttgagttccttagaagaagggtatcttagctcattaaggaaatattatcatgatataaatctaacatcatgaaacttatcttggacatgtcaaatttggtctaagaatcaaatgtagaggaaaataaaacccacacacagtacctgcatggaaacggaacctgtgcaaacacctgctttggctatgttcctttttgtggagacagatgtcccccttcactaggaccagggtagagatgaagaaggttgatttggacattggggtgctatatgttcttttgggactgaagttccatattaggaaacttaatagctgacatttacataacttttaaacatcccaagtagtacgctctgtctgcacactattttatatgtatgcaatttgtttgtttttgtttttgttttgagacagggtctcactttgtcacccaagctggagtgcagcaggcatgaacacagttcactgtagcctcaacctcccaggctcaagcaatcctcccacctcagccccctgagtagctgggactacaggcacacaccaccatacctggctaatttttgtattttttgtagagactgggtttcaccatgttgcccaggctggtctcaaactcccgagctcaagtgatccacctgctttggcctcccaaagtgctgggattacaggcatgagccactgtgcccagccatatggatttttttaaaattatgaacttacataacttcacaggagacagacctgaatgaggtagttattaaactactttctgactatggaaaggatttctgatccttgtagtatatttccacgtatattgttatactgttgtgtgtttgtatttagttgctcatactattttttactgtagcttactttatatgcaggtttccatgggtcaacctaatttatatttttgtcattttaaatggaaaaatgatatcccatatattttgtagtattatttgttcagtgttctttccaatgtgggatgctttggttatttctaattatttgctatcatgctatcatatacagaattcttatgttcatttctgctcaaaattatatttttgtttgtatgaattccacggtgtatatttcccaaagcgagatagttagataaaagagtaacagcagtttcatagttctggttgcatattacagtattactttccagacacacagagccaatatacaaccccaccaggggtgtgaggcatgctggttttcccacagcttgaccaacatgaaattttatcattccagcctatttctgctagcttaatatgtgtgtagggcctcactagagatattttattttgaagttcttcaaatgatatgaagcaattcttttccacgtggaatgattcactattttcattttaaggacaaaccattcgtttgtatttgacagttttgaagtgacaggtttaattgccttctgtataattgattctgtagggagagaaaataggagtgctattaggtattgggttaggctcaaagagtcaagaaagaagattagttgtgtagttctgaatttggaaacttgtatgtggacgactggaacagaaataccagttgaccctgtttaagaagggctagagagcaggaacattctgatttcatgatgacaaaaatactagagttttgacataggacaacagatcttgcttcaaaatgaaagcaagaccctatccttcctgcctctttgatcctctcacagtgccactttctttcctgaacattttcagatattcttatttcagatagaccactctggtgtataataggaccagttttagagtggccatgaagctaagacatgttatttgagagctcttaggggaagacctggacacagcagtcgcaggagaagtcagtcttatctgtaaaaaggtcagcttgatcacagaaaaaggctttggcttggttgtgttggccctccatggcttatgatcctctttcaagtaagcaaataaatgattgcagtgttggtttgagtcctgtggtgccaaacacaagacacattgttgctcatgcaatatagacctttgttttggacagtggtctaatctgctggtttttaaaacattggtgactgtccaacttataattaaaatcagtctatcaagcacttggagacaaaatctgaggttattctttcattcctagttgtcacactaattttttgccttcacttttgtctctgtagaatatttacacgtacacctatctatatctatttagatataatttatatactacaaaattcacccatgtgtacagttcagtgatttttaatgtattcacagtcatcactacaatcaatttcagaacattttcattactccaaacagaaaccccaaactcattagcagccactctccatttctctacaatatccccaaccttaggtgaccacaaatctactttctgtctgtatagattttgcaattctgggcatttcatataaagaatcatagaacatgtggtcttttggtttagcttatttcacttaggataatgtttccaaggttcatttatgttgtggtgtatataggtactcttttcctttttattgctgagtaattttccattgtgtggatatacaactttttgttaagtcattcatcagttgatggacgtttggattttttccattttttggcctttatgaataaggctgctacgaacattcatgtgtaagtttttgtggggaagtgtggttgtctttttttttttttttttttttgcaacagagtcttgctccgtcacccaggctggagtgcagtggagcaatctcagctcactgtgacctccgcctctcgggttcaagcaattgtcatgcctcagcctcccaagtagctgggattacaggcacacgccaccacacctggctaatttttttgtatttttagtagagatggggtttcaccatgttggccaggctggtcatgaactcctgacctcaagtgatctgcccacttcagccccccaaaatgctgggattacaggtgtgagccaccacacactgccagaagtatgttttcatttctcctgggtaaatacctttgagtggaattgctgggatacatgggagctctgcttaaatttttcaggaactgccagatggctttccaaaatggctgcaccattttatactcctaccaacagcatatgcgtgctccagtttctccacatccttgcaaacacttgttattgcccctctttcttgttatagccagcctagtggttgtgaaatggcaactcattgtgatttgatctgcatttcccatttccctcacggctagtagaatacttacttcctatcctagtttttccttatacttttaaaaaattaaataaagaaaacgctgtagaaaattaaggagcaaaatgtatgcttgcagctacagcttcctctggggtttcacacttccttgcctcatcatgtaacgggccaccactaggatgaaggtgctccagtcttattcttccaatcttctctccatttgtcattcagaatcctgggaaagagagacacttgtcctgccgtgagttatgtgcccactcttttgatttgtgtttctgcctagacagtgcacagcatgagtgttggcatcttgaaaggaaactggggtgctcctgagggagaatagatgccaaagttgggacaagagcccagtttcctgcctttctaggtgtaactcattgccaaggtcgggagcaaagcaaaccatgtaggaaacctcatcatgctgggtagttaataagtatgccctagcacacgttttcacagagaaaacataatacgcttcatttgtaatatttaagtattacatctaaagttacaatgtttaaaaatttatatatacccttgttggatacaaagcatgtttaaaatatgtgacctcatttgatcctcagtaatctctgttagtttctaattatattcagtagtggtattggtattgtatgttttggcctcattgtggtttaaatacacttttgtgaactagcctgagaatccaaccaccaacacaatgatgtaatgagaaaacgtgctctgagttccaaacaaatggctaacagataagtgctcagaagtcaacctttttgtaagctggggtatcactggccagcagtcacatgccagcaggtgtgagtagacagtggggaacaatttcctctcatgtgtatggctccctaaagtgttggctgagcattgtccacatgggtgatgcaaaggatcactgaactaggagcagttgggaaaaaatacaatcattgggaattcctgtagcatcgaaggtgcctacagggaggtagaagtattcatacaacagttctctggtgttctctgttgtagcaaccagtcagccaaaagggttcagctgcttgaaatgagaatggctggatcaaaatggcagctcaggatttaaaggattctagtcagataccagacatcctcacatagagaaaactctgaatggctgggggagaaggagtcaaatgccctggatctttttcttgggcctcaaagtcctccttctgtcatcatccttccagtattgggcaggacctgactgcaggcatcatggcctctgtgaacttctcaagggtatgtattatctgacaaaaactacgatgtccactaacaggccactgaaaaggtatcttagtcagttctgctcattgcccagccaaggcctacgttttataacatgatatcaaagattgcatctaaaattgtgatgatttcctaaaataatcatttcatttagatttttctattttaatccaaggtattcttcagcggaaataaggaaacagtttactctcccaccaaaccttggccagtaccatcgacagagcataagtacctctggcttcccctctcttcaactagtaagtatgagttccaggtttacttagcgattggtcaagtgcaaaagtgcccagggtatgtgtttgcctcctgttccttagatcttcctaccatcacctcacattctccagtcaccagatcctaactctgtgactgtgtctggacatcagacaatatccctctctctctctgccaaccggtacttagggtacataatagaacctctgggagctgtggttttgatgtctctagactaggtgggcttccaggtgactcagtctcatccaaattatggttcatatttgggggagaagggctagcccaaaaacttaccaccatttgtagtatgcatttttttggaaaagcatattccaaaatctgaaatgccaagttacagacctcctttttgtaaaataattttcttgctagtataatttacatataataaaattcacacattttaggtgtacaatttggtgaacttgggcaacttagagtcacttaacctttcctcagtcaagatatagaacacttcttttatcctaaagcgttccccagcgcgcttttacaatctcctctccccaggccacaccctccaactcacgcaatctctgactcacttctgtcaccataattttgctctatctggagcttcatatcctgttacagtatgtacaaaccttctttttttgagacagggtgtcagtctgtcacccagcctggagtacagaggtgtgatctcagctcactgcaacctcaacctcccaggatcagatgattctcctcccacctcatcctcccaagtagccgggactacaggcgcatgccaccacacctggctaatttttgtactttttgtagagacaggggtctcgctatgttgcccaggctggtcttgaactcctgggctcaagcgatcctcctgcctcagcctcccaaagtgctgggattacagtgagccactgcacctggccctaaaccttcatttttaaaacacatttcctcttaaattgaagattgcctacatttttatatcaatgccaattgttgagtgtgcctatatgtgttatattatttgagcactaaatgccagatgtgtgccaagtgagataaatctgacaaatgagatggtttgtaaaaccagcagtgaatattcacttcctctgtgagagagctccagccctcctgtactcacttcctcacacagcacagcagcactcttgctggttctgctgcttatcttgaagaggttaggttactttttgtttctacttattacttcgaaaccacttctgccttagaaattttgtaaccttccgctcagtttccggtaaccgccattttgtctcctgtaacaatttacgcgccgtgtaactgtgaatctttcaaaggtatgttttactggagtgatttctggttatttcagaaggataatttgtgtgttgcgtcattaatgaaatagtagtacgaaaaacctatagcatcttttactgcaggaggtaactttccatgccattttttcagaaaatctacttatgacttcagtggcttgctagactggcctttttatttgtacttttcctgtgtttcagaattgcagagtataataaaggcatgtcaagtgcatattgtgtccattttcaggtatattagataagctttacaccaagataaattagatatgcttattggtttaatttgtgctaatatatatttaattgaaaaatcaaaaaaatttttttaaattgactgaagttgtattccaaaacatgcaaaatttagtttaaaatagattggatacacttttaaattttaaacaaggtagagggtttagtgctttgcttttttaaaaagtaaatgaaggctgcagctttctgcagtagttgtcttgggaagtagtgtggacatcactcctaagagacgttaaggaagtttagctaacaggctttaaccctttctctccataccagcttttactcttttttttttttttttgagatggagtttagctcttgtcacgcaggctggagtgcaatggcaccatctcggctcatcgcaacctctgcctcctagttcaagcaattctcctgtagttcaagcaattctcctgcctcagcctcccgagtagctgggattacaggcatgcaccatcacatctggctaattttgtattttgagtagagacggggtttctccatgttggtagggctggtctctaactcctgacctcaggtgatccgcccgcctaggcctcccaaagtgctgggattacgagcatgagccaccatgcccggccaccagcttttactttaatgccacagccttaaattttctttcaggagaaattattttatgtaaagttacaaaggaaaataatgcttaatatctgtaagcattcgtttggtaagtttgctgcctcctcagtaagttttgatgaaagtgaattttgatgaattactaccttagccgggtagtgacgttaacatgtggcttagctgtccattttctaagatatcaagaaaccagcaacaataagtaaaattgttaaattatgcaagaatcacatgttcctacctgtcatcatttagtcttggttctatttgcatgtgaatatcctttagaatatattactcccagttattccgctttacttttctgaatctcttttcccatctcttgacttcaacttcagtatatggctcttgttccttctacctggagaacggaggcatgtggaagcccagaggattgaattcttttttttttcttttctttcttttctttttttttttttagatgaatagtctgcttaggaaatccatctccataatgtttacctggtatcgtgttgtaatgtcagaatgaagtggctgttcttccccttgagtcatcgtcccgaatgaaggttccccaaaagaaatcatcaacttatgtggtgatttccttttacctttaaaaaaaaatttcttttcatggaaagataatggaacatgtcggtaagattcatttctaggaaggcaaaggagtagtttatcatctaaagactctcaacctaaagctgttttagaaaactttccttaaaatgagaagccgtaggttttcgttgcattattttggctaattgaaaaataagaccaagtgcgttctgaccttcgtttctcttacctttatttttacaaccaccatttcaatggcccacttgctgatacaaatgattgtttaattttaaaaagcatttaattgaagtcaagttatttagaacctaatcatttacacgtctttgttgttgctgctgttttgcaagagtgaagagcttggagtcaggtgaatctgggatgaggtacagttgtcatttattagtcatgtaatttgtgacaagccacttaatctctctgaagacttcagtttcttcatttgtaaaattggcataataatgctgtccctagtagggaatatagaattatataatgggtcctttgtatatattggctagtattgctctcttacgatttggcactatggagacactgtgggagattaaaagaagatgatgaataaaaggtgacttcagctctgaagggctttatgatccatttgggagaacaggtaatgtagaatatactggcttcaaaagtggcaggtgtttagaagagaaaaggatacatgatgtgataggaggcaaaggcttgattgagaaggctgagaagacttagagtaagggttctcagccctgactggacattaaaattatctagggacaattcaatcagaattcctgggggtggggaccaagcatcagtattttaaagttccctggggactttaacttgaagcccaggttgagaatcatttaaacagctctgttatttatttatttaaaattttaatgtattttttgagatggagtctcgctctgtcacccaggctggagtgcagtggcgcaatcttggctcactgcaactcctgcctcccaggtccaagctattctcctgcctcagcctccccagtagctaggaatacaggcgtgcaccaccacaactggctaatttttgtacttttagtagagacagggtttcaccatgttggccaggctggtcacaaactcctgacctcaagtgatccacccacctcggcctcccaaagtgctgggattacaggcatgagccactgggcccggcctagttttactttttttttttgtaatggaatttccctctgtcacccaggctggagtgcagtgatgtgatttctgctctctgcaacctctgcctcctgcgttcaagtgattctcctgacttagcatcctgagtagctgggattacaggcagctgccgccatgtctggctaatttttgtatttttagtaaagacggggtttcgccatgttggccaggctggtcttgaacttctgacctcaggtgatccgcccgcctcggcctcccaaagtgctgggattacaggcttgagccactgcgctcggcccatttaaaaaaactttaaaggtagacgtattccaaatggggggaatatataaagaaaggtaacacttattttgccctgtgtgctttgaatttcagaaggtgtagtaagcaaagaccacttactaaccctacagatatatccttagaaaatacagtggtttctgtcataaatctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatgataaacttgtcccaggtctatttgacactcctaccaaaatcctttgtgaccagggctagaaggcagctgtggctagtaaataaccctgtgtgtagactcacttattggctttggcattctctattgccacagctgtgtgaatagattaaccagagaccctctggtgccagccacctattcaggcaaacaagtctataatcagtacctctgttaaaatgaaactgtaatatactattgtcttttcatttatttatttatttatttagagacagggccttgctctgtcgcccaggctggagtgcagtggtacaatcttggctcactacaacctccgcctcccaggctcaagcgattctcctgcctcagcctcccaagtaactgggaccacaggcgcaccattgcgcctggctaatttttgtattttttttgtagagacggagtttctccatgttgtccaggctggtcttgaactcctgagcttcagtgatctgcctgccttggcctcccaaagtgctgggattacaggtatgagtcattacacccggcctattttctgattgttcaaagtagaagccaggcacaatggctcatggctgtatgtaatcccaacaatttgggaggcagaggcaggaggatagcttgaagccaagagttcgaggccagcctaggcaacatagtgagaactcatctctacaacaaagttaaaaagaaaaattagccaggcatggtggcacatgcctttagtcccagctacttgcgaggctgaggcagaaggatcacttgaactcaggagttggaggctgcagtgagccatgattgagccacagtactctagcctgggcaacagagtgagaccctgtctcagaaaagaaaagagaagagaggagaagagaaagagagaagagaagagaagagaagagaagagaagacatacaaaagaagagtaacatacaagagaagagttaggagaccctgtctcagaggaaaggaggggaggggaggcgagaggacaagagaagaaagagttaggatctatgccctaaggaagtaaggaggatttgagactgtgtaggtggttaataaccttaagctacatattttatggagggaaaaatcctatttttaaaagtgagaatagaacaattttgaagtgaaatggaatgaattagctggaccataacggctctgactgaagaaaaggatgtaaaaagccacatcctggatatgtaccaaacaccatggttacatggcatgtttgtatatgtaacatttatttaaaaaaaaagtctcatagcttagaaggcatttatttttgttatgtgtataggcttctgtgcaataaagcagccttttttattttacagctcatgatgacttaaatggttaattgcctgataaatatggtcctcttttattcttctgattctgttgttcttttgcacttcatctttcaaggggttgggctattcttaggtttcactgattgcactggaagggacatgacggaaaatgaagatctcaagataattttcttgcaaattcacaatggaagataaaaggaaagagtggcaggcattctgcacacagagcagacgtttctttattgtcattgttcagcagaggaatcaactcagccttggtgaaactagagtgatgcccatggtggcatgtcagcatctccctcttagtggcatcagtgctagattgttgttgttggaagcaggagagtgtttagtccataaagtacagaacttcgatatcacagaagctagaagaactttactgccttcagcttcgtttaaagatagtagagagcttactcattcgttttagaaatatgtattgggtctctatgtcaggaactgctggcacagcagtgagattgaagatacaacagtgaatacaatagagggcctatcctcatagagtttgcctttcagaatgagggacagacgcagacaaatagaaaatgtcgattgtgtcagggagtattgagggctttgaagaatgaaatcgtgacccagaagagatgcttttagattggatcatccgtgaaggcctctatctagaaaggagacacttgggcagaattctgaatgaacttgacggacatctgaaggaaaaatattccagtcagaaggaacagtacgtgcaaagtccccaaaacttcaataagtgacgtgctccagaagcagcaaggaagcagaatgaggcctgaacagagtgggcagtaggaaatgcagtcatagagaaagcagggctgggtcacaggcctcagagactgtagaacattggctcctactctaagacaggaagctgctgtgagcattgaggttgggcgtggaaccatttgactttttatgaggatcactctggctgcagtgtggaaaatagactggacgagggagggcagttaggaagatgtcacggtaactcaggaaagcaataccggtgctttggacgagggtggtggcagaagagaaagtgagaagtattctggatatatttcagaagaaagtggataggattttctgatgggtgatatgtagagtgtaggagaaagagaagaagcaagattgactttaatgttttccacctgggcaattggtggactggaattgccacttgcagaagtgtggaggtatggaaggtatgggaagagcagattgccaggaaagttgagttagttttgaactcattgtgtttgagaggtctgttaaattatcaagtagtgatgttgaggtgtaattggaaaagtcaacctggaatttatggcagaagttgaggctgcagatataaacttgtaattttaaaaatgtatatttaaagccatgggagtgaatgagttcatttgagattgaatgcagattgagaagagatttagaattgaactccagggcactgcatagcaggaggaaaacctagtaaaagtggtatctgtaaaatagaggaacgaactgtcacaatttgcctggtactgaggattttctcagtacatgagactttaagagactgggacaccctgagacaattggttgccttccatgggaagaaagtatgtcaagagggagagagtgaacaactgtgtccaataaaccaggactgagcaaaaaccattgaatttggcatcatgaagtcttaggtgactttgacaaggcttgtctgttgtgaacagccaagtaaatgtgaggaccactctccaaaaggtaaagaaacatgcatgaggatacaggtgcgccagctggagacatcatgcctcttccccgtccccaccaggagtggcgtgaagcctccccagtgctgtaacgaggcagccaggtcctgtgtgactgcacatgtgacttggggcaagtcatttaacctctctgttttcactatcctatttgtgaaatattgtttagatttgtggtttgagtcagctatctgtatactacactgtgttaggagctatgtagattaattttcaacagatatggttctggggttgtaggaattttcaatttgagaacaaattgaatcttaccctttgtcaggagaaatagcctttgacatgtgttaggggcaagggaaatctcaaacttgcttaattttaaaaatgaatatttggttgtggataatttaagctttggtgatatttctaattattttttgtgtgtttctagtctactgaccagaagtctgaaaaaaacaactaaaaagaaagactgcataagccttcactagagaagtattgaaaattgcttgagggaagtgacggtttctttagcctagtgtctgtaggaccccagtgtagtgtttgttgaatgaatgaaaggaggcgtatcagtcaggttcactcagagaaacagaagctgtaggaaatccatatggatgtgtgtgaaggtattggcttgcctactgctggtgtgtggctaagcgagcttaaaagtccgcagggcagatagtcaggaaggaaatattcccaacagactgagctcccttgggcacaagctgaagcctggagtctgaactgccagagagcctctaccttcttagaaaaggcttcccactggctaagtcaggcccacccaggggaatctctcctttgattaacttaaagtcacctgtttagggactttaattacattggcaatagtcccttcacagaagcacctaaatgactgatgatgtaactgaaaaaatgtgtgtgtatgctacaaaatggctgcagtctcccttctgtcctccagctcttgcaggagaactctcttgtagctcaccctgtctgaaaacatactggaaaggaattcaaggaaatgtagttcagcctagccacgttgacacatcatgaagccgtcacaaaaggtaaagcctggtttaggagcatttgcatttgcagtcttaagtatttttgtcttatttttcaaaaggggttgggcacggtggctcacgcctgtaatcccaatactttgggaggccgaggtgagtagatcacttgaggccaggagtttgagaccagccaggccaacgtagtggaaccccgtctccactaaaatgacaacaattagccaggcgtggtggcgcatgcctgtaatcccagctattcaggaggctgaggcacaagaatttcttgaacccaggaggtggaggttgcagtgagccgagatcccgccactgcagtccagcaacggagtgagactctgtctcaaaaaaaaaaaaagtagttttggtttttaatttttgattttttcttatgttattacatataacgaatgatatgcatactctgaaaaatcatgacataaaggtgaccttgaaattactttgatgttcatttaaactagtctttggtctccactggctaggagaccacatatagcagaacagcagagaaagcaaaacagttaattttcatgtttggcttttgagcttccagggacccaagtcttgccttgaaccgatcttaggaaattcctcattccctacccgaccctgtttctaaactgcatccctgctgaaatgcaatgccactgtaactctctccaatatttgttttcttctttggcttaccactagatgtatgtatatatgtttgtgtgcctgtgtgtgtgtgtgtgtgtgtgtgttgactgcctcatagtaaagcctactcttgagattaagactcctgatagtttagagaacagaaatcttttttagttcctggttattacttgaatttgcaagaggaacaactgctaggaggcctagttaacagtagttagggtctccacccacttgccaagggcaagactagtttacaccacatttggaatgaccagtttcctcccactttagtttcagtgtagaaagagtaggggagacgaactattcaatgtcagcttgggtgtagtgccagaaccgtactcagtaatgctgtcattgctgttggtgcttaccagctcttcagtactggaatagcttcagacctcgagagtttatgactttatcatcaactgggtgtgttgcccttggcacattgccacacagtgcttaatgatgatatatgttctttatcaaattccccccaccaaataatggcattatttacgtgtgagaaagttgcacatttcaccacctcatggtttattagagtgcaattccgtgagaacaactgcctgtgatcctctgtatccccagtggccaactcaggagctcagtatgccctacccagtagatgctcagaacatcattgctgagtgaggaagtcagccatcattttctccctggatagtctctcctgtagataacaggggccgttatcagccaggtttttcatcatttgtggctttgaatttcagggacatgacaagtttgctttttgtttcgttttgttttttttttttttttggttttctagagacagggtcttcctgtcactcaggctggagtgcagtgatgtgatcacagctcactgcagcctcgaactcctgggctcagtgtttctcccatctcagcctttggagtagccagcagtataggtggtgtaccaccacacccatctaactttaaaaaaaaaaaaattgtaaagacagagtctcacttttttgcccaggctggtctcatactcctggctcaagcaatcctcctgcgttggcctcccgaagtgctgggactgcaggtgtgagccaccttgcctatccaacatgacaagtattattctctggcaggaagtgaaattttttctcactgatgattgcacacaaatgtcatatctccatgaggcttctactcactagttttacggctcatgtcaccttgcttcaaactatgcttcagtataattttgaagtgtatatttccattgcctctccttgagtaattgatattcttcacaataagtttacatttattatcacttttatttacttactattattactctgagcagccaatcttatgagaagctcagagtggaacgtgtgggtcctggtaaatatattatttgactcacttccaaacacacttaatattgcctggtgttttgattatttcaaaatatacagatttcttgaaaggcctgcaaaaggaaacaatcaaaattatagcggttaagaatgtgagtctgccttggtttgaattccagatgggccagtccctagctgtgtaatcatgggaaaattattaaatctctagcctcgctttcttcatctgtaaaatgagcatacaggctgagcatccctagtccgaaaatgcaaaattcaaaatgctccaaaatctgaaactttttttgtgcctccatgacgccacaagtggaaaattccacacctgacctcacgtgataggtcacagtcaaaacattgtttcatacacacaatacttttttttatttgtataagtttaagtggtacaagtgcagttttgctacatgaatatactgcatagtggtaaagtctggacttttagtgtctccatcacccaaatagcatccattgtattcattcaggaatctagcatccctcaccccctcccatcttcccacctctccaagcctttcatgtctagcattctgtgtccatgtgtacacattatttagctcccacttctaaatgaaaacatgtgatatctgtctttctgtttctgagttttttcacttaagataatggcctccagttccatccacgttgctgcaagagacatgatttcattctttgttatgactgaatagaattattcaggcacaaaattattaaaaatattgtttaaaattaccttcaggctatgtgtataaggtgtatatgaaacataaatgaatttaatgtttacatttgggttccatcccgtggatgtctcattttgtatatgtaaatatgacatgatatgaaaaattcaaaactctgaaacaccaattgaactcaatttgcagtaagaatgcatacctcacagggttatagtgaggattgaatgagacaatcctagtccaatttctttgcacatagtaatgctcaataattattacttaaatgggtataaactttatagtaatgaggttggggctggaaaaaatgcagtttcataatttcctatagaagtcattcaatcctgactctaaactctgtattccatgtggtggttgggtggcgtgggagagtcctctttatcctgtggggttggtcctatggaggtgtctgtggcagattggcagatgcatttgtcttgtgcatagatggtgtctgttgtttcctctggcagagttcaccagtgtcctaatgcaaacttagtcctcatctggctcctgcacaggctgatctctggctcctttagcccctcatggttcctgttgtttcattttcagagggacccttgtaaggactatagtcctctcttcagctgaccttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatgtaagtcagcaatctcattactcggtatatagccagaggaatataaatcattctaccataaagacacacgcgtgtgaatgtttattgcaacactattcacaatagcaaagacatggaatcaacttaaatgcccatcaatgacagattggatgcagaaaatgtggtacatatacaccatggaatactatgcagccataaaaataatgagatcatgccttttgtgggaacatggatggaactggaggctattatcctttgcaaactaacgcagaaatagaaaaccaaatgctgcatgttctcacttataagtgggagctaaatgatgagaacttaccaacacaaagaaaagaacaacagacactgtggcctacttgtgggtgaagggtggtaagagggagaggagcagaaaagataactatgtggtcctgggcttaatacctgggtgataaaataattgtacaacaaacccccatgacatgactttagctatgtaacaaaccttcacatgtacccccaaacctaaaagttaaaaaaaaaatcccagacaggaagtagggcatattttgcctaatttgcagcttcatcctcactccctaacttacgccactcatgtctcctccatcatcagggacagcaagagtggggaggggacgaggcctgccacatctccattctctgatcttatttcctcttgcctcttcaacagcgctttgtctctcctctccagcttgaagcccttactctggtatgtgatttcaaagcgatgaaaaactggtttcgttagtacttcccttggatctgcccttgtctcccatcaaggcagtgcaagtaaagaatccaagatatttgttttgttggtccactggagggtagagatagagaaaaacagtaacttccccaccacccccaacctcccttgggctgatgactccaaagactgccataaatgaacacttcatagagctgctattaatatgacacaaatctacttgatctaagggattcttttactttcttagggtggtcattcctaagtctttggatttcacagaaaagaaaatatattttaattgaggactgacaaaggttgccaactttttatcaattataagaattgtttttataattaccatcaatttctattatttcttttactccccctctttccaactgtggaaggtaaaattgaagagcaaagaacacttatttcaaagtgagtaaatttagctatatgaaaactcagcagattgccctgagtttccttgcgtagctgcagtccagtggaaatttcttccagaccagcaccagtcgccccagtgacatttagaaatcactgccctggattgtttcagccaccgaaacactcggtgttcactgtcagctatgattatatatgaagtgctttcgagaaccaatgtatagcataacttaggccaaaagaaacactgtgcctaaacactcagccaaggagtgttgagtttgcctggatttctggaaaattgtctccgttccctagttcactgtatttgggtaaacaaaacatggcctcggagagcctttgcgggagaaattataaaaattcagcaaagctttgtgatctcattttggatctcctcaggattcctcatcaagttgcaattaaggagagaaaaattccgccttggggtgggattttaattactcatcatgttatgacttgactttctgtgctgcatttttttccatatcactacttctgtgtttgacagctcctccaaagagtcgctccgttttatgccaggagcgaagtacttactaagtcaaaggaaagcaaggcaaacatctactattgcctttgtgcttttaccagaaaactgggtgagaacctccttttccttttccctgcccctccagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaagggtaaatagttttctaaaatgtagatgtgattgggattgtcatgattgttttcaataagtgggtaggggagatgccttcaatctgaacttaaaaataaaataaaattactcaatccattcaaatgtgtgggacagctatatgatatcatcatgtaagtatagatagtttttaaattagtttggccagagattttgaaaagctatgtgaagactaagccagtgcaagggatgcaggaggaccaaatgaaatgctcaagaggaggttaaaagtgcaggctctggagccagaccacctggctgccagctcagtgaccttggctgtcacatgacctcccaaatcctcggtttctccatttgtaaaaatgtcaagatttttaataataattactgaaatgccaccatccagaagcattttaattgcttacagttatgagactggatcaagttagaaacataaggtaaacccacatttattgagcatctactatgttctgggtactgagataaaaagatgaataagtcaaagtccctcctttaaagaaagtgtcatgcagtgctaaaacagtggggagagctctgtagaataaatatgtgaatagctaattagggcttgagtttctatagttggctcttctatatgtttataggcttgggcattagtttttggcatcaaactaactgtggaattgtagctaaatgaaacgcctgttgcttctaaaatgtaaaaaaaaatgtctctttggaggtttaggataaacttttatttacatttattttaaaagccaaattaagattcatatcctcctggacaggttccatcttctcatcttccccagaaggtcccagaaagaagatcctgacacacagcccctgccctctttactctgagatattctagttctattttggattttatttcatcacagtttaaggaggttggatgataatgggctggtattattgtgaaccgttgctctcttgttcagacagtcctcactcacataggagaactgaccatatgtgtagctctgatgttttaaaaatacacacttcccaggaaagaaaaacattgtcatttttgggaaacatactcccccattttcagtccatttattcaggtatgactttagtataagttaacacctactatttcatctttagtgaagaatcatttaatttattcctttatgtaaaatttatggatgtttccaaatatggtcagaatcttggaaaaagctgtttaaaatgcttacagtagccagtcaccgcagcttgttcctgtggtcccagctacttgggaggctgaggcaagaggatcacttgagcccaggaatttgagttcagcctgggtaaaatagtgagaccctgtttcttacaaaacaaaaacaaaaaacagtacaatgaatttagaggaaggaggaggtttttttttttttgaaatttgataaggaagataatttctttacttagcatcagttttttagtatactgttgccttgtcaaaagaatttataggtaacatacctgtctgatgtctttaagacagcctctactatttcagttgttgccaaaaagtcttctgtataattaaggcaggggaaggtatcatcatcacaccagagtaaacaatagctgactcctgttgaacaacctgtgcctagcccagaactttatgttgagctgtgatggcgtggtagtgaaaaacatgaacgctacaggtgagctgcctggattcaggtccctgctccaccacttgctgtgtgacttggaacaagatccttaccatctcatttttctgcaaagtgagaataatagtaatgcctgccctatggtgctgattgagaattaactgaattaatacatataaagtgattgcctcagtgcataatgcacagtaaatgctacctaagtgtaaactattaatatcatatatgcgtcttattgtgtgccaggcagtcttctaagcactttgcacactaaccgatttaatcttcatcaaagctgtctactaaaaggggcactcttactactctaacagctttaaggagaggaaactgaggcacagaagggttgagtgactggcttatggtcacatagctataagcgatgaagctgggatttgggcaattagggcccagagactgcatgtgtaacctttacaatattttatctaatactaacagcatgtctctgttcttacctccttatcacagatgagaaaattaaggcttgtagcatttaagcctgtttatttctggtactaatgcatttgcaacaatagcaaaaagctttgctacaattgttatttttgatttcaagactctgaagcacttgaagagtattgctcatggtgcattccttaagtagacatgacaggaaccaactgaattaatgatcaccaacaaaagccagtgtttgcaatttcatcaaagcataagacaactgttctttttcctggctttcaaaaaggagaacacgcgtgtcctaacaaggttacacatgcataaaaaatatgtccaaattaccctgtcagagataggtatttatacttattttccttgttttgtattcgaatacagctagttctacctgtcttgtgtctgaatgccttcggggatagttataatttaacatgattctgtataataaagaaaacccacaaagcaaaaaaatgccaacatgtttgtctcatcaaagtaaaaatgtttattgccccaggaatacttcagacatttggaatgattgggcaagaacatcctaagcattctcactgataaggatttaaattcgtgtcatgttccttgctcatgattaggggttgttttgttgttttacccagtaataacgtgtttatttcattttctacctcattagggttgaactggaccctcatgtcagggactgtgttcagacctacatccgtgagtggctaatcgtgaaccggaagtaagttactttttttccactttttgtatataaatattaattttatattgctagtttttaaatatttcttaatactttgaacagttctaggtttacagaaaaattgcatggcaaatagagttctcatgtatgccttccttatccccactccatatcacacacacagttccccctattatgaacatctcactttagtgtggtacatttgttacagtagctgagccaatatggatatgttgttattaactaaagaccatagtttacattaatgtttactttttgtgttgtatattctatgggttttgacaaatgtgtaatgacatgtatatgcctttacagtatcatacagaattgtttcactgccctaaaaatcctctgtgttccacctgttcatcctccctccctggcaaccactttccttttttactgtctccataattccaccttgttcttcaatgtctttttgtggcttgatagctcattttttttattgctgaataatctttcattgcatggctgtaccattgtttatttatccattaacttactgagaaagaaagttctattttaaacataaagaatagactgcaagcttgcccaacccctagcccgtgggcaacatggagcccaggatggctttgaatgtggcccaacacaaattcataaactttcttaaaacattatgaggtttttttttttgcgatttttttaaagctcattagctattgttagtgttagtgtatttgatatttggcctgagataattcttcttccagtatggcccagggaagccaaaagtttgggcacctggaatagagcctttttgttgtcttctaattctgatgaattcccagggggaaaaattaagtgaattgaaacctggcctcagcttcagaggtggcattcgagtttatgaccaagaaataaattacttgctggccttccagtaagggatctttctctcctggattaatcaaaccttctgtgacattgttctgagctttttctctccatgccatggacctggacagcactctctcatgagaaacatctatgcacattgaaattctcagcctgcatgggtgtacctgttggggagtgagatgtggactctctacagattagggcacaccccactagagacacgtcacagaacctttgacaagacattagtagtttaaaattctgatagcctcactcctcctatacctcagtaagaattactattctatggggtaaatgatgaaagactttgaggattgggttttatctagctcctggaagggtgccattgagtttgtgctgaggttttctggagtaatgtcaatatgcacacattttcagcagcagaaaaagagaaagcattcattattaaaagttattaagagaaagttagatgccaatccatcatctgttctaaaatgaatggaaaacaaagtttgctgggcagtcagataaaattatggtttgctgataataaataaaagatttcagaacaagttgttctcaagtttttaaatgctatcattagaggtactttctggacattaaagatctaaaaaaaatctgagaaggaacaaatagaaagatccattttgatacatttggttttcagatttattttctatttcgggcttgtccactttttcatttctcatggcaatgcacgcttcttggagtagtgatttttcttgatcttgcacaaatgtaagagaaaaaaatgactctttttggaatactcgttgaaattttagaaataattatgaaacacaaatcactcagtttcactctagacagataatcatcatgaacatttgatgtctgtcctttgaatagtgttgggtttttttggtatatatttgcgtgaaaactaaataagattataatatcatttttgtaacatgcattttcagttttcacagtaaagagtgattctcttcctttgctattaaatatgcttcctcaatacaatgattgatgattgcataatatatttataccaaaatttatttaaccaattttaatatttaggtgattccttccttttcagtgttgtgcttaaaatgcaaaaacatccttctcaggaaaaatttgtacatatttatgatttttttctttggaattaattcctacaagaggaatttctatgtcaaaggatatgcacaaatttaaagatttggaatactagatcaaacattatgccgggcgcagtggctcacatttataatcttactcagcactttgggaggttgaggtaggaggatcccttgaacccaggagttcaagaccagcctaggcaatatacagagaccccacctctaaaaaaattttttaaaaaattaactggatatgatgacatgcacctgtagtcctagctactcgggaggctgaggcaggaggatcacttgagcccaggaggtcaaggctgtagtgagtgacgattgcaccactgcacaccagcccaggcaacagaggaagaccctatctcaaaaaaaaaaaaaaaaaaaaagccaggcacggtgctcatgcctgtaatcccagcactttgggaggccaagacgggtggatcacctgaggttgggagtttgagaccagcctgaccaacatggagaaacccagtctctactaaaaatacaaaattaaccgggcatggtggtgcatgtctgtaatcccagctacttgggaggctgaggcaggagaatcacttgatcctctaaaaatagctaaactgggaggcagaggttgtggtgagccaagatcgcgccattgcactccagcctgggcaacaagagtgaaactccgtctcaaaaaaaaaaaaaaaaaaaaaaaaaagattattgacactacatgcatgaatcctcaagaatattagatgttataatttatcaacatttccaattttatttgataaaaggttgtcttttttttcattttcttttactattagattaggcatctttcttctatatatttcttggccattttttatttttcctggtgctctgcttattcgtgaaatttgtgcatccctattaatgtatttgtctagtctgatttatttttataagcacttttttggtaaagatattaagccttgtctaccatgtattaaaaatgtcttccccagtatgccttttgtcttttaaagttgtttttaattttcaacattcagaattatttatgtcattaaatctatattaatatttttccttatgtttaattttggcatcatgcttaaaatttgattcacaaacttattattattttctaagagtatgggattaaagcattaatccagatcattagccacttgactgttgcttctgttcccttatgtgtctccatttgtttttatcttttctacagaagcaatggttacccatatatttattatatgcaagtttttgcatcttgttcccctaaaaaagaaaggaatatgtgttttaattttatgtttggcaacattctagggatgggattaccattggcccagttctctgcacccctgtgtaatggagcagttcccttcttaacggtcacctagtggacagggagaagtgtacaacttcagaactcattgtcagtttctggcaagctttcttgtagaaaagttgcatctctttctatccctctgcctcattctcttgcactctgaatctaacactctgcccatgaaaactaaaattcctagcacacactcctcccagggatcattctgtctctatatgcacctgtcgtattttatctgtggggagaatccagtacactattgccagatgtccttcatctcccaacctcacacagtacatttttagcttattgttttctgtgagttgtatctgtattgttttagaatgatggtagaaggagaaggacaaggagaaggtggtgattcatataaatgaaaccagctggaagctgtgatgctttcatagataagccactattatgaagaaggagacttcagatttctgtatagacactgaccagggactcgtgggcaggaaggtgtgcaacaccttcttatctttattcagtgagttcccctttggggagacaaagtttggtacatccttctctttccagctccatctgatccacagaggttctgtccagattcaggcattaagttatctcttcatttggatgagtttccagtttttctgtgtcttcataagtggtttactagaaagtcggaggaggatgcaataggggttgctggccatttgttaattagtgattaattatttagctctcctttaattggttatgtgccaaatcatgtatgattgttttgaaagaaatcaagtaatatggaggtgcattaaggaaaaggcaaatctcatgcctcactacttaccagtgtcctacccttcccttaactcactcttcactgcgtaaagcccagctgtgtagcttccagatcttttcataccctcacaaaaaatatttgtctatttatatttttcacataaagatatatgtattaatgtatgtacttatatattacaaacatttctttaaaataactgtccatgtcagagctatatcccattctactgaaatgctgcctagtattcaaagggtgaaggaatgtgtcctaagttactgaaactaaatgaccattttggttgtcaccatttttcataattgcaaataatactgaaacaaacatatctgcacatttgccccatacatgtgtgtgaatatttctgagggtagaaatgaagccagtgtacatggtatgctctgataggtactgccaaattcttctccagaaaagtcgtgctgtttcattccattaccaactgggcattaaactggcgtgttcccatattcttgccagtgctggatattatttattaaaataaaatttcagttcctccagtcttcttttagttattattttaatctggaagctattacacctactttctgaatacagtttcctatcaccaagtttcctttccttatgtgttctaaaatcccagttaaatatgcacttaaccatacaaccgtaagtcccactcttgagtatttacataaaacctatgtgcaaatacagcagtttagcagttttatttgtaattgccaagactgcatagcagttttatttgtaattgccaaaaactggaagaaaacccagattgtactcagttgggtagtagataaacaaactctggtaaatccatacaatggaatactactcagcagtgaaatggaacaaacaattgatatatacaacaacatggatgaatctcagatacagtatgctaagtgaaagaagccagacaaaggccgggcatggtggctcatgcctgtaatcccagcactttgggaggctgaggcaggtggatcacttgaggtcaggagttccagaccagcctgaccaacatggtgaaaccccgtctctactaaaactacaaaaattagctgggcgtggtggcacgtgcctgtagtcccagttactcaggaggctgaggcaggagaatcgcttgaacctgggaggcggaggttgcagtgagctgagatcatgccattgtactccagcctgggcaacaaagtgagattctgtcttaaaaaaaaaaaaagaagaagaacccagacaaaaaagataactgcatgattccatgtatctgacattctggaaaagatgaagctacagggatggaaaacaggtccatggttcccagggtctgggagtggggaagagggctgactacaaaaggacacgggagtgccctttgcgtggtgctgggactgtagtgcccatgatgtaaaatctgccttggaccattacattagaagaaatcaattccagttatcccaatattccctccaagtgaaatactttggtagcatatataataataattcaataagtattagctattatatttattaagtagtacctatcagaaaacatacttatattagcatgtcaaaggaatgaacacaaaattctctcccatatattgaacgcaccatggaggggggacctgccttcctctggaggaccatacttagtgaagccactttgccttataaggacatgcctttgttatccagaaccaagcagtcaaacactgatttagttagctcctttatttctcagttatctcctgctgatattacatttctccataatatctagagataggcttttatgtccttgctagctgtggtaatggttttgaatcccacttagggggcagaggagtagagtaatggccacttgtgttccctcccaccctcatcattctacagggcatttgccactcaagtactgtaattgagacatttaaatcatacaaataatgctgcccatgaaggatagaggaaatttttagatttccttttaaacctaacagagaaagattaagttacataaaaatgtaaaatacatgatctccagtacattgaaggaaatgtattttcttacttgaaatgtttgtgttacttagactggaagatttattaaatgatttccattctatcactcatgtttacagcaccaaatttggtgtccttgttctaaaaacaatagtacttttctccccatgacttttgaaaatgattactggtttactgattagcatggcgccatgtttgcttgtttgtccaaccttttatctgcatattttgataatgttgtgtggattaatatttgatgacatcctttgggtgatattaacgattttaagctttatttcttctgtcattttctctaaatgaaccaaagagggataaacttcagaatgtttttgatgcctggtggagagctgaactcttaagaaattaaacttgtttacatactatatttattcttgccgcagagacagtgaaacatttcatgagtgttatgggcagcatcataaaagcctttagactttgtttttcatctggggtgattaaggtaattctgaaggaaggttgagctcaaggagagctgagatatcaaggaatggggtatcatctgttttattactccatattttactcccagtgaagtggtaaacaattaaaattcaaacacatcagtgcatataattcagttactcccagaacaccataaaaatgtttccctgatcaataattgcttattatgacatgcatttgttgtgctagctgtcaaggtgcttagctatttgctttctaaaagtatgaaaagcacgcccggctcatcagcctatgtggtaacaaagagcaatccagctgtggatgtcacagagccactcttgacctgttgtgcatagactccctccccacaaatccaaacccactaagactctccaggctctgttaacacacaccagcctggttcagcttggatgccctcctcacaccatgtgggttctgattttccatgccaggcagtccatcttaaatggatgcatcctcaccgtgtttgggcttcaacttcctattctggacctcctcggctactccctaccccaaggcatggagggctgccttgttctgatgcaccttatgattttagcaccaaattgtacaggaagggagagaagggaaaggagaaagaagatgtgaaaggaaagagagggtagggaagaggaaaaagaagatgaggaacacgtattattttctaatcctcacaataggtcctcaaaatgagcaacatttccccctatttcatacttgaggaagctgtgactcagagagactaaggcacttgcccaaggtctcttagtacattaaggagccagcgtctgcacccagttccttctgactctagagcctggattctgctggctgcaccacactgtctttaaagagaacactctcaaaacgcgcttggtctttggattgtctcaaatgtgttagaatagtgttttaagaaaaggaatgcagatctcctgggaagcaataggtcgagttcatttcatgagaatcatttttctagccattggcctacttccccatttttctcctgtctgcatctaggtgcaacaggaacttggctttatttgactccattgccagggtggggtaatgaagctgggactctcttgtagccagcggcagtgagccagcagtctcactgcctacccagtgatggttccttctgtggccagcacttctggaatgagtcatctttacatgtttgccaacccttgtcctctcctccccagccaggttcacccttgctgctgtcaaggagctttgagactttctgagatttttaaatggggaagtagatgttaaacctagtatgaggaagagagggaaagtttgctctggtttcaaacacacagtcatagaagatgctagtcttaatgctttccatagcaaaaaccctgaaggcttagagtgtacacattgtgaactgaacttttaacattattgtgtaactcatttgttaatgcctatttgtcattgactgtggggtccatgtgaaaaactcccacaaacactctaacaaaatggaagacagaaaagaaagcaagcatcatttgtgtacaatagccaaagaacaatagccaaataaatttgatggtctcaaaagttaagcatcttttgaagagaaaatttgattttagggccaggtggggtagctcatgcctgtaatcgcagcactttgggaggcagaggcgggtggatcacctgaggtcaggagttcgagaccagcctggccaacacggcaaaaccccgtctctactaaaaatacaaaaattagctgggtacggtggcgcatgcctgtgatcccagctacttaagaggctgagacaggagaattgcttcaactcgggaggcggaggttgcagtgagccaagatcatgccgctgtactccagcctgggtgaaggagccagactctgtctccaaaaacaaaaacaaacagaaaaaagaattgattttgattttttcagatacagtgcatgaactttttatcataaaatattaaagctggggaaaatatcttagaattcacctcatgttcatgctttaccctgtgaagaaacagaggcacagagagaaataacttgaggataatggaaacaagcacacatctgtaagtgtgtgtgtgtgtgtgtgtgtgtgtgtgtgtgtgtcagagagagagagagagatgttcctttgtaagtaaacactcttggaaatagccgcattttattataacacaaaaagtaatgctaaagctgatatagttctggttgctaagcttcacacacaaaaggtctttaggtagctgcttcctaatttttatttctgtggcccaaaagtctccttgtaaaccttcgtgtcatgtcatactaaacctttgacatcaataccctttaaaatgtacaagtccttaaaaaaaaaaaaaaggcaaagggcaaatactaatgtgggaaatttgaattttaattaactgtttgtttcaatgttaggataaattaatgttagataaattctttggtaatttttccccctaaaattggatttttcaagaaacatcactggttcagtatattgttatttggggtagcataattttaggcgataacttaatatttgcatatatttgtcactactttgagttggtttttgtcccctgacccccagccaggatgttagatcacacagatttttttttctttgagcccttagggagagtccaaaacagtcacttcatgtactaggaaagtttacccagtcagcacacacagatatgttgttgcctacatttatatttgtgagagtgactgttaagaaactagcaggtttataaaatccgtgtgagaatttctctcaaataactgttaatggacaatccagcaatcctcccatctcaggctcccaagtagctgagactacaggcaggtggcaccatactcggctaattttttgtgttttttgtagagatgcggtttcaccatgtcacccaggctggtctcaaactcctgggctcaagtggtgctcccgccttggcctcccagagtgctgggattacaggtgtgagccactgcacccagcctgtacattttccttgaaatcgtttttggatgtttagtcttatttccttattcagagttcacctgtttattttttttttcatttccccaatttagcctgcgtttcacccagccctagcaatataggtttgggtcagagaaattcaagcggccaggggatgctgaagatggcccattatggccgggcgcggtggcacacatctgtaatcccagcactttgggaggccgaggcaggcagatcacaaggtcaggagatcgagaccatcctggctaacacagtgaaaccccgtctctactaaaaatacaaaaaaattagctggctgtggtggtgggcgcctgtagtccaagctactcaggagactgaggcaggagaatggtgtgaacccgggaggcagagcttgcagtgagcagagatcgtgccactgcactccagcctgggcgacagtgagactccgtctcaaaaaaaaaaaaaaaagatggcccattgtggtaagccttgacttgaattagtcaccaagctagtcttatctcttttctaggctaattcttgttttttgtttggctcaaaacaaattgtttgtcttcagaacacaataaaatccagggagagtgtcctgttcttcctacagacgtcactgggacatcttattctttaattaattcagtcaactaaaattggtcaaatacctgctctctgtgccagagttataaactttgtatttgtataattgctagtagctctcttacatttcttactttatctatctggcatttgatctacctaataccttccaatatcacctcatgtccctttaccagcttggtggtttttctatagttcaggaaatcaaacaaaatggtgtgtgacctggaggtactagaaaaacaatagcaaaccaactccaaagccagcagaagaaaacaaataaccaaaatcagagctgaaaaaaattaaaacgtgaaaatccatacaaaagatcaatgaaaccaaaagtttgtgattcaaaaaaaaaacaaggttgatagatcactaactagattaataaagaaaacaagagagaagatcgatccaaataagcacaatcagaaatgacaaaaatgacactacaactgatgcctcagaaatataaaaaatcctcagagactgttataaatacccctatgcacacaaactagaaaacgtagaagaaatggatagattcctggaaacacacaagccccctaaaattgaagcaggaagaaattgaaatcttgaacagaccaatagtgagttctgaaattgaatcagtaatacaaaacccaccccaaaaagcccttaatcagatggattcacagccaaattataccagatatacaaagaagagctagtaccaatcctactgaaattatttcaaaaattcaaggaggaaggactcctctctaactcattctgcaaagccagcatcattctgataccaaaacctgggagagacacagcagaaaagaaaacttcaggccaatatccctgatgaacatcgacacaaaaatcctcaacaaaatactacaaaccaaatccagcagcacattgaaaagttaattcatcacaatcaagtaggctttattcctgggatgcgaggttggttcaccatacacaaatcaataaatgagactcatcacatagacagaattaaaaacaaaaaccacaggataatctcaatagacacagaaaaggcttttaacaaaattcaacatcccttcatgttaaaaaccctcaacaaattaggcattgaaagaacatacctcaaaataataagagccatctattattcaactatccacagccaacatcatactgagtgggcaaaagctggaagcgttcctcttgagaactggaacaaaacaaggatgcctactctcaccacttatatcaacatggtactggaagtgctagccagagaaatcaggcaagaaaaagaaataaaagacatcccaacaggaagagaggaagtcaaactagctctgtcacagtgcaggcaatataattctgtacccagaaaacactgcagaccctgctaaaaggctcctagaactgataaacaacttcagtaaagtttcaggatacaaaatcaatgtacaaaagtcaataacatttccacacaccaataatgtctaagttgagggccaaatcaagaatgcaattccatttattttatccttttgaataaaatacctaggaatacagctaatcaaggaggtgaaagatctctacaatgagaattatgaaacacactgaaagagatcagaggtgatacaaacaaatggacaaatattccatgctcgtggataggaagaatcaatattattaaaacagccatagtgcccaaagagatttttagattcactgctattcctatcttaattagcaacatcattttttcacagaatttaaaaaaaaaaacctattccaaaattcatgtggaaccaaaaaacctgaatagccaaagcaatcttaagcaaaaagaacaaagccggtggcatcacactgtgtgacttcatactacactacaaggctacagtgaccaatacagcacagtccaggtacaaaaacagacacgtagaccaatagaacaagataaagaaccagaaataaagctgcacgcctacagccatctgatctttgacgaagttgacaataacaagccatgaggaaaggtctccctattcaataaatggtgctggagcaactggctagtcatatacagaatattgaaattggacccctccttttaatcatatacaaacattaactcaagatggattaaggacttaaatgtaagacctaagattacaaaaaccctagagaaaaaaactgggaaatactattctggccattggccttggtaaagaatttatgaataagtccccaaaagcaatggtaacaaaaacaaaaattgacaagtgggacttaattaaactaaagagcttctgcacagcagaagaaactatcaacagagtaaactgataaccaactgaataggagaaaatatttgcaaaccgtaaatctgaagaatgtctgatatccagaatctataaggaacttagataattcaacatgcaaaaaaccaccccatttaaaaatgggcaaaggacatgaacagatacttctcaaaagaagacatacatgtggccaaaaaatatatgaaaaaatgcttaacatcactaatcattagataaatacaaatcaaaaccacagtgtgataccaactcacaacagtcagaatgcctgttattgaaaagtcataaaatagactgggcatgtggcttatgcttgtaatcccagcattttgggaggctgaggcaggaggattatttgaagccaggaggttgagaccagcctgtgcaatgtagcaagactgtgtctctacaaaacatcaaaataaatggaaaaaaaaaaagaaaaagaaaaagaaaattaactgggtatggtggcgtgtacctatactctcacctactgggaggctgaggtgggaagattgcttgagcctaggaattcaaggctgcagtgagctataatcacaccactgcactccatcctgggtagcagaacgagaccctgtctcaagaaaaaaaaaaaggcaaaaattaacatgttggaaattagttcagtcactatggaatgcagtgtgaagatttctgaaagaacttaaaacagaactaccattcaacccagcaatcccactactgggtctatacccaaaggaaaataaattgttctacaaaaacgacacatgcactcgtatgttcctcacagcacaattcacaatagcaaagacatggaatcaacctagatgcccatcgacagtggactagataaagaaaatttggtacatatacaccatgaaataccacacagccataacaaagaacaaaatcatgggggtttttttgcagcaacatggatgcagctggaggccattatcctaaacaaattaacacaggaacagaaaaccaaataccacatgttcttatttataagcaggagctaaacatcgggtaaacatgggcataaagataacacggtagacaccagggattactaaagaagggaggatggaagcaggtgtgggttgaaaaactgcctattgagtaccatggtcactatgtgggtgacgtcagtatcatgcatacatcaaacctaagtgacatgcaatttacccatgtaatgaatttgcacatgtatcccttgaacctaaaataaaagttggaaaaaaataaaagataagatatcccgtatcctcaataaaaataaaagtggcgtgtttgtgcacttgactttgtaacatgttttccaaagatgtctttgagtcataaaaatgggaaatacacatgttggtttctctagtcatcacttgacaacttacatgttttacctttcttatgatggtctgtctcatttcttcagtgacagggctagacattctgttttaaactcttcccacagctgtatattattcaacacaactttaacagagttcatagagtggagattgaggatgtttgcaaagttaaatcatttatttttattttttcttaaccatgtcccgcctgctttattcattattaagaacattgatgtgaagattaaatggttttctctatttttatcttcaaacgatctctatttgtggcttctgcacattgctagatttattccagccacttacactagggtcatagtttagcttcagctcggagccaaatgccccacagctgaaatgaccgcacctctgaagtggcattttcccaggccatgcctccctttaataatgagccagccagggggtaaatttgtatctcattacaacagagccttgtattaggcctggagaataattaaatgtgaggaattataattggttccctctttgaaagctctctcagcaccatgtctacacttaagccattacttttatttttaatctaatggtttgccgctctctctccctctttctctctccaaattaaatatcaaccataaaagaaaccaaggaagtccagaaatctgtggctttaaaaagactggatctcgaaaagattttcacaagacgcttccgaaacagacgtttgagtcggaaaccttggagtgcagtgaacccgctgctcaggtatttcctgtcaacaaacatggttaccaggttactgggctcttctgcccagggcatgctgtcagttttacaaactagaataaacgatagacgcatagaaagtttgagtaggaggaactttaccatctgagtcagtgattttttttttcaaacttatttgtagctgtagaaattggtgttcaaatgaaaacccagaaacccaatgattaaaatagaaaaaagtggaaaagctctaactgggggacagagacaccttgggcccatccctacgacagttcctgcagagactcttggtgcccctaaggcaaactacagagtaatgaaaagctctatgctgaggccagaatacctgcattctcctagtgattctaccatgtactaactctctaacttcaagcaggataattaaacttattgggcttcagtttcctcccctgggaaacaaggatggtaatactaactcatgaggttatttgagtattaaatgagttaatatccataaagaattagaataatgccaagtacacttagtgcctagtcaatgctggtcactgttattgttattgtcattattctttttcttttttttttttgttgagacagagtctcgctctgtcgcccaggctggactgcagtggcacgatcttggctcactgcaagctccgcctcccgggttcacgccattctgctgcctcagcctcccaggtagctgggactacaggctcccgccaccacgcccagctaatttctttttgtatttttagtagagacggggtttcaccgtgttagtcaggatggtcctgatctcctgaccttgtgatccgcccgcctcggcctcccaaagtgctgggattacaggcatgagccaccacgcctggccagttgtcattattcttataaagtaattacagtttaaaattcaagttaaagtgtacatattgtgaaatgagcttttaacactattctgtaactaattttttaaatgcctggggtcatttgaagaactccagcaaacactctaacaaatagaagacagaaagaaagcaagccttcatttgcataaaacggccaaagaacaatagccaaataaattccatgtttccaaaagttaagctctatacacctatgctcacagcagcattattcacagcagccaaaaagtagaagcagcccaagtatccatccataatgaatggataaacaaaatgtggtcgccaggggctgggggagggaggagtaggaagttattgtttaatgggtagagtttcggcatcccaagatgaacagcattatggagatggatgctggtgatggttatactgcagtgtgaatgtgtttaacactactgagctgtccaacctgcccattttatagatgagaaaaataaaattgagaagaaaaaatttgttcaagtttgcacagaacttcttgtaaactaatatagttttcagcttccatgtgtcttcataatacaggaatctcaccatgctggaaatgattcgaggtttttaaataatactaatttttcagacaaggtggtccccctaaagcaaagcccactacttacttggagcttcacagtagaatcagccatcatttccagcgctaaatatgacaggcttactgagggatagaatacctggatgctctgctctatgggagatttaaggaatttttcatcagtaattttgactgaattccattttcaccctacatgctgaccaattaaattgttcctcttaatgttagtcagatagaagccacggtaggtatttcagcagaagaaatttaacacagggaattgattaaaccggttttggaggtctgagagaaccaaaagggaaaaatggaggctatcctaaaatcgtcattatgggaaacagcacaccagcctggggctggggtatacggcagtggttctccacttcagcttcatcagaatctcccagagggtttgttcaaatataggttgctgggccctgtctgctggaatttctgattcagtaggtctggagggtgaacctcatactttttaattagcatttcctaagtgatgctgatgctgctggtcccaggaccacaatttgaggactgcaggtctaggggaagatcttggagttgtcagaacgtagaagctcagaagaggagcctgagagcaaggactgaaatccctgagaaggtactgcccagctggtggtgttgtctcaagatctcagagggaaaaacctcatgaagcctggactcacgcctcacaggaggagaaattgcccggctggtgctggtaccttcaaggaggtaagataagggtgattctggaagtaccaaaagaacctgaaggctagaaccagctgtcactacgaaggtgagaggaatagcaagaggaaggagccaggccctttgacctccttgaaccatccggtaaccctgtagtgctccctattgacagaacctaaagggagcagcagacacagcggaaatatgatttgctgacctagcatcaaagaacaaggcataaaagggtgaatttggagcccagaaacaataggtgaagaccagcgtacacacaaagcacacgctttcctgcagcatactagcagagaactcaagtcactgtgttgtgtgtggttttttttgttttttttttttttttttttttttttttttttttttttgagatggagttttgctcttattgccaggctggagtgcaatggcatgatctcggctcactacaacctccgcctcccaagttcaagcgattcttctgcctcagcctcccgagtagctgggattacagacatgcgccaccacgcctggccaattgtgtatttttagtagagacagggtttctccatgttggtcaggctgatctcgaactcctgacctcaggtgatccacccaccttggcctcccaaagtgctgggattacaggtgtgagccaccgcacccggcccactgtctgtgtttaagagccaacttgatcatatgatccagcagtctcactactagatatatgtccagaggaaaggatatcagtatatcaaagagacatctgcactcccatgtttattgcagcactattcacagtaaccaagacgtggactcaacctaagtatccatcagcagaagaatggataaagaaaatgtggtatgtatacacgatagaatactattcagccataaaaaaatgaagtcctgtcatttgcatcaacatggatgagtctagaggataagtgaaataagccaagcacagtaagactaatactgcatgatctcacttatatgtggaagataaataagttgatctcatagaagtagagggtagaagtggtaactagatgctgggaaggatggatggagaagggaatagagaggttggttaacggttacaaaattatagctagataggaggaataagttctagtatttgatagtactgtaaggtgactagaattaataataatttattctgtgtttccaaatagctagaagaaaggattttgaatgttcccaacacaaagaaatgataattgaggcaatgggtacactaattaccctgatttgatcattacacattgtacacaggtattgagatattacactgtattccataaataggtacaactattatgtgtctattaaatttttttaaagagccaaattgtacaaaagttgtttgttttgaaatattggaataatactcatcatggagagaatctcagactgcgagatgacagcaatgttttcaattccactctcattcttgtgcaccttcttattgagtagaatggtgaggccacatagctagatttataaaatttaaacaagtatatgataagattccttggtacacgtagattttataaaaattagattatattatgcataatattgcaaaacttcctttttcatattagcaatatactgtgattatctttctcttccaattaatacgtgttctttcttttttagagacagagtcttgctctgtcgcctaggctggagtgcagtggcacgatcttggctcactgcaacccctgcctcccaggttcaagtgattctcctcccttagcctcccgagtagctgggactacaggcatgtgccacgacacccggctaattttttgtatttttagtagagacggggtttcaccatgttagccaggatggtcttgatctcctgacctcatgatcccccggccttggcctcccaaagtgctgagattacaggcatgagccaccgcacctggccaggttctttcttttaatggctacataacattctattttatgaaagttccaaaatctcttaacacttcctttttgggggcatttagtttacttctattgttttgctatcacgaacagtgtttcagagatgcccttgccctcacattcttgcacacttgccagttataccctacggataaattcttagaagtgaaatttctagattaagggatgagtaatgttagatttttttacttatatgtatcttgatatccttttaaataaatttgggaaattaaagtcattttccttaaactcttataaattttaagaaaaacaaaagtattaataatcgaagtgttaatattgattatttctagcacattcagtttggggaaaatttatgatctagtagagtagtacttttgtgaggtagatgtcacaaaaaatgtgtagtatggagaaattgtccagtagtatgtccatttagtagaattttgagaataacattttgccataaattttatagatatttaccattaatccatttgtagtcctacaacatatagttgattacagttatacattttttgctgagtctttggttcaaagcatgcagttcccaattacaaagacattcctaatggaataaaacatccactttgtgactgatttaaggttgttttcttaaagcacaccgcagccaaaagtggacacagcttgaatagcaaattttttcctttttgttgttgttgcttcatccaataactgttaccaaattcccgtagaaaagtgttgcccactcccacatcgacctttggaagcataacattcagctttggtgtctatacacaatttaatttggaaggctcctcacaaatcatcttattttccagtttcaaaaaccaagttctgagtggagattaagacagggtctctttatttcccagtgcagtctcctatctatttatttgtgaatgaatgaattagttaattaatgagccagggtttcactttgtcacccaggctggattgcagaagaagtcatcgtggccaagcgtggtggctcatgcctgtaatcccagcactttgggaggccaagacaggtggatcacttgaggtcaggagttcaagaccagcctggccaacatggtgaaaccctgtctctactaaaaatacaaaattagccaggcgtggtggcgcgtgcctgtaatcccagctactcaggaggctgaggcaaaagaatcacttgaacctgggaggcagaggcagcagtgagctgagattgcgccattgcactccagcctggccaaaaaatgtgaaactccgtctaaaaaaaaaaaaaatccaatctttcctattggctttattaaatacactttaactttagaagcttagaagcacaataattagaactggcctaactttaaaaaaaattttcacaaagaaattagtaacttgtagggtcatttgtaatctttttctctgttgatttttacagttttaaaaagttaatacaataatttatttacttattttttgagacggagtctcgctcttgttgcccaggctggagtacagtggcaccatctcgggtcattacaacctccacctcccgggttcaagcgattctcctgcctcagcctcccaagtagctgagattataggcactggccaccatgcccagctaattgttttgtatttttagtagcgatggggtttcaccatattggccagtctgatcttgaactcctgacctcaggtgatccgcccacctcggcctcccaaagtgctgggattacaggcatgagcccaatattttaaaaatagtacattattacagaagctagatgtgcactttaaattattatcagaaaattagtatgacagacaaattctatgattgtcccatcatctgggcctgtgacattcacacctttgtgatgttcatccccgactgtgggtgggacctgggacttgcttctgtcaaaacaatatggcaaagcatgagaggatgtcacttgtgatcatattagatagcagccaaaatggattaaagacttaaatggggccgggcgcagtggctcacccctgtaatcctagcactttgggaggttgatggcggcggatcacctaaggtcaggagtttcagaccagcctggacaatatggtgaaaccctatctctactaaaaatacaaaaataaccagatgtagtggcggacgcctgtagtcccatctgctagggaggccgacgcaggagaattgcttgaacctgggaggcggaggttgcagtgagctgagatggcgccattgcactcaagcctaggtgtcgcagcaagactcggtctttaaaaaaaaaaaaaaggtaatcatacctcactgcagccttgaactcctgggcggggttcaagcagtcttcctacctaaacctcccaagtagctaagactgtaggtgcacgccaccatgcctggctaagttttgcttttttttttttttttaagagactgagtctcattgtgttgcccaggctagtcttgaactcccggcctcaagcagtcctcccaccttgtctacccaaggactgggattaaaggcataaaccactgcacctggcccagtctcctttttgttacaacttcctccagctctgttttgctctggtgtgagacatgagcatggttcattaagaggcttggcccccccagccccaggaaagaacaagccaacaaccgataggaatgtagtactgtttttagtcctttcctcaggactggtttgtctgcataagatgagtaactacctgcttccaggtgagaagaagacatttaattttagagtagtccagccaggaagctgagatgtcattcttatcaaatccgcagtttcttcagaagacttgaggcctggctgagattctgtagtcccaaattggagcagtcttgagacatccaagattcttcggttctcattttagacttgccgtctctctcacaaagacccactgttttctctcacaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggtgggtgccactgtttccatactggagaatctcagtgaagactctgagagtcatgtggacaattgtgttgttcattattactatatagcagcccatggtgtcagggctcacttgtatgatttctggggcctcgtttttcactcaggcaagcctgtgtgtcatagcagagccattattgattatcacacagatgggattctgataataataacaactggaattttcatagcactttacaaaatatgttcactaagagcatctcatttaatccccaaatgtttcaagggtctacatgtagtaatcacacccagcaagtcaaaccatcctattatttgaggggatgtgtggtcactaatccattgagacatacattacttaaactttgatgttctttagtgctttgttactttctttttaatggtctctatgagcaaccagagagacctgctttgaaaacatttcaggctaggataatcacagcccatgctcccaatgtatagaactttgggatcttgattgtttacttcttcatttattggagctgactgacaacaataggataatgtagactttgcctgtggtcactgcctgaggcactttggatgaaatgagaggtgacgattattcaagccttttgtctgtttgaactccttatactgtataggaggctctcagttttcccctctgcgtgaggttatctacacttctgggtcttgccagaacagattactgctatatctctgctgtccaaatggtattgaaagttcagttggaagaaacaggatttgaggaaactgcataaaagatattctatccatccatgcctctaaatatttgaaattcgatccttggattaagtgagacaatcagagagcctgatacccccacccttctggattgtgtttgctaacctgcccttcagtgagctcacgactggtcagcaaggaggacaataaaggaaacagcagtcatgagataggatatcacgtccacatggaaatactattgttgacattgacctactcaccatctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttcaccaaatgtggcaacttaatgattggggtcctgaatttactccagctttcttttcttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaaggccacaaagtctcaggcgggaggaatacgttttagtgacctatcgcactgcacagtgaccagagttaataataatgtgttacatatttcaaaactgctttaaaaaaggatttttaatgttctcatcacacacacacaaaaggtaagttggtgaggtgatagatatgttaattagcttgatttaatctttctacaatgtatgcatagatcaaaacattacttgatttaatctttatacgatgtatacatagatcaaaacatgacactgtaccccatagatgttcacaattactacttgtcaattaaaaaataaattaataaagtatgaataatgtgagcaatatcatcatctcctttcctcagattaaaaagcaacaattaggctaaagagctttttcaagattcaacagataaattaaattacaaaatggggccctaacccgctaactacaaagttcgtgttcccttgtttatgtatctacatacatatgactacctggtatgttgggacacataactgaaatccaaatatgatatttttaaatatcatgtaactttttagtttccatccacgacattaagactttttaccagatttgtcaaaacatattaaatcagactgatttggcctttactttccttcctcttcctctcagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgtagcctggttttagaggaactttgttttatgatctttgaaacaatgcagacgctccattgggactgaatgttataatctgggagcaggcctaatggggcctgcttttattgagtagagagaagtgcttcgtaattagtgttgcagttatttgtaaactggcgtgtctaaaatgcttgagggcctctataccagccctttaatattttgaagctgttgtcacagaaattgcatttgtatttataatttgtgctttctccaaagaaagttctatggaagaaaggtaaatttctgcctactctgacatgattacaaatgctggttttttcgatgacacaatcagatttttaaatatatcattacttgatttccctgtaaggaaagttagaagagaggtaaactagtatatccaagttatggctgagtctacaggagaagcaaaagttggacttaaccaccaagcttctataaggcaagttctttccctaattcattctgagtctacaaaaggcggttattctacaaaaggcattctatgtcaatccctaagaaagattccactgatactccaaattatagaaaagtttgctgaggctgttggttacaagtgacagaacccaactaaaaccaattcagaaaaaaaggctaggggagtacttcttggctcacctaagaaaatcacaggtaggcaaatgtggagttgacctctggatccattgggagagtaaatgaaagaatatcatctctctcatactgtctctttctctctcattatctctttcattccgttcatttatatatatttttaggatgatgaaaacaagaggtatccattaatgtttcacatttccactttctgtttgcttgggaattagttgccatttcagttagctataaagcctgaggaaattcatatagcttagaagagactgaggaaatatatcacccaaatgtcatatgtggaccttgtttggatcttgatttaacaaaataacagtaaaaacaaattgagacagtcagggaaatttgaaactgacaaaaattatttagtggcaataagaaattattaatttttaggcataatggtattgctgtatgtttttaaaagtctttatcttttaaagatatgtactgaaatatttatatatgtatatggtctctgggaagttgcttctatgtaatccagtattgagcgagaaaggtggtaagtgggtaaatagatgaaaccagaatgcccctgaattgaacttgttgaagctagatgatgggtgaatggttcttcattgcattgctctctcaacttttgtgtatgtttaaaattttcccaatgaaaatcttttttaaaaggatttcaaaaattagaatctagaccaaaggcagtcccagaaatccatgagtgtctctaccttcaggttgttttccagttagggagatcttccctttagatatgtctgttccaatgatcctaaaaggtccagattgccctgagcgagtaggcatcaaaacaatgtctcctctgaaataaactcagccattccacccagcaacatggccaaccgccgtaaccacaaggaatggggaccacagggagaggttggagtaatgatgagcttaccacattgatcattccatcaaagtgggtacatatttaccaggaaggtgactttactgctatttgcaagaatgttaagcttgctgtggggtattcactggaaagctcccaggaaaagacagtgagatgtgaccctgttctttggacccttgcgatgggcagagcactcaccagtgtttggaaagcatactgcaagagtgggaattactgttttcaaggatttgcactacttatttttgcatacatgaatataattaacatagaatgatagttcagatacagatgttaaggttacaataggggcttgatatttctctttaagtgtttagtttctgtgcggtaaaataaacaggtagagctcttaatttgtcattactaaatttcatatacctagcactttaggaagctctaactgcataagcctgtctagaacttgtcaattcaaccccaagtctctatcatctgtttaagaaaacagtgaactgagaaagtgactctgtattataggatcaatggtttacagccttaagtgaaccattctgactcagatttcaaatctgaaactcacatacttactagtaaagcccttgacaggagaaatattgcaaatgtgtaattagagtgggcaaaaaacacacaaaaacatcaacaataggtataagattttgcaatgccatctggtggatgttactaagccatatccatgttcacatttccttccttcctgcttcagtctctttgtcttgaatgcttgggtttctaaaaggagaaactgttttgctgcaaatgctggctttgaggttgggggttggaagagaaactttcttataaaaggcagagtgttagaaaaaaagcaaatctaagttaacttgagccgtggagggtagccttcccttccctgggttaactctaattggagctccccacagaattcactaatgatttccttacgatgtgattaaaaataggaggatgctgtggaaatacgtccagtaccagaatgtcccaaggaacacctgggcaacagaatattggtcaagttgctgaccttgaagtaagtatcaacaaacacactgccaccgctttgagatttatcttgccttttacatacaaatgttgtgtttattatcagagcttgaatcaaagcggagctcccaaaatacgtctaacagtgggcagctgtggagtagtagaaagggcacgtttgagtccattcctggattttttttctaccaacttcttgatggtcattcttctacaatagagaaggcaaacacacgtgtctactaaagttaggcaggtaaggtcattgagtgaaatgacctacattaagaaaaatagcgcttaagtcagtggtgtgctggagtcgactgtactaactcgtgagatctgacagtgcatatctcttcctgggttcggtgaagtcacattggtaactttaaattggccatggcgaaagtatttacaatgtagaaatcagccaatgctacacgtttgcaccaccctcagcacccggagattatttgtaaaacatttaccagtatgccactgttgaaacacaatgataaatgcaactgaaactcagtgccaggggacaatagggagtggtgaggactgtagtaaactatgttaagggggcactcactgctagcaacagactcttgccatccaaataaacaggcccatttttgtcaactgtcttttctattttttcaagagaagctgaaaacccagatttttctgcataatataccgactccctaaatatgttctcattccctttataaacaccatataattaaaacacgactacagtctggtttcatcttgtgggccaattatttgccacatctacttcaaagtagttgcatccaaacgtttcaattgtatactatgatagcaaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatacctctcttcgtctctgcagactgctattttcaagaattagttctccttcaaatccacagatgaaaactttaaagttgtacatattttacctaagcaaaactacagaagcgtaacatttatttatatactattagatgggtcatccatctctcaaagtcacttcataggtcccttcagcggcccctggtttgcagtgagaaggcatctggattctggatgtaaggctgggtttcaacccctgggaacttccctgggattttgagttcttccctataaatgaagttgatagaccttatggtctcaaaattcctacctaccacaaacttctatgattctaacgcatagcctctgccaacttcttctgcctcagaaaacaagccagcaagtctgctcacacagctatgggtggtctcttgatattatagtctcctcccgctggccagttctaccagagggtcttcagggccttttgtacggagaaatgagcagcccataaaccagctgagtgtcaagtaatgggcacagaaaagcaagctcttgcccttgcaaaccaacctggcagtgggagcttcctcatctgtctggttggcgggaggactgagtggaagtggctcttcccctctgcattgtttaggaagccttcgctattgtctgagggacacacctgccccgacaggatgcatcatcaggctacttttagatgcagcgactatgtcatttgagatggcagaaattctcctctatggtgctcatagccaagctttctagacctctccagtgaatgagaggcagctgttctcacaggtgggaaaacatggtcactaagagagatatgtgttattttaaaaaaatgttaatggaggccaagtgtggtgactcacacctgtaatcccaacactttgggaggccaaagtgggaggatcgcttgaggccaggagtttgaggccggcctgggcaatatagtgagaccccctctctaccaaaaactaacagatgtgttaatttttagccctagctacattgggaggctgaggtggaaggatcgcttgaggccaggagttcaaggctgcagtgagctatgatcatgccactgtattccagcctgagtgacagagtgagaccctgtctctaaaattaaaaaaagaggagtcacttgaatatctcttaatgaaaattgtaaagtgcagtttctagtgatgtccccgcaactgccaaagcagaaattaagtcgaattgacatatttgccaggtgcacttggcctgctcatgtgttttaaatagtatctatactaacctataactgcaagagaagagatagaccaaaaagacagccctccgagtaactacttagagtaaactagatgaaagaaagaaacaaattcttataggtaagcctagaatgtgacagtatgaatagtaaaaatataagggtaatattaatggcaaatgttttcccatttacattgatatgtaggattctattcataatactacatgttttagcccctgaggaatttgtttaaagttgtagacatctgtaactgtctctgtattgcttttcagaaatatagaaaccctcaaagatacagagagaattagggtcctgccaattctgcaaatgtttgtaacagaaaaaaaaaaaaagaatgacaacaaagtatttttctgttttgtgttttaaatggagaaatattttaagatttaataccatcttatgaaaagtaatctcagctcttaggagtcttcttgatggtgaaactttaatgtgcagaaaatttgcccaggcagtttcttttaaatgcagattttggaggaccttccataacaatctccctcaagagattctggttgagtaggtctcaggtgggatcaagaaacctgcatgctggctaacttcttttgcttcaaaatgctagattctggggactacacttaaagaacaaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaaccggaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgtgccagtccctaactgtgtagactttggcaagttccttattccctgggaaccttgctttcctggtgtgttaaatgcagataatatctgcattacgctgtagttgtgtaaagagactgatgtgtggaaagcacttattataacacaattttaagtctttaataaatgtcaattctctttttctttctcggaaccacagaggacttactactcagtaccaacctaagtatatcacagcaatattcaggccctttgtgtagtagggagtaaacaattaaatatagattgagcatgccaggcagcagctggtgagcctaggcccaggaaagcctccaattggcctggtgcagtggctcacacctgtaatcccagtactttgggaggctgaggcaggtgagtcacctgagctcaggagtttgagaccagcctggacaacatggtaagaccccatctctactaaatatacaaaaattagctgggtgtggtggcacatgcctgtagtcacagctgctagggaggctgaggccgaagaatcgcttgaacctgggtggcggaggttgcagtgagccgaggttgcaccattgcactccaccctgggtgacaagagcaaaactccatctcaaaaaaaaaaaaaaagaaagcccccaattaatgtgcaattacctaataatagaaagaataatcatagaaatcctcaacactgggcttttcggtggtaaaatgtatgtaacataaaatctaccatctttttttttttttttttttttttgagacagagtctcactctattgtccaggctggagtgcagtggcatgatctcggctcactgcaacttctgcctcccaggttcaagtgattctcctgcctcagcctcccgagtagctgggattacaggcacttgccaccacgctcggccagtttttgtggtttagtagagacagggtttcaccgtgttggccaggctggtcttgaactcctgacctcatgatccgcttgcctcggcctcccaaagtgctgggattacaggcatgagccactgcgcctggccaaaatctaccatcttaaccatttttaaggtacagttcagtggtgagtacattcacattgttctgcaaccatcaccaccatccatctccaggaatttttctcttcccaaactgaaactctgtacccgttaaacaataactccttattctccctactccccagcccctggcaactcccattctactttctgcctctatgaattttactactctaggtgcctcatgtaaggggaatcatgaagtaactgtctttttgtgactggcttcttttactcataatgtcctcaggttcatctatattgtagtatgtatcagaatctccctccttttatggctaaataatattccattgtatatatgtagcatattttgttatggcctcatatatgtatctgttcatggacaagtgggttacttccaccttttggctattgtgaatagtgctgctacttggcattgtttttaagatacattcacacacatcattatacgtgatcctcacaacaaccaggaaaatggaaaggcaagcatccttaccttattttgcagataaataaatggaattcagaaaggcgagtaacctgattagggtcgcagaattagcagatggtggaggaggaacagagtccaggtctctgcctgggtgccctgggagtctgccatgattccaaattgcctcatttccaaaggcgccatttgagcaaataaccctttttgtctgtgctcatattctgtccaaatattcttctaaaaagtcctcttttgagacaaagctatccattgatgaggacatcctctcacacatacctggagacaaaacatgactttattgacatgatgtctgaggtaatggtggactggggcccttttcctggtgctctctgcaggtaacatccaaagccatgggacatcaagctgagaaacttggaagaccttcaccagtgttccatgtgcacctgtaatgtccaccaagatactaaaggcaaataatgcaccaggattatgctttgggattcaccgtttcgaggggaattggcaattagggccaatatgagggctcatctttctagctctcatggggcccaggcacctcagtgtttatctgctgtgctcaagcccctccctgacctcaactcagcaactccccagtaatggagttaggaagggccagacattcatccccatcaaaacccagccttcttctgactgtcccactacaaatctaaggaaaagcaattgaacttttcttttgttgccatctgaaaagccccattccttagaattgaataatacagattctatcctttaaatttttttatttcaatggctttagggtaagtggtttttggttacatggatgaattgtatagtagtaaagtttgagattttagtgcacccgtcacccaagcagtgtacattgtacccagtatgtagtttttttatccctcatccccctctactctcctgcttctgagtctccaaggtccattataccactctgtttgcctttgtgtactcatagcttagctcccactaacatacagcatttggtttccattcctgagttacttcactcagaataacaacccccggctccatccaagttcctgcaaaagacattaattatttccttctattttatggataagcagtattccatagtgtatagataccacattttctttatctactcattggttggtgggcaattaggttggttgttggttccatatctttgcagttgtgaaacagatactatctagcaataaaatgtgaaatgtgaacaagtccattacctcagacagaaagtctaccctctgaaaacacagtagttacaataagaaggtgaatcacactaaaggtccattcagcccactctctcttgcagtgagtgagtgaatgagtgagatattccaaaaatatccaccatgcttttgtaatgtccaccatgatctcaaatgattaggaatttttcacaaacctcctatatttctctattaatatcccagtgcgattctcatatacttggagttttccaaatatttcgggaaactgctcatatttttaaccagtttatctatctaggtgttttcagaaaattcaaaattatctaactcaaagccacatagattttcctctctttctatggtaggttcgagattgaaattgagcccctgtttgccagcattgccctctacgatgttaaagaaaggaaaaaggtaagaaagcaaagaaaaatccatccctaaggcacatatattgttcatgattctttgcatgtatgtttttaaatttctttgcagcaagaacctatcagatttgaaagcaaatgatctttgatgagtccagttctgttgcctttgcaatttttcaagcagtggtctgagaatgtaatttatgatctttgaagaattttagagggagaggctactggaggtgctggcctggttggaatagagaaagaatgaaatagcgcatggggttatgtataaaacaaacccatttaaatacatttttaacaagcttggatgcgcatgtaaagcttcctcagtttgagagttctttgcactgtgaaataggctcatgactgaagggcatcttacatggtagaggtctcaatttgtcacagagttcagaccttaccaactgtaatgtgcttttaatgaaaacagtgaccaagacctctcgtgtgtttttaatgtttagtcattttgtgactcctagaagaggacagcaatagcaaatccagagtaggatggacacttctgcccttctttacccataatcattctgtatttaaggaaacaagcatctcctgcataaatattaataatcactgagatttgtaggataggttaactgctaaaacaagcagaacccaatctcagtggtttaaagcagtagttctcaaacttgagcatgcatcacaatctcctggaggacttgttaaaacacagattgctggacctcacccacagagtttctgattcagcaagtccaggtggggcctgagaatttgcatttctaacagtcccctgctgatgctgaagctactggtcaggggaccacattttgaaaaccgctggcctataagcaagaagttgctgtctttgtttctttaaccatccagggtgggaggagggacccctctgttccacgcagccactcagaaatacaggctggcagtggctcctccatcttcagtatgttctctccccaaattactcttgtcactgccattgctgcccctgaagaagagaaaagaaggatggaggaggcctggaagtttgatacattgcttctgctaacaattcactggagagaattgagtcacatgatcacccctcattgcaaaggaggctggtaaatgtagtctctgcctgggcagccactcaccactaaaattctcatggtgatgaaggagagaacccaaccatacagtggctcttaagtaatacgacactaagagagccaggagcactgttcacatcatgctcttgctcagaatcttcactaagattcattccctacaaccaggctttcttcatgatggcattcctctaccttctttccatccatagtctatgcagagtcaagctagaccgctgactaagcttcccccagccgttcaagcctctgagatatttattcatactctaatctctccctggcacatcatcaccttccacccctgcctatcagaatcttctaaggcccatccatctccagtgctgcttccatgaaaagttgtccttgtcacccaactgcaaatggcctgtcactctggaacttccacagtgcttctttgtatgcatgtggtgacttgtattttgcttttactgtagttagttacatgtttaccttttccctcacctttttttttttttttttttgagtcagggtctcactctgttgcccaggctggcatgcagtggggcgatcttggcttactgcaccctctgcctcccgggttcaagtgatccatcctcccacctcagcgtcccaagtcgctggaaccacaggcacatgccaccatgctggctagtttttgtattttttgtagaggcagggtttcaccatgttgcccaggctggtttcaaactcgtgagctcaagcaatgtgcccgccttggcctcccaaagtgctgggattacgagtgtgaaccaccacacccagtccttccctcattcttgattgtgaattaattgagagcagaggtcctcctcttctgtagtgaagtaactgatactcaggaaataccggtgggttaataaacatttaaatgtttcaaggaacatctctcaaatggctccagaatacctagacattgtgacaaaacatttgtcagatttatccaggagccactttcctaaaccacatctgtgattattacacttactccttcagcaaaatttctctgtggtgtttttactcctttttaacatgtttaaaccatgaatgcaacaggtctaacttatatttcactttgctgctcatttacagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggtaattcagtacgatctgatttgcccaatctgatgttttcattgctgtgttgttcccagcacatgtttggggtgcacgcaatctcagaatgtgtccacatatcctctgagattcactttgtttccttctcagtttaccccttttccgttctaagtaaactgtttcagatactagaaagactaggttttggagacacacagacctaggtttgagtcctggctttacaacctagtaattaaatggcattggcagtttcctggtctttctgagactgagtttcctcatctgtgaagtggagataatcacactgacctcagtggatagtcatgactacagaataaagcttggcacatcttgggcacccttctcctaattaaggagagttccctcagtgacctggtgcaaagaagctgctgtggagaaaggaacaaaatctctgggctagagtttcctaacgatgttcatgttgctctagagatgcatagttacgtgttcccaagtccagcctcttacaagctgaagcgtgggctgtggttttcaagtttcatcctccttttttttttttcttcttaccatgtcacagactgtctctaatgagagttgaaatctatggggcaattgtaagtagaagagcctttcattctaggctatactctttgctgttgtaagaaaaccagatcctttctctgtacaccaaaatgactggttagaaattaacaaacatcaggtattttacctaccttaggccagataattggtcttattgattcttttttttttttttttttttttttttgagaggagttttgctcttgtcacccaggctggagtgcagtgtcaccatgtcggctcactgcaacctccacctcccgggttcaaacgattctcctgcctcagcctcccgagtagctgggattataggagcccaccaccccaaaccaggctaatttttgtatttttagtagggacaggatttcaccatgttggccaggctgatctcaaactcctgatctcaggtgattcacctgtatttggttcccaaagtgttgggattacaggcgtgagccactgtgcccggccgtaaaatcattgtaaaaacaaaacaacaaattcaggtgtctgatttcatgtgcccccagcctcttaggtttggaacattatctagttagtacagtgttttatgtctgtagtctcagtgatcgccccatgatctcatggattccaaataattcaggtagctttgaggtcacttaacagatggcaaatgtcttttcactctagcttctttaacaccatataacaaagattatgagaggttactgtagcttgaggggaacttatttaagcttatagaagtatagttaaaattatattgctgaaaagacacttctattgttgtcaaacttcaatgtgtctccttttcgttgcaatattacttagacatacaggaaaattaaagcccactatgatagccctgtaggtaagttcacaattctctgtcagcctaggaaactgaagaagccaacactagttctatagagccaaattttatctcaaactctacttcccagtggatgactttctcttgattaatccgtcatattctgccaagtaacagtggttacccattggttcctatcacttactaaatatgttccaaaattttcaaatgtataaatgtgttcatttggcataacaaacatactaaagtgtttggataggtttaagaaattgaaatctactcagcaagacagcccctggttggctttctgtttgcttttctttatcgtaatgccatcattgttgcttctttccctttaaatatatagtaaatggtgttaaactatttagcacatccaggcagacattatttggtaagaggggcttctttcttttttgtttatattcccaggccgaacatcagggtctttactgtattttaggtagcatcatctagttcaggtgttgcatataatacggctttaagggattatttccgcttaaaagtttaattcaagattttgtgaaatttttttttaaaaagaatttgttttacaatcaaggaaagaagagtgaaaatgggattgaattggaaacttttcaaaaattgtttaaaaattggtatgccgtgcccaatttaaatatttcataagttgcgatgggcctatccttatgtaagggccacatagtttgagaaaacacaaagcagagagcctagcactttagaagtcttgcagatgttaaatttcccatcttaaagagtttacaatccagttaaaaaaacaacttggcattcaaagaaatgggttcaaattcctattttgctacatttgctgtgtatggtagcaagtttagtctgtcagtctaattggacaatgatccctgtgcctgagtggttttgaagaaaattgaaataatgtatgtaaaaacacctaccctgtacctgacataccataattaggtaaacaataaatggccatgaaatatgaaaaaaataggtatgccaagtgttaatcctaccccttctgaatagagcagaaagtagtctgttcccttaagaaaagttttaggttaatctgataggcttatttgccctactttccatggttatgaggagtcatgcatttcattacacacttttgcataaatcatgagggaacaaacaataggttctcatgtcggtctgcagctccttctcatgaagtacctggagttctccttgcccactgcagccagggcatagtatctgctggtctggtcaaatctgacttctcctgcttcctgtatgttccatgatacacactactagtgcatgaagccgtggcattccccttccttgcttcagggtcctaattaagaagttcttcatctctgttcagaatttattctaaagaccacatttttaatccattcacttcatggaaaaattagcttccttccaatttgttctacaagctcctgactatgagcttcaggagaatgggggcagtgtttatcgccaccttatctcccagctgctaccatatagaaggtactcaacaataagtaaacgattgctgattagcaggaatactggtcagtttctagctcaagtgttacgtgcttatgttttcagtgtggtgcatctctcagtgggattcgccttctcttcatgctgtggcaatgggagggggttttgaacttctttgatgagaagagagacttcctgcttggagtcctccctgaagcagatattcattgagtagcctcatgctgcttcctttgaaaccccataaatgcccctttatcatgggtattgttaaatactttgtgcctaactcacagcacctattaagtatgtgtcccttttgtactgtgttgacccaaattctttcttcaaggatcatctcaactgatgggactaaatccactggttttactcttcaacatctaagttaaattttttttgagcagagagttaggaaatttcaaatttctccttgtctttcttttaaatatggtgcccaaatttatgacaactggccagccagtcactttacctgaagcaagacagaagacacttcattcattcttattaccagcattcattcctatcaacagccagttagcaaagcaagaagctgcacatcccaatgcttttgagtttctttccaagtctgttaaatccagagaattagccctgataggaattacaagggagacaattacagataatttattcggttcagtcattcattttgtggaaggttttagtccctaacccaactttcacagagaccatatctcttttttacattgtaagcaataataaagaaaatgagttttccacttcctacgtatgtctcctgggttttgttttataaaataacttttattgctgtttttattatatacataatacatgtttattgtttaaaatagaaaatacacataagcaatgggaagaaaataaaaatcacacataatcccaccatagaaagttaactactattaacacttgctgcatttgctgagtatctactgtcacccttttaatatgcctttatgatttgttaaataaaattgtatgctattctttatataaattttttaataaaaaaatatgtatcacagatagcttcctatgtcatcaaatattgtcataaaatgtaattttgatggttgcatagattcctttttatggatgtaatttatgtgccttattttaatattctttttattggtagattgaaaaagtcctgcagcagggagagattggagactgtgcagagccctacacggttatcaaagaaagtgatggtggaaaggtatggtaatttgagtgttgttaaatggagacatcttagaagaagcaggtattttcagaagtgttacacaaatagttaatgggctttagtccctaatgtgtccctatataagacactactacattttaattaaataaaagaggaaaagaaaactggtcaccgatgatgactttttttttttttttttttttttttttgaggcagtgtcttactttatctcccaggctggagtgctggagtgcaatcacggccccctacaaccttgaactcctgggcttgaatgatcctcccccttcagcctcttgagcagctggtactacaggcacatgccaccatgcttggctagttttttatttttttttagagatggggtctcactgtgttgcccaggctgctctcataattctggcctcaagtgattctcctgcctcagcctcccaaagtgttgggattacaggcatgagtcaccatgcccagcctgatgatgattttttagagaaataaatccttgaattttctaatgttgacatacagcaaggtctgactgcataacttgattggggcaaggccaccccctgttgtcttcattctgaggctctgactcagctggttgggaggtccgtggagaccccaaaactaaacagtgccagagctctcctggccttcctcaacagcatgggccgctgccctttcaggtatgcaaataactgggaattggctgccactaccatgcattatatatattcattagcacagcataggtgttgagcctatgaaaaggatatcttttctcaacagcaatttgcaaagattcccagtgtgatttttaaaacatggccttggccgggcgtggtggctcacacctgtaatcccagcactttgggaggccaaggcgggcagatcatgaggtcagaagattgagaccatcctggccaacacggtgaaaccccgtctctgctaaaaatacaaaaaattagccgggcatggtggcacgtgcctgtattcccagcttctcaggaggctgaggcaggagaatagcttgaacctgggaggcggaggttgcagtgagccgagatcgtgccactgcactccagcctgggtgacagagtgagactctgtctcaaaaaaaaaaaaaaatagcctttctggaataagacttaccttattagtattgtactctacagactcataaatgtcaagtaagatttattgaactcaaggcattttttttttaaaatctgtcttttattctgaactcagaaagaacaccttggaagtattgtaaacttcctaaggagttgttaggaagctttttagaattttttggagttttccaaggtgacttttggagaaacaggttcacttgggagcttggtagatgatatactaaacttgatttcaagattcttttatgcaaatccaagtcacatagctagccaccaaaagaattgataatctgatgtaatgagtctctttttgttttcgttagctaaaaatgtattttactaattaaatgtagcctttttgtaaactcctcgttttttaatctttatttccttatcagctagacccaagtgcatcatttttctgcctattcactgtttttattttttagtgggaagatatgtttttactctttttaatcagtagggtttggattttggagatggctgtcatattcaggtcagaggcagttgacttggtgctgatgcttgtttcagcttgtttctttccattttcctccagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttggtaagattttcacctgcagtgggaaagggagggctccccagtgtgcgctgcccaggtccacagcttactagcggggactgggggcacagtgaggtgtgggaagtggggaggcagaaggagataaatagaatgaaacactgttatgactggattacgtagatttggacggtgatctccaaaagaaattatcacgaacattggtgaagattaagtatactcttatagtaagattttctagatggtatgacactttaaaaagctgatttttgctagccacccgctctcaaaagtaaaactttaacaagaaaatgtagtaaccatctgtagtgtgttaagcagagacaccatggtcgactcctaaacctaaaaaaaaaagcctctgttacaaaggcttcaaaaagcaaaactcaacaggaacagggcgtggtggctcacgcttgtaatcccaccactttgggaggccgaggtaggcggatcgcttgaagccaggagttcgagaccagcctggccaacatggtaaaaccctgtctctactaaaaatacaaaaaatttgctgggtgtggtggtacacgtctgtaatctcagctactcgggaggcagaggcaggagaatcgcttgaaccagggaggcgaggttacagtgagccgagatcaggcctctgcactccagcctgggcaacagagcatgactttgtctcaaaaaaaaagaaaaaagagaaaaactcaagtttcccagcaaaatttccagttcgttaaagtttactttgccaagtgcaatgaaaaaatgggcatccaaagaatatttactgttttagtttatttagcatatttctttttcgtcatctcacccgtgatctgaatcattcattcctacactgcttggtgtagaaattttcaaaagggttgcaaattttcaagtagacctgcccatatcacctgtggtggggtttctctttccctaaatgcttttgtatccaccaaatatagaagtccatgttcacatcttttcatgcattccttaagctaaggcttaagccacttctgaaatactaccttgagcagggaagtggaggaaagggcattttgtgattgctgctgctattttggagttactggtacataatcaccagtcagaactcctgggttatttctggttcgtcaataacaaacctcactttaccacatcctgatcttcctgccacagctttctttaatgccgtctatgtagacccaagtaacttattgataagagttatgtatagagcttagagggcacacaagctaggtaattcaggatagggcatgctgaggcctcaatcatctctaggtcaaggataacctgacaacagagactgattcttaaggagcaaccagaagatgcaaagatgtcatgtattatactgaggcagaatggcaagtttaggtgggtagaggtagcaagaaattctaattcaacatcatggtaagaattaaggataagaagatactcaaagacgggttggaactgctctagttctaagcaatttgattatttacaagagaacccatgagtttttgcaatataaaagcaacaagatctccacccaaatcccaaaaggggataagaaacaactgggcaaactatcagggtcccagcccaagtctgagtgtgatttggggttctaattcccattgggcagatcacccaaggcagaaactcagtcttgctgcctggtccacataatgagagcagaggaatgctgggattcagagtgtacacaggctgaccccagcatgtttgggtcacaatcacaaatgccttcaggggcatttgagtacatgcctctcccagtggaatgcaaatatagaaataaaagaaaagcaaacactgtgctgactaaataaagcttatcaggagaccctgttctggctatagctctggactcttgccgggtggcatttgggctaccctaatttccatgtgggaggggcccatggctgctcctggcctctctcctctggtcggaggaggattaaggacaccaacaggaggactaagaaaggtaggggccaatggaaggacattttcattcaaaacaaggatggccatattcagtgttcctgatcagtgactttaatcatacatattgtgaagttaataactgctgtgtgtttgaacagaaaggcatactttggagtgacaattgtttttcttaaagggagaagctcagtgggtgaacggaggacattggcccaatctagaaggctttctgaaagagccctctccttggaggaaaatggggttggatccaacttcaaaacctccactctgagcgttagcagctttttcaagcaggtatctcttcacattacagtgtgtctggatttttccccatactggcatgggcactggaacccacaggaggaggatacgtagtgattaagagagcaaattagttaagctcactctcttagttcattttctgctgcttataatagagtatctgaaactgggtaatttaaaaagaaaagggatttgtttctttcagttttgaaggctgaaaaatccaaagttgagggcccacccttggtgagggctttcttgctggcggggcctctctgtagagtcctgaggtggagcacggtgagcagctgagcatgctagctcaggtctctcttcctgttcttataaagccaccagttcccctcccatgatgcagattaatccattaatctgtgaatggattaatccagtcatgagggcagagtcctcatgattcaatcacgtcttaaaggctccacttcccaacactgccaccatggggaccaagcttcaccatgagttttgaaggggacattcaaaccacagcattcacaaagcctcaatttcattagccagaaaacgggaacaatagtacttaacttcatgtggctagcaggaaggtcaggtgacatgagacctgtcaagctcttcttagagtgcctggaatacagtaagtgctcaatgaatgttagctattttaactgagagaagggttaggttttgttccttgtgataccaactatcctatttgaactatcttggccaatccattcattatgctatgacaacagtctggctgggccatctccttcccggtggatctcagggtttcttggcctggctattcatgtgcaagtttccactttcactactgcttgatgtgcaagtttccagggctccctgcttgctcagagagggtgaccattccagatggtactctttgttagctcagtaaacatcaagactatttaaaaaaataaaaaacttcctagacttgtcaacggtatagagacagaaagtagaatgacggttgccagggtctagggatagaggggtggggagtcactggttaaagggtacagagtttcagattttttttgcaagacaaaagcattctggaggttggttgcacaacaaagagaatgtgcttaacactactgaattgtgcacttagaaacaggtaagatgggccgggcgcagtggctcatgcctgtaatcccagcactgggaggccgaggcaggtggattatgtgaggtcaggagttcaagaccagcctggccaacatggtgaacccccgtctctactaaaaatacaaaagttagccgggtgtggtggtgcacacctgtaatcccagctacttgggaggctgaggctggagaattgtttgaacctgggaggtggaggttgcagtgagccgagattgccccactgcactccagcctgggtgacagagtgaggctccatctcagaaaagaaaaaaaaaaagaggtaatatggtaattttatgttagttatattttgccacacttaaaataaactcgcttggtctgactctgttttggaaagttttccatagctacgcagtcttcgtggagcatttaaaggggttacattaacaaactgaaatgcaaaagggatgctgagggcgcctgtgcaccgtgccacatcatagaaatagtaaaggtctgaaaaggtttctattcagcatacatgtacccttcccaatcttatgaccttggaggacaaggtacttaactaagtctggatggtctcactgggaataagacatatctacccacttaccttactgggttgttgtaaggattggagatcatgcatgtgtgctcctgacccatcttgggcatatgtgggggtggacagcatttatacttaaccttgttcgagacaaatgtgaagaaaatgagatggaaagatgctttctccaccttcgaacatttgaagaagaaagtaaacttattctgtattgttccggggggtaatactggcatcagagggtgagagttatcggggggaagcttttggcctggttttctaatggtcagacgggcttccttagaatgcagcagatgccccatccccagaaggactgataagaggccgaggcacagtgagtcacagtgattgagaaggatttaacaagaagtggagctcagtgatttcagagctgtctataatcctaatttctatgaaagacttgtgagaataaaacttaaaggtaaaaatcttcccagaaatcgtttgtccccaacccaagagtcaaaggtgcatctacattaactctgacttttctcttggcaggaaggagatcgccttagcgatgaagacttattcaagtttttagctgactacaaaagatcatcatccttacagagacgagtcaagtcaattccaggtgtgaatgacttatctttatcctctttagctgtgccaaaactgcttatcgttagacacagtctttgtctaatgccagaatttataaaatcatgtttgccaagtgaaatgtgagattttgtgttaggggttaagaatctgaattgttctatgtctttggcaaacctattaatgtttttttaattttcttaaaggattgatttagtaaacaaaccttgtgctttagatctggtttctcagataatgagataattgtttaaacagaggagcccctttaatcaaataaaatattatacttagtattaaaaaagtaaatgtgagatgctttggtagaaggcaaaggcatcttccttatcctcactcggcagccctggaggtacttctgtagcatcctcaggtccagggaagccagtttgtgtttgtttttgtttttttgagatggagtcttgctctgtcaccaggctggagtgcagtggcacaatctcagctcactgcaacctctgccttccaggttcaagtgattctcctgcctcaacctcccgagtagctgggactacaggtgcctgccaccacgcccagcttattttttgtatttttagtagagacagggtttcaccatgttggccaggattgtctcgatctcttgacctcgtgatccacctgcctcggcctcccagagtgctgagatgacaggcgtgagccaccacatccggctggaagccaattttaaaactcccaatttttactgctagcaatgcagggaagttacttaacaatgtaaaattatactgtggtaattcaggaaagaactttaaaaatcctctaatccattccttctcattttacaatttcttgctttatattttattttatagaggctaaatctcgaaagttatcatgacacacttttctcaagctgtaggaaattagctccaaaacttttttacagtactatagtttgttcttattttcatgaaagaaacacagtgcaacaatctttcttgattccctcataacatgacagtttctttactagaacattcctattttctctctttaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaaccgtaggtgattgccaaatctctttctaaacatagtttacctaattctctttaacaagaaagggttacttcagatgtaattgtagtttaggattatagtggacatatgttttccagagattaaaaaaaaaatctgctagccattacctttgttctcctctgtgcagagggacatattagaaaaagagcaatgtgaccaaaatgtgctagttgtcaaaaggacaggttttcagctaaagattagctctttccaacagaatttacagcaataacataataatagcacacattccaatagcatttacagcaataacagaaagttctgtatgtgtgccagcagtacaatagccactaatcacatgtagctgttcagcatttgaaatgtggccagtgcaatggaggaactgaaaaattgattttaattaattttaatttaaagtcaagtaactgtatgtgtctactatattggagagtatggagctagacactgaaggcctaacaggttgggctgccttggtttctgaatcgcttatggtggcacctgacctattccatggggtctggaaggagtgcttgtcaacacatatctgccaaaggcattaatgctcatgcacttctttattttgagactatttcctttaatgcagaaaaggatgccttctataaaaatcatctcttccccaccatccagaaatgacattgttgttttctgtgtttttatataaaagaaatacagtggtactgattcagttgaagtcttcttttatccccagtctccagtcacagacttttacctcacctcctagacttttatcatcatgaaattatgtatttcctattttttctccttttacacacacttacacacacatctgtgaacgctcaatggcattatcttcatattcatttaaaatgtacgcaaatgacttcacactctaggtcaggggtccccaacccccgggccatagaccattactggtccttggcctgttaggaaccaggctgcatggcaggaggtgagcatcgggtgagtgaagcttcatttacagccactccccattgctggcattaccacctgagctcctcctcctgtcagatcagcagtgacattagattctcatgggagcatgaatcctattgtgaactgcatatatgaggcatctaggttgtgcgctccttatgagaatctaatgcctgatattctgtcgctgtctgccatcactttcagatgggaccctctaattgcaggaaaacaagctcagggctcctactgattctatattattgtgagttatataattatttcattatatattgcaatgtaataataatagaaataaagtgcacgataaatggaatgtgcttgagtcatcccaaaaccatcccctgccccccgctgccaccccagtccatggaaaaattgtcttccatgaaaccagtccctggtgccaaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcatttttggaaatatcagtattgattcatgtaaaggtttgtgggtttttttggggtttttttcgtttttttgtttttttttgagatggagtctcactctgtcacccaggctggagtgcagtgacatgatctcggttcactgcaacctccgcctcacaggttcaaacgattctcctgactcagctgcccgagtagctgggactacaggtgcctgccaccacacccagttaatttttgtatttttggtagagacagggtttcaccatcttggccaggctggtcttgaactcctgacctcgtgatccacctgcctcggcctcccaaagtgctgggattacaggtgtgagccaccatgcccatcctgttattccttttaactgctgtttagtattcctttgtgaagaggccatattttattcatttccttgttgatacgcatttaagtctttttcaagttttcagctcttacaaacactatgaagtaagattttttgtctttgcccctctgtacacgtttgtgaaagtttctttaatatatctaaaagtgaaattaccagatcacaagtaatacacatttcagtcttaagttttctaaaattttacatttgcagtcctaacagcagtgtgagagaattcccattttccagttcctcacccatactttccagtatgacgtatgtgggactaaaatgcaaagaacttcagagctcacctgatccaagcattcccacccccacatttccagatgcacaaaattaagacccggaaaggataagtgaatggttccttgaggtcaaaaattacagcgaggtggccagacacagtggctcacactgtaaccccgctgctttgggaggctggaggactgcttgagtctaggagtttaagatcagcccgggcaacatagtgagacccccatctctacaaaacattttaaaaattgcccaggtgtggtattgtgcatccctgtagttctagctacccagaaggctgaggcagaggattcttgagcccagaaattcgaggttagccttgtgccactgctctccaaatcaagcaacagagtgagaccctatctctaaaaaaaaaaaaataatttagaaaataaaattatactgagaaatacaaacagctattcacacaggaatggagagttcttctttacagtattcaggaggtatacacttatttccccatttaatccttcctggagcagctcttcattttcaatcctcattccttacatctaaacttagtccccacgtctccctcctagaggagataagcattctcaggatgcagtagtttcgattctctattccttagaggaagatgaaggcatgaaaatgtttgcttatggatgctttgtatctttttagaaactttatcctataatcgggaaacaatgcttgtggcattggaagagacttgcatccaatgaattctgtagttattcaacttcccctcagcatttaatcacccacaggtggcatttacaatgttctctactcgttcctgcaaacattatcccttaattacatcacagtgggacttagagtgcattagtgcactgaatgatccagaaatgtaggagggcaaaggaggacaagtctggacggattacaatggacccaacttgtcatcatgagaaacagacccacaaatacagagttaatcttcttgagctgtactggccactgtagaagtgccaaggacaccccgttagaaatgccaaggccaccctgttagaaaccaggtcttggggaatgacagaagagatttctctccagtttggttgtggccccttctcttggctcacagttcttctctgtggctctcaggccaccatattttatagtctatttaaggaaagagagagataatgaacttggtttggaatcttacttcatgaaaatttcacagaatttaggaagcatcttgtctaaatatcttgttctaaatttttagtgttcttctccagtccttgtgtgctttagggtggttttgattagattgggcttgacagttacccagtcccagatgagtgtcccctttcctgcacctccccccattcacgacatggaaatggaaagaatcgagtgaggtctgaaccccaggtaaaattggcaagctgactaagttcgccttgggtgacctcaccttttcatttctgtccattttcctctctttttgttccttgccatctccccatatctcaaaaaacctggaccttgtagcttttctatactggcccccaaaataaaagtctcttttcaagcaacgatctctaaactcatttgctatggtattgataacaggtatggattagtcttatcactcccaagagtattatcattttgggccaggtgtggtggctcacacctataatcctagcgctttcggaggccaaggcaggtgaatcacctgagtgaggtcaagagttcgagaccagcctggccaacacggtgaccccttgtctctactaaaaatacaaaaagtaactgggcgtggtggtgggtgcctgtaatcccagctactcaggaggctgaggcgggagaatcgcttgaacccaggaggcagaggttgcagtgagctgagatcctgccattgcactccagcctgggcaacagagcaaaaaaactctgtctcaaaaaaaaggtattatcttggcagggacagcagttcctatttcttaattgaagaaatccagatttcttctcattccaagagtctgtcaggtaactttcactgttgatgttgctatttccatgccaatcaataatcctgatcatacctgtatcccttaaggaaatcaaataactgaaaatgaagatctgtggggcagataaattcaggaatatttcttcgtttatagaggattcacctcatgaatttgaaatatggcttggcttataaaaagttgatctgcctggagcttgtagctaacacctctgtcgggccaaacaataaatgcttacactgagaaagccaggtttgggatttcaaattaatgtgcccttaacataaactgcagagcccccctgggtggagggaactattacctggttctaatagcagatgttttctggccttgagtgccagtggtaaccagagtcacacattttaggattttggtattgatgagggtttcagctgaatattacttgagttgaactccagttatctttacctgtcttaaaggagcagctgccatagtgcctcaggtaaagttggcttgggataggctggcattgccttccagtccccagcctcaccttcctcccacctcttcactgcctcttttctttgccctgccccttcaggtgtcctgcgtggggcaccattcgagttgcattctagtgtattaggttggtgcaaaagtaattgcggtaatgtgtgtgtgctgccccgtgtctctaccttattcaagtttctttaaggaacagctgtagatgagttctggtagaactgggtagtgctcccagaagtatccccgtgggtccgtgagggttgggcattcataaaataaatccttgctctaacgatagagaccaacttctagagccagaagtgctcatcccaggaatgaccaggggctcccaaaccagcggctcgggccctctgcagtgccatgtgcagcctctgtgggttagaggcatggagctagagcagggtcctctgaaccagagccaggcaggacactctgagaaatcacaagcagaaggacagcaattctgaaagcagagcagaacagctggaaaaactgagctgatgaaaaggattatccgaatccaagcttggcgttccttgctctgtgtccagattaagaaaatgctagtggtttgcctaggaacacatttgcaccaactcctggcttattttccatgtgacccaacagctggtactagagacaccagctgctttctggtgggggcagaatgaaaacagcatgggctgaggccaaggcccagcaaggtcttcaagggcatcctatcctgcggccgccagaggggtatgtgcggagatcacaggcaatgaggttgtaatgagctgttaagctccctgccgtccctttaatgggtgattacagtaaaaagagccacataaagtacgttttcatctctcacttcagcccccgagagcctctgaggtcttgtttatccaattatcagacttgctgtggaggacggtgcttgctgagaacaagcatatcagttggaacatgatttctctgatggataattagctgttttcaggactcctcctattcagctgaatgttctcagaccagaagtctgatctggcctaacggggatgtgctcccatatcgcagtggagtcttaaggagtactacccaccttctcttctgcgggggaaaaggaatggcgtagcatgcatgcaggacctgaccggaaggaatgtctgcgagttatgatttagtgactagaacttctaaggaaagaaatgaaccagaaataactgcaaacgaagtggttaggaagaggggcaggacatggggagtatccttgaaagggacttaatttcatccaaggaaataggttcccagtttaagcccagttagctctgtattcagagtggatcttctcagtgctaggtgaaggaagggtggttgtgcatcagagtaagtgtccagccccaccctgaagactcccattcaggtggtctgggatggggcactggtggtctgacactctcttttgttcaaaatcaaagcgtccccctccttctcatggaagggaagcttccaccaacccttaatgagttcctgtaccatatggagttgtcaaatgctccataccgggcacagcggctcacacctgcaatcccagcactttgggaggccgaggcgggaggatccattgagcccaggagttcaagaccagcctaggcaacatagcaagaccctgtctctacaacaacaacaaaaaaattagccaggggtgggggtccacacctgcagtcccagttacttgtgaggctgaggtgggaggatcgcttgagccaggaaggtcgaggctacagtgagccgtgatcatgccactgccctccagcctgggcaacagagtgagactctttcaaaaaacaaaaacaaaaaactctgtcctaagtatcagatgatgcggaagcccagtacttggttttactaggcttagcaagcagtcgcttatggaacagaagcttttataaacaaaccatgtagttaggaagggcagtggcagcccaggcaaaatctagtcatttgaattagccaaggaacggagacaaagacaaagtgaatttctggtgctagttgcaacttggtctcgataataaatcaggaacacaatccccacattcctaatgccttgctccaaaactcagcaatcctcctatttgtaagaatgaaaaaattcaggagggaaccaattgcctaaggttatgacagcaaagctaccgttccagtataatattcagccactagaggacacaattcactcactttctagattcagacacacgactacctttttcgttacaaaacatatgaagtcgtgatttatgaaagtaggacacatattgtattttttgcccttgaagtgcaagaccaggaaaaactgaaaagtattgcagcatcctccgagatcactgttgtcattttttcgcaaaggattttattctagcctgtcagtttctgcctcctttcattagtaagtcctgaccttagacatctggcatttttttggaaggtgtagtggggagggggaccaagagatgcatcccttaatgtagctaaagatcgaaatcttctcattttggggagagttgcttactatacatatttacacattcaccaattttgtctcatatgtaaaccacagaatgtgccgaattttcctagaatcatggttgaggcaggtaggagtaaggaggtgctgtgtacattagtgtcactgattccaccgttcacaactccataccactctccttattttatactcttgagtccacagtgctttggtgttacagcccatatagaacggtcctacctaaaagtcctgcggtcggtttaacagtgacgagtgtcatttttccactgtcctttacatagaattcagcaggaagcttcatgaggcaccctgtttctacatgagttgccctggttggtggaggcagaagcaatggagaagtggtgatgaaattaagtcaaagttaggcttgcatttgactctgatcttgaatagtttgtctagattagagggagcacctaaaatccaaaaagccttttgtctttgatttctatacttttgttagttttacaaattattatttaaaatcagtcctttgaagtggcttcttctcttctgacgggacagctttgggaaactgtttagtcttatttcttttgctattgggaagttgtgggggacgctattttgcagctttttcatcctcagttctgacctcctcatgtgctttacagatgcccccaaaggtcagcattcatccacctttcactgagagtgtttggccatctctaaagcagaggtattttaacagctctccttaatggatgtcctgtggtttcaggcctcagacaggctgcccttgggccctcagcagaagtcgggaatcgtcttatacttccagatcgtcttttactcaggcaaaatatgagatgctgtgtcagggtttcccaagggaagaaactgagtgggaggtgcaggtaaaccccacagtacaaaataaaacagagctgtgagtagttgaaaggactgtgttttgacagcgtaataaggtaattgtttaaaaccatggctaattcatcagatgtcatgtgtcttttatagttaaaagatgaaatttctttacccactggtgtcaacaacagaaagattctaaaactttcaaaaaatgtgccagtcctggctgctttgtttcatgttctttgacaactttcaaaatgtaaattgagattcatgcaactattaatggaaatataaatatcatggcttcataaggataaaattagaggagctcaacataacggctcattttaatgatttctaaggggtttccatgcccaggctaataactgtacatttagcaataagcaaatctcaaagcctatttcttatctttccctagaattacagcttttaagcccaagctggtcgttccttttataccactccactcacttgataggggtgacatgggctgagctttctctcctatcagggctcaaagacaagtttagcagcgtttctaaacttctgtcaatcagctcacaggacacagaccagtttcgttatcccattaacagatttacatttctgttctctggaagtgtcagttaatgtccttaaaggtaatatacacaaatgtacacaatagtctctgaatttttctcagaagacacactcagaaaccttagaattctgattcattctctttggctcagacttggatgaatttgcttctcagagtagggacatgaaaattattcttaatttatacttcatgtaatctgtttcttctttctccctccgccgccctccaatagctcttctgagcttgtttgttcttcccctaactcccattgttgaaaacatggcctcccctcattctcacctttccaggaatctccttgtgctcctcaagttcggctcatcgcaaacttggagttctgttttctcatgcccttctttcattttcttcttttaagagacaggatcttgctctgtctccaagattggagtgcagtggtacgattctagctcactgcagcctcaaactgctgggcttaagtgatcctcccaactcagcctcccaagaagctaggaccactgctgtgtgtcaccacaccagctaattattttatcttttctagagacaaggtctcactctgttgcccaggctggtcttgaactcctagcctcaagcaatcttcctacctcagcttcccaaagcactgggaggtgccactcttcttgtgttttttacctttgcatttatttcctggttacaatacttttaacttaatggctgctgaactagattctgccaatgtacgtgccgtccaggacacgttcatgccactttaattttcttagaacatcaatgagatagtcttactagggagagataaagggcaggggtttggttttctggcaggttttctttcattttaataacgagccaacccacggaggaaggaattgattgatggctgcttcctcttttgtaaagaacaaacatcaaattagtggtttgtcctcactttgcggataagcagaataataacacctgtgcctctccctgcattattttgaaactaatataattttgtttggacagaacgtagatagcaaccttaatggggaggaatgtggaagaggaattactgaagggggaccagtcagcctgtcaggcagcaactctggtgccaaagaatggacataggatcagagctgtggacccccgtcctgtttgtaaacttcctgagggtggcagagattcataccctttctcccatcaggacaaaaatcagtgtgttggagctcactcaggaaatgctctttgggattggcatgggaaggggatgaggccgattgacaattagcctagttcactgggattttgttgtaggagctgggtggtggcaccatatggccaacaggggatgccagcgacatccctaatttctctggcttcctgataggtcctggtagggtcggggttccaccgggatttgcctagtatggtctacctctgactgaaattaaactctaagtaggtaactggggaacgcctttctccagagagaaggttttgatgtgatctcatcatcggggactggattggacctggagaaatcagtttttctatagtcttgtttctagagtggcaccctggtcttgggcaggtcagaaggacagatagttggtcaccatcttcaacacaaatcatggctggaaaagggccccagtagggagtgcctttctcactcaccaatcaccaaggctagaagatagtctgcagattctttcagatgccacaaagctgtgattacagctgcccattggcaaatcaggtactagtttttgttaatcacattgcagtcttccttcactgtttcttcccctggtcccggaattaaggctgggctccatttgacaagttatcttctgtgcaggtagagcagcaggctgtgttagctcacagcatctactcagtaggcatggaaatatccactgaatgggactgagaaagtggaatgggaggggaacgtgtgaagaacaggaagtttgcctctttatgtccaaagtctgtctacttagagcaacaggatggtgatgatgctttctggttaaagatgtcatggcaacagtcttccctagacagctctctagcaatagccagtggcatgtaaaccctgcatttttgcactgtatccagtgtttgcaactcccttgtagaactttccctgaagtcagcaagaaccctgtgagaatcaggatttgtctagaaatttagcatttacctaatcaatgattctctagacatgtcagtacctccaagtgattcatatgcatgtttggtgggcgtcgagcatgtggcagtttggagaaggaagtggagaatgcagcagcagcaggagaaatgtttgatgttgctaaacatcaaccccacagcaagcctagaactcggggaatgggaggcatggtgcgggtagctgctgacacacagctctagagatagctgcctgcaaagctggatgggactccaggcaataggcttcagggcctaactgctctttcaaggtcactgattgttacaggagccatggtctgcagcattgagcatggaattattattactattaagcatgatcctcaccgtgatgctcttggggtggaacaaaagagcccagagagaatatgcttattttatgcaacctctaacgtttcctcccagagttgtgatgaaactgaaccaaactctagcatgagaatcggcatcccaggccagcagccaaaacaagtggtgacacttggccaggcacggtggctcatgcctgtaatccctgcactttgggaggccgaggcgggtggatcacaaggtcaggagtttgaaaccagcctggccaacatagtgaaaccccatctctactaaaaatacaaaaaattagctgggcgtggtggcgggcacctgtaatcccagctacttgggaggctggggcaggagaatcgcttgaacttggaggtggaggttgcagtgagccaagatcgcgccactgcactccagtccagtgacagtgtgagactctgtctcaaaaaaaaagtgccgatactttatatatcttctgaaagaaatgaagtctgtaagaaggactgttaaccctcagaatggtctggggatgctacatccccttgtggacttgtcacactggtatgagtgtagggagtgggaacacttcttctcagctccttcctcaccatgtgtcattcagggacaaagggagcaggatatcttccctttgaaaaatctcatatgcctggcaatactcgtcaccctgtgaataatgttgatgcattcacctaaccagtattataagcccctgctgtgtgtcagacactatgcttggtgctgaaatagacaaggaggggactgcctgtcttggaaggcaaatcccagtctcctaagagacactagaaccacaggcaaccatgctgatctatgcaatgacatgtaatgcaactttgtcctgcaaccaccttgagatctttgaaagttctcctacctccaaaactcagacaagtcctctctcttgccaagtgcctaaagcaaggatatgtttatagaggcagctgggggcatctggccaatttatttcccagcagacctgctgcttcccctgattccaatactttcttccccaacccaaaccaaggcgtctggcaatgttaaaaacatcaagaatgataaaacaagcattttaatgaagattattgatgtattcattggctgtttctttaaatgggtagagaactaataaaggatctaccccaaataaccaaaaatatcagcctcagcaccagcagaaattggaagcgttctggtatttatatgtgtttttctcagctggcagatttgttttaggaaactatttgcaaagcctgggaaaaatgtgctttctctgtctgttaaaggaacatgcaggttggttggtgctggttctccatctgacagttctgtctggtggcctcaaaaaaaaagaaaaatacagcatagtccagatttggactatgcaaatggtgtcttgaaacttaacttttaggtcttgagcaaagccaagtattattgaaatgtttattttgtttttatctgcaggaggttttcattcaaaatgtggtgctttgggggaaaaggaagggtgtttgtactaggtactttttagcattcttcttattatctgacctatcacagcctcttcaggagacattaattaatttagttcatataatcaacactggaaccaaggaaaaattatttatacttttagaaattctcatgttcttatacttctttggagattgaattgactccaaagagactattttgtgattaagaatatttttgtggccgggcacggtggctcacgcctgtaatcccagcactttgggaggccaaggcaggtggatcacctgaggccaggagttcaagactagtctggacaacttggcaaaaccctgtctttactaaaaatactaaacttagccagccgtggtgacgggcgcctgtagtcccagctactcgggaggctgaggcaggagaatcacttgaacccgagaggtggaggttgcagtgggccgagatcacagcattccactccagcctgggaagaatatttttgtgtggggagtcgttatattatgtccttagaccaggaggtccaattgaggcagaaatttttgaagtaaaaccattttttttgaaggaaacacatatttaaatatcaaagaacactggacgtatacttttaaaaatttacatacttgtgttagttatctattgctgtataacaaaacctttgcagctcaaaacaacagtcattatctcacaagtttatgtaggttacgcaggtgcagctgacctgcttggtctgagctttcgaaaagtgcagtgaggatgtcagcctaggctgccgtcacctcaagggtcccctgggggtggatccacttccaagctcactcatgtggctgttggcaggatgcagttgctcacgggttgttaggctgagggcgtcggttcctcactaagccagaggcttccttaagttccttaacatgttttctcatggggggcagctcacagtgtagcaattggcttcgtcaaaacaagcaagcgggagggtaagagacagaaagcaagacagaggccagggtctttcacagcctaatctcaagagcagtacctcatcacttttgtcctattttgacaaacgtcgtattgacttttgtcactacatcagaagcgagtcactaggtctagcccacactcaaagggagaggatttcacagagcaagaatatcaggaagcagaatcattggttatttcattagaagctgctggcacagttcttaatgaagctacaaaacattgaactgggaggaatatgggggtaggagggtgacagggagggcaggttaattttgtggatgctgaggacaacgtgcctcatgaaaagtgttcccatcagactggtgtatttctgtttcttttcttttttttttttttttttttttttttttttgagacagagtctcgctctgtcaccaggctggagtgcagtggcacaatctcagctcactgcaacctccgccttcctggtacaagcgattcccctgccttagcctcctgaatagctgggattacaggcatgtgccaccacgcccagcttattttttgtattttagtagagactgggtttcaccttgttggccaggatggtctcagtctcctgaccctgtgatctacccaccttggcctcccaaagtgctgggattacaggcatgagccaccgtgcccagcccagaatggtgtatttctaggacatctgcaatgcatcactctctaataaaagaaaaaaaaatagccactccttgacagatactcaaaggtgtggagtcccttactaaaccacactccaaagaaataagcctgcaaaatagggaaaagttgttttttacctagaaagcagattctctgcattttcttattttcaaatagtggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaaggtgagatttgcaggctgtctgaaatgtttcttgctaaagtagttccaatccttcccccatttagaaaaaaatacattcttagtaaatgactttcaggcagaaaaagaaaaccacactggaaataggattctaataaaccaacatggggctctagctggtgaacatatttctgagccatccctatacagaaaccacaagacaaataagaaaaagtaaatccagatcacttagacccttcaaaccacatcctgggttccaaggacagtggctgcgagttaggaaagatacatttatccagtggaccttttgactgtcttgtcaatcttaagaaaaaaatgtagagtaaaaaattttggctgggcgtggtggctcacgcctgtaatcccagcactttgggagaccgaggcgggcggatcacgaggtcaggagattgagaccatcctggctaacacagtgaaaccccgtctctactaaaaatacaaaaaaaactagccaggcgtggtagcaggcgcctgtaatcccagctactccggaggctgaggcaggagaatagcgtgaacccaggaggcagagcttgcagcgaggcgagattgcaccactgcactccagcctgggctacagagcgagactctgtctcaaaaaaaaaaaaaaaagaaaaaatttggtttgggtcccttcccaccttcccttgcttcatcactttccttaagcctctaagcatccagatcttccccaaagcagtgcttcctagtcagtgattaccctatcctctttttattccttttcttcatgcacaccttcagtccataaatccaagctttttgtaaggagggagggtgagtaaaccaattcatactaaggtgagagtgaattatatataaacctcttaatatattaaatctaccaagcagtgtttcagaaggaaatctgctaacatgggcatcttacttgaaaaaaatttcagttggttcaacaaagtatggtttagaaatcattttcaatcaggatcggggagagaatttttttttttcttaaagcagttaggtttccccagcagatttcgaatgcttggatatttgtgattcttttctatgggaatctgatctggataagacctaagaccataaacactctagctttccctttgggtctttgctattgaaaactagttggacttaaacaagtgaagtgggttttaaggatggctcctttcacccatttctaaaagatagcattcttgagggtctgctttatttagcagaaggaatgctggttttccaatctctcactcaaaaggaacttttacttatctcatagaaaagaatgggatggagattaatgtaatagaaaaggtattctacaaatatcatagcagctatatttaatcaattcatgttcaaagatcaattagtagtaataagagttgtgctgtataaaatcaccatatctcatattcaaattgcagatcatcagttgaaaaagcatggattgttttctcactgaaagaaatctttaaaagtggtaccataagagacattaagactggctattgttttatttctctctctctctctttctctttctctctttctgtcatttgatttctgactttcagtggatttttttaacattacaaaatcatagagaaagaatattggaccatttattgtagagtttttaaacaatttgataccattttttttttctggcgtcttaactgcatttgctgtttgtgaggggtgtagaggtccctgatgttcagagtacagtaccagcgtttatgtgaaatattgcagcctggcctgtggaggacaggggttactaaggggcaagctgctgcttgcgataacacccccagtgcctccttctaatcttgcgccatttcccagggcagacagccttgtggggctctgactggtgccctggaacatgttttaccttccatttttcttgctctgatttctgaagacagaatgttctcttcaacctacacatcaggagttttccttctgttttcctttttcactggttcctttgtgaatttgcacttttatctaacctaaaacattggaaacaggaataaacacaaataatggcatgaggccgtggccacagaatgacaagacaggacacagcaaatgttttgggtttttttcacatttatgaaccttctcattctatttatttatttatttacttacttatttcttgagacagggtctcattctgtcacccaggctggagtgcagtggcatgatcatagctcactgcagccttgaactcctggactcaagtgatcttccagcctcagccttctgagtagctgggattacaggcatacaccaccatgcctggctaataaaaaaaaaattctgttgtacagatggggtctcactatgttccccaggctaggctagtctcgaactcctggcctcaaacagtcctcctgccttgacctcccaaagtgctgggattataggcctgagccactgtgctcaactgcttcccattctaaaaagtgtctaaggcagttatagaggttatataacaaggtataaaatttctgagtgaaaggaaaataaggagagagaaataaatctaagtgtgtgtaaggttaatatgtacacagaatgtttattaaggcctttgacagttcctttaaaaattacctgcaggccaggtgcggtggctcatgcctgtaatcccaacagtttgggaggccgaggtgggcggatcacttgaggtcaggagttcaagacaaacctggccaacatggtgaaaccctgtctctactaaaaatacaaaaattagccaggtgtggtggcatgtgcctgtagtcccagctacttgggaggctgaggcaggagaatcgcttgagcccagaaagtggaggttgcagtgaactgagatcacgccattgcactccagcctgggtgacagagggagactccatctcaaagagaaacaaacaacaacaacaacaaaacctgcaaatttgagctgcctagcagccaagcaataaagggaatcacaatgaacgataagattcatatatctgccaatttaaaaacaaaccagttctcttgggtcagtgcttctcaaacttgaatgtacatttgagacacctggtgcattgttaaaatgtaggttctcatctagcaggtccatggtgcatttctaactggctcccaggcaatgctatgctgatgctgatgctgacgctgacgttgatgctgctactcattggactgccctttgagtagtaaaattttagctcactcagaaaaacctcatagtttatttggagtaacatccctttagcccttgtagatattataagactacattacaataaagttctggtgagtctaattgttgaccagagagattgtttacttcagagcacctggatttgaattgcagtgtgccacctgctgctgtgttacctggtacaagttaatgcattctcttcacacctcagttttatcatcttctgaatgaggctaatagtagtacctgtcatagatgcttgtaacagtgcctgcatagagtaagaatgaaataatgttagctattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaaccttttcctgtagtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagctttttatgtataaacctgtttcattggtgttgtatcagaattgcatgttgctagtagtttactatcaaaacaacacttgtgtttcaagctgttaaaaaatgaataaaataggccaagtatggtggctcacacctgtaatcccaacattttgggaggccgaggcgggcggatcacttgaggtcaggagttcgacaccagcctggccaacatggtgaaaccccatctctactaaaaatacaaaaattagccgggcctggtagcatgctcctgtagtcccagctactcaggaggccgaggcaggagaattgcttgatcttgggcagtggaggttgcagttagctgagatcatgccactgcactccagcctgggcaacagagcaagactccatctcaaaatttaaaaaaaaaaaaaaagaataaaatagaaacactgatttttctggtattttatacccttccccgaatatccatacccaaggcatttttaagatttccctaagctggaagcaccagaccacatgttatttaaaacatattaagatgtacctactgtattatgtatactttgtatatcattttataacagtctgcaaagtagcaggaaaaaatttttgccttcaggttaaactcagaagagttgccattggctaactgaaaaattttgcatttggtaagcatttaattaaaaatttattgatttcggttttgaggttttacttttcatatttttagagccaataacttctggaatctcagacatttttgtggaatcttaagttgttcatagatcctaggtgctgtgtttgtcatcctgagagcttaaatggccctgtccaaacctcagcctcagctcagagtaggaaattgtcaagcacttggtaactggtaagcaaatggattttagtcactaaatggagcgggaggaatggagtgctccctcaaaaagagcatttcagctggtcacagtggcttgggcttgtaatcctagcactttaggaggcccaggcatgaggaccacttgagcccaggagttcgagaccagcctgggtaacacaggaagatttcacctctacaaaaagtaaaactaaaaaattagccaggcattgtggtgccttgaatctgtagtcctagaaacttaggaggctgaagcagaggatcgcttgagcccagaaagttgaggctgcagtaagctgtgatcacgccacagcactccagcccaagcaacagagcatagactccatctccaaaaaaagaggctgtgacagaggaaggcagggggatgttaatcagagagacatagagactgggagagtctgaaagagaggcagagagacttacacaaattaaagacacagactgagagaaatggaaaaatgaagagaggatcccagacagattgattgacttcccaggtaacatataatatcttacaatcctgcagaatgtttaaagttgcattttaaaaggcactccgtttgttcacacaatcctggtaagaagatcatcttaattagtatcatactttgcagctttcaagcagttcttaggcatcattgcgtttaagacctggctccagccgttttattacagatgaggagattgacttgttcaccttacatttgtagagcattttgcaatttttttgaaggacatttccacccattatctaatcacaagtctccataaatcccatctcccctggtataaaagcagcttaaattacaggtgctactaagatgcaaaatgcagcccacaaaatcagcaaatattttttctttgtttcctccttttttaaaaaaggcgtagatttcatattactactttgtttcaggccgtatattgaagtaacaaaaataaaaccaaaattgacaccaattttatttcgaaataaaatctacttttttcactttcccacatcattttctagctgctaaccttcatgcatattcaatttttgcatatttacagccctgtcaaagataaaattttattttctgcattttcactcaacattatacactgagtattggccatttcactcatctcagtgccactttcaaagagatacccaggaaaagcagcagcaagggttgttcgaccttgaacaactacagataatactttggctctctttgagatttttaaggccctgtaagtaaaatattttcagattacagaaggcttgggattctgtctttatcacatgactgattggtcctccatgttctccttggcagatgtgggtatcagtgacacaatgttttttactcaaaacatggtttagcttaccagtaccaggaatggccgatgcatacgcattctcattgtgaaggtttatttgcacctccactcttcttaaccaggctattttcacagaagaaataaccccaacttcatgaaccctattcccatgacctatttgccaatctgttaaaataatggccaactcaaatgatcagtaatgattgactcaccatgacatcatccatcacctttgtcactggaagcccacttgccttaaagggtgcagcatcttccaactttgctccagcaacttcagctcctcattaaatccctccctgtaggtcatccctgcaaccagttgacactggagctcagcagccagctgataggggccttcactcctcttgtcgagctgctcctctctcctctcaaagccctctttccttctctcctgctggctgacctagaagctcagctaaagaggtgttcaaagggtccagtcgcttaaacaggtggccagtgtgctttctgctataactccttgctccttgagctcagctccaagctgtagaaggccatggaagagcacattgatgtcatcttgggaataattaacagggtccggtttttctgttcgtttccttgcaccagatgaagagtaggataaacttgggagaagccaaagtgatgtttttgtattgtggctttgaatgatttcaaggtcccttggttaacctattctcagcaaaagaaatagaagatggtcccaagatggtaagagcagagtgtttggttgataatttgatctaaaagtgaccagactccacaagttaacccccagagctgctcaattacagcagtttaaaaataagttgaggattcgttgctaaatcagtggaaagaatttggagtttccaaaatagtttgtaatcaagaaaagccatctgaggaggccctggagggaaaatcgctgatgattatcaaatgtccagttctcaatgcggtggtatatgtgactgaaaaaaaccacttttgtccacatttggggaaagataagattatactaaatgcctggcacatacactggaccttcagttacctagaaaactttcaaaataactttgccataacaagtggcaaattattaaggtcatgggctgtcttctcaaaattacttagataacatgattctctggccagtatgagacccttaatttatcacgtatgaagcatatgagcctgtttatccgttcgttaatcattatttttatctggcttgggctctgggttactggccatgcaggcagatcttcccttccaaaaggaaacgttattattctcttgtattcgtttctttaaaaacatgcagatttaacaaaacatattacttagcactcttactgatttagaaatatgatgacccttaggaaatgcatctccttaaaagaaattccaggcaaactcatttaacctttctggatgttagtttcctgaccttcaaaaaatgggatgttggaccaaattatcttgaagtttccttccagctgtgtgctcggtggggagtgctggcagtgtggggcaggacactgaatatctgtggtggtgatgtttggatacaggggtgagcaacccctttggaagcaacatgcaaaattgctgagcagtggtgggggtgcatgggaatgggtggcggtgcccctgtattggagtgtaagagacaagtgtggtgagagcagtctggcagggctactactgttatgatttacacagtccctttcatccagctacttcaaagcaccttcacaaactctggctcattattccttcaaacacagcattcaagaaagattgataggcgccttttaattaattcaaagatgatgaagctgagcattacagaatataaggggattcttccaaaagtatctgcactgcagaggggcatgatatataaagtgttcatcacaggtttctaactgaaacaaggaaatgacctgaacgcttatttttagaggagaccagtatatattatggcatattcagaatatgcaataccatgcacccattaaaatcatgtttattaagaatagtcacattagggaaatggtcataactgaacaacgtttagtggcataaaaaaagataaagctttgtacatacagtatgatgaaaatgtttaatgtggctgggcatagtgacttgtgcctgtaattccagcactgtgggaggccaaggcaggagtatcactgaaggccaggagttcaagaccagcctgggcaccatggtgagaccctgtctctacaaaaaatttaaaaattagccaggtggtcatgatgcatgcctactattctagctactagggaggctgaggctggaggatcactggagcccaggaggtcaaggctgcagtatgccatgatcataccactgtactccagcctgggcaacagagtgagatcctgtctcaaaaattgaaaaaaaaaaaaaaaaaaggtttaatgtgtagaagggaaaaggctaaatggaaatgtgttaaagtcttaacggtgatcttccttggagcaatgatatagtgggtggttgctattcttttctttatacttttatgtacttttatgttatgcaaggttgaaaaaatgggcacatattgctttcatagtcatttctgttaagataatcatatgattatgaaagagggagtgtgtgtgtgaaagtggaatggaccaatcaaatagaacagtaggaagacctcagaagatatgacacatgagctcaaccccaaagatgagaagaaccagccatttagtgaatggggaagccctctggggaacagaaggcacgaaggaaggaataagtttggaatgttctaggttttgaaaaaaggccagcatgggagaatgatgaaagataaggtcagagccattgccaagggcaaggtcatgtaggacccatgacgaaaagtttgggaaacccttgtaggggactgacataatttattttacatttttgaaaaatccttctgaccaatatatgaggaacattgtaagaggcaagtgtagaagtcaagatctattgagaaggcgttgcaggggtccaggtgagaatgaggatggttcagagtggagagacagggacaaggtaagttggagtgtgggtctgacttgttagccatgtggaggaaataattatcataataactatcatgtatgtttttagggggctctataacttcagtatgttttcagtgttcacatttgtaggtttacagagtttgtacttgataaggtacagaagtaagtcacttctcaaaaatcatgcctttagaagcatatatcatgcttctattatagtaatgataataatagaagtctactgctagtcataaaacttatctgttcagagaaggctttttttttttttcagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgaggcattctcagtgcacagtaacctgtttatctcgctttgccttgctctttcccaagcacatttttgctcaacgccccctaccttccccatacacttgttaacactttgcagagcactagggctctgtgggacaggctgggaaatgcaggttgacatgccactgttaatacctagaaaattaaggcaaacttgtccctgagagatgtcaggatagcacagtatggaaaggccatgcttatcagggctcttatctgagagaatacagtggttatgagcatgactctggaactagacagtctgggttgaattccccgctctgccatttagttatatgatatggggtgtattacctaacatctctgtatctcatttgttcctcacttgtgacatggggatgatgacaatgataatagtaccaacctataggatagctatgagaattaaacaaattagtaaatatgaagtatttggaacattggcctgactcaggataagtcctgtttaaatgttagtatcattattattgtttcttcaagccaggaatatacttcatcaattatgtgtacactcattccttcattcaacaaacacttacttaatactcctgtgtcctaggcactgttctagtgctggagatacatcagtgaatcaaaaacatgagagaaaaatccctgtccttgtggaacttacactgtagtggaatctactactaataatgcaaatagaaagaaaaatatatgcaagttacccaggcactgggtagcctagtacctgtcctatagttgtcaaatggatggatatattattcttattgttgttgtcgtttacagtaattgagcttggaggtttgagctgccatcttagataagaacagaaagctaagccaatacgagtgccatgccagtaagaaaaggaaactattacataaagattaggaagaaaaaagagaagaatgacaagtaggccattatctatggccatgagttttatttaaaatgagctggaccttttttgccttctttatctgtgtatcagatagacaattacctctaggcagatttccacattccaagacatgaagactttctaagctgcagcagacacatctttacttgtagcaaaacagagagcgatgggggttattttcagatgactgtagctgaagaggaagaatcaagtaattcactccccccaataataattcacttctgagaggaaaaacttctttggaaaaagcaccccatgaatggaagtctcagcatttgctgaagaacttagttaaaataaactctagacctttttcattgattctttatctcttcttttccagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttcttttttttttttttttttgagacagagtttcactctttttgcccaggctggagtacaatggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtacccaaatgttactgataatttgatcctttctctactggtgaacaggtcatctttggaaaatccagcgggcctgaatttctgcaggaagtgtacacagctgttacataccataataagtaagtctatttcagcattctaaatatatgccaagatggtttcatcatctcctggtttttccaagtcccgtgggtggttcctcctaactatttttataattcagggactgaggggcaaaggaaatccatgccagttccgtgactctgtgttgaagatgtataactttgccattaaccaagactgagagaagaacgtgtcttcaagaatccaatatagttttgacttttccagaagcttctattctagtatgatgcaaagaggttgtattacgttaattaaggaaacacatttcctaacttgctttgagaccctggaggggaccagaagcacagtccggctccccttgccctgtgtgtccctgtccgctccacttgacacctgccccactgtctgcctaggctgaccaaaggagaaatggaacactcattattccaccggcaaatggagtcatgggataatgcccaccctattattcatgttccacagggaagggagagacacctgcacagtgttggacggaattgggtttgatccgggcctgataacctgggcctaattaagtccttcatttaagcacattctgggattgggatgaggattaagtgaggtaatgtacattacatacctacattactttacaatgtacgtaatgtacttcgtaattaatgaagaacctagggcttcataatgcagttaaattggttcctttttcctcctgcctcattcatttgcttctactctttgatgagtgcagctaggtgctaggcttggttccttgggtagaaatggaaaaaggaggtcacagcaggagtccaaacctcatcctttcttcaaattaagttgttggagttttccattgtgtgggggagttgttttttgttttttgttttttgttttttgtttttcctgacaaagcctttagttcatgaacagttttatgtaagggaagtgcatctaataacataagcttggtctcagggacttccagcttcagagcagagtaatgtaaaatgaaaagcaaaacaccaggcaaattctgaggagcaaaggggctgtggcgttttacaatcagagaagtcatcattcttgctaaaagttatttgtgtataatgtgcttttgaaacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagtgagttgtttccagcctgctgactcacactgcagttgttggtgcatctgaggtccctgcagagataaacaaccaaattctattcacttgattttttccagtcagaagtagcaaaacatgctaagccacattatagcaagaggcagaaatgatttgccttagcaaatgtcaaatttcaggaatggaaagctagcgggtgatagatgttggaagaatactcatctgttttttaaaaagcattgcagtgttcactatttccaaatttaatatccatgcttcacgtatagaactagctttgtcccccaagaagaaaccattttttctttaaaagatataaaaggtgaaataaacattgatgttgttcagacacacacaaacattggctacagagaaaaatgctactgctttagctccaaaagcaataaatcatcaatattaccatttcaggaggtctcggagatttaaaatgcaaagaactggacagaaattactgccaaaaagagtactggtcaatatctactcactgtttagttgcatttgattattgcgagctagataaattatcagaattatatgctgtaataaataccactttattatttacatcatctgtttcagtggctgccaattctcttaaatgaacgtcttcaaactggatcctactgtctcccagttgccttggaaaaattgccacccaactactccatgcattctgctgaggtaattggcaagctggccatcagctgtttcttgtccagctgtagtcttggaccaccttcccagactcactttccattcccatgtggccatggatgttcatcatgttctcagagagcacattgttctgataggatgggaggaataactgactgtgaaacctcattcttttaaatgccaccaaatcagaatgttcagtagacgcaacctacacccaaggcagcataaccttgcattatctaccacagagggattcccagaataatgtattatagaagaggaggcaaactaaggccattcatagtaaacaactgttcccatcaaggatccttataaaagattcccaggccagattcatccgtttctttcttgggtcagttgtcacagccctccggtagataccaaggtatttattctcctaccaatcccaatgccaatagcctttcccacttcctgtttctggcactttctcttgctcatccactctgctgcagtgcacccatttaaagagaagcccaggtggatcaactgaggtcaggatttcaagaccagcctggccaaggtggcaaaaccccatctctactaaaaatacaaaaattagctgggcctgctgttgggtgcctgtaatcccagcactttgggaggccgaggcaggcagatcacttgaggtgagaagttcaagaccagcctggccaacatggtgaaactccatctctactaaaaatacaaaaaaattagccgggcgtggtggcgggtgcctgtaatcccagctactcgggaggctgaggcaggagaatcgctttaacctgggaagtggaggttgcagtgagctgagatcacaccactgcactgcagcctgggtgacagagtgagactccatctcaaaataaataaataaaaaataaataaagggagcccaggggactgtccaccctgactgcaccagctgtcacactgctagcccacttctcagttccttgcataggtttacatcaataagtattattttgaagtaaatctcggacatcatatttcattttagtctgcatcttaaaagataagggatttgtttttaaccatcacaataccattgtcatactttaaaattttaactgtaatttcttagtatcatcaaatattcagtcactgatcaaatttttaattatcccactaatgctatatttttgacgcttgctttttaaaattggtattcagataaggtccacacactgatattgattgttacatctctggagacgcttttaatctacagatcctccatctcttttgctttccttgcaattttaagttgaagaatttctcagaaatttgaatttaatttcaaccgttccagtcaactttcttctctgttctttcgccatctaccgtctcacttccggctgttttcctcttattttcttttttccttaaagagagaaccaacttttgccctggaccacaggcatgtgtctggtaaaccaaaacttctctcatcaaagccatctaaggggcaatccgagtatgtccacagacatttccctgattggtctttatgatttggacatcaacacctttcagtatccctcaaaaccaccttcttatcatcaagttgcacactctaatttcttagaaccccctattatctttttaagctataggaaagacctgagtgttggagagagacaaatctgtgtccaaagtctagattctgccactccctagctgtgtgaatgttggtgagttgcttaccctctctgagtctcgaagatgaaactgagcccatatctgcatatctgcctataaggttgctgtaagcattaaatgagataatgcttgccaaacaacaaactcaattcctaagtaaacattaattcctttttcttacttgcgctatgctgtgtttatagatatacccttagcctctcttagtatcctttaaacctgcactgtctgataagatagccactagctgtatgtggctattgaggaaaatatggctagttcaaactgagatatgtgctataagtaaaatatgcaacagatttcaaaaacttcatggggaaaaatgtgaaatattgtattaataattttttacattgattacatattgaaacagtctttaggctgtattgagttaaatgaaatattactttcacatggtccttttgtgtttttttttttttttttttttttttagagacagggtcttgctctgtcactcaggctggagtgcagtggcgtgatcacagctcactgtaatcttgaactcataggctcaagcagtcgtctcacctcggcctccttagtagctgggactataggcatgcaccaccacgcccagctaattttttttttttttttcattagaaacagtgtcttgctatgctgctcaggctggtctcaaactcctggcctcatgtgatcctcccactttggactcccaaagtcctgggattataggtgtgagccaccatgcccggcccctttttacttttttaatgtggccactagatgattttaaattacatatatagctcacgttatatttccactggacagtgctattttagatcacagatggcaaactcaagtgcccacaggatccagatgagtaacataaatgaatgccttgttctggtggcatctgttcactctggagattgtctcttccccatctgaaggtcacagctgttctcttcactctgcagattggtgacatgctgggatataaggccaattttttcatttcttccagtactcaaatgaagttagaaaagcagtcttttataggaaattttcaggctttcaaatattggtaattaattttttaaagttcctaatacttcaaacagaacgtgtgtgtaggctagagcccactttgggccccagcttttgactgcttcagatagctttaaaggtctccatcccctgtacacatctacctttcattatgatgaaagacatacaaacctaggcgaggccctcactcaacactgcaggacatctctaaaggaatgcaatttcaatgggaatttaaggcaagaaactgtctgtaagacctacgaaggtaatgatatataaacgtataaaagagtcactttgagtaattaaagcaggagccgacctggcctagaaacatgtgggaaacacttggaaaaactgtggtgaaagggaaagtaatatcgggtactcaaaagtattaaaatttcatgtcttgtaaagatattctatactttgtcctgacaattctgattaatggggaaattgctgggatcttaatttattttaattcctagaatccagaatcatcaatgctggtttggaacttagagacagattacaccgttcagccctcttctcacagcatgagaacagaacactaaggcccagaaagtttagttgagtcgtctaagtaaaaataactagtttgaagcggggcacagtggctcacacctgtaatcccaacattttgggaggctgaagtgggcagatcacttgagcccagaagtttgagaccagcttgggcaacatggtgaaaccacatttctacaaaaaatagaaaaattagttgggtgtggtggtgtgtgcctgtagtccccgctactccagagactgagacgggaggatcatttgagcccaggaggtcgaggctgcagtgaaccgtgattgcaccactgcacttcagcctggcgacagagtgggaccctgtctcaaaaggaatgaataaatacataaatattaactagtttggtgtagaattgaagttgaatccagggctcctgactccaagaacagttagattagttttcaagagagttctgtatttgtataaccctgacatttccagtcaagttggtctgcattgcttgttagtaatcagaaaagggaattggattgctaatcttttttttttctctttaacacagaaagtcccattacagaatcctcccattaagtgggctgaaggacataagggagtatttaatattgaagtgcaagctgtttcttctgtacacacccaggtaaggaatgtcaaggttaatcatgaaggtaaaggtgcagcggaggagcctttgaaggacaggccaataaaagatcagtgaaaatccttgtctacagataaataaaaaataaccctttagttctttgtggggacatgcaaacctctttaggtttcatttgtcattggaatagaaagaccttacaaaaccgccgagcacctaaaggaaagaacctagtatctgcactgttggtggagaaactttgcagggggacttgatttgaaactctcatctgctgttacttcttttccctctgtaactctgccactttgccagcttttaaaaagaaattccgtactctctcctttacctgccactgtctgagttctgcatctgctgagacctctctcttggcagtatgcttacctggtacgctgacctctgcttacagaacatgtcagagccaaaattatttcttctttagctaataattattgaaacgttcaacttcatgcaccacattctacaaagaagttcatagcctcggtctgaaacatcatgtcttagaccttctggtctgaaacgctggataagaggttctacccataaagagctattcgattgtgtttgtgaatccactggtgaacattgatggtataaaaccccatgaggcctgccttctcccttcgcaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacaggtatgaacctgcagggctgggctgggaggaggcaggagcaagcaagcattgccttctttaatgaaaaatgactttccagaaatccagagacaatgtgatcttcctttccactgatgatgtgtgctcaagggaggccaagtcttatgctattttttttttgagactctctgcatgttggaaagaaaaagaaacattaaaatagggttcttaatattatagctttttgtaaactttattaaatgattataggcagtctttaaaattccatttctggtaattgatgaatttattttaccttgaagatatttttgttttcttgactaacaggaaatggaacattttaaggtaagacaacctgtgttaaatggagggaaggaactctctacattgaaatgcaatgcaatcaatttttaaagttaaaacataaactcactattttaaagtgtatagttcattggtttttagtatagtcacaaggttgtgcaatgatcgctacaatctagttttataacattttcatcacctccaaataaaaccccatcactccctattcatccctccccctagaactcatccgttctctcttacagtctattttaaatgcttacttttaacaagttaacactaaatacaatgtgtacattttcccttagaaataatctcaaaagcttatcctggaggcatgaccagagtccagtggttctcctaactcttccagggtagactggctggtatagggcatctttatttgccaccattttcagctgtgcctatatagctctttgctttccagtccagcagacgtcttttgggtaccatccatatgcccagtactgtactaaaagttgtaggctttgtgacaataaccaagagcatctcagacctcagaggacttataatatggcaaagagtcagcagcacaggacaagactcctcaaagggacacagctaaattttgcagtggttgtggggagggtggtatcaaaggagagagtgagaaaacatccatctgggaggatgcaggaggtccacataaagagatggccttgaagaagggatagagtgaaaaccgacagaataggggcaatgagatgagtgcagcactgcagagaaccagaaaagtgtgggagtgtcaggaagaaagtcagtagcacagttggtggtggaacagaagcacgtgtggaagtgggctgggacaatgaagtgagacggcttttagagccagggaggggcatgtccccttaatctctcactctgctttgcaccctgatatgcatcttctgtggttccacagatcaaacgtcctgtgttggaggctaacttttcatccatgtagcagttgcctctccagctagattcttgcagagctctgccctccttcgattactttctgtgcccccgcatatgtggcacactgctttgtatgttccagctagttaatacagacttgttcaccagacaaaaatatttatatgttttgagcagcttctccatagcaagttgccaccttgtggtgtgaggaccacagggtgttggcataggcagaataagtggaggtggctagtctacaagcatttattcagaacctattctgtgtctctgcaatggaaagcacagtgggggcacaaaagatgtgagaaatgcacttcgcatgggaaggattccagctttcacagacagacagtttaccaccagacatggctggagaatcatgtaactcagtttcacttgagccctgtactgtgtggagtcagacggcttcatggaggaggtgggacttgtgctgagattcacagggtcggtatgattttgtggatgggagtgaggagggcttcctaggcgaggacaacagcatgagcaaagtctcagaggtaagagagcaggcatgatgggacaatacaatgactgcctcattttaagggatgtcgaactgagccaaaaagggtacaaggttagataagtatattggagccaaactatagaggcttagggcaccagaacaagaggttctatgcagtaaatcaaatgtgtatgggcccactgtgggaatgacttgatatgcagacatttttaggttaatctgtacaagaatcagggttgtgcagcacatctcaaatcatagtgtccacaacagtcacgtgagcatcttgtaaagatgcagaacctgattaatacactctctggggtggggcctgagattctgcatttcttagtagcaagcaggtgatagtggtcgtgtgtgtccgcagcccccactgagtagcatcagtttacaacctggcttagagaaggaggacgtctggacagtcttatgtctttgtcattaaaaaccatcaatgctattcagtggcaggaggaggaagttcaaaagagggaatgtggaggcatctgtggtactcagagccagcatgccagagctcaccaaaaccatctacccttcccaggcctagttaaattggtcagcggtcaggactcattgtcactgtcctggagaaacttccacctcaggctccttaaggaccagctgtgggactacccatttttctcttggttcctcagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggtagagttgccctgagtgtgggactctggtgggcggggcaacaccacctccaccccactgcagtgtaatccaaaataaaacatcctatgctgggtgcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatatatccaatggcagtggttcttaaactttttgttattaaaaaaaatcccttttcacatttccctcaaactgaactattgaaataatagtaatgcatttccccaactcttcttaattatttacataagtaataatcaagtagaacttcttgtcagcatgatataaaaattagtgtcagtgagttcacaaaattgcaggcccaaataaacatgacacttttgttggtctgtgcagcctcatttctagtaaatctgaaaatttgattgagtttttaaaaatactagtgatgtggctgggtgcggtggttcatgcctgtaatcaatcctagcactttgggaggccaaggtgagcagatcacttgagctcaggagttcaagaccagcctaggcaacgtgacaaaagcccatttctataaaaattacaaaaattagccagtcgtggtggcgggtgcctgtagtcccagctactcgggaagctgaggcaagaggattgcttgaacctgggaggcggaggttgcagtgagctgagatcatgccactgcactccagcctggaggacaaagtgagaccctgtcttaaaaaaaaaaaaaattaaatagtaatatctcatagatttccataaccgcttgtgaaaacatgtcaacatttaaagatgaaaaacagtgctgtatacatcatataccgtaatcctcacaaggttcagatgactctatggatttttgaatctgagaaaacctcactgcatgaattgtaaagttgtcatttaaatattgacaaattaaaaatatccacatttttagcttctcatgagaaatcagaagctctagcaaccctggggtccatttcccgatggcagtaatagactggagccagtagtaccccctgcctttgtaagaggcatgtgttggctgtttaccatgatctccaccactccctggtgccttatgccccatctacttctctccaaaagattgcctcctaccccaaccaggatttgttaagaagtctctaattccaaggcctaatccggtggcttttcatccaccctatccctcttcaattccttcttaaactcagtaagtaactctgttcccctgtctgttgacatgtctctgcctggtggggtgcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaaggtaggaaagatgtcaaaccgtggaaggggacacaggcttttttattttttaactaaaacttggagaagtaacacagaagcaaccactactgctgcccaccatgctggtcggatgctttaatgctcagctttggagtgattaacgttctttagaacagattaagaccattctgacagatgcagcagcaagaccagcatctgaggatttgctgagaactacttagcttgggtagcaaagttttaaagcatcaggggtttagccacatggagtcatgtggctaaaccatgcattttattttcaaggaaaaaaaatagctttaacttttgatacctggaaaggttgcctttaatttagttttgtttctttaatacctacctcttacgttcattaacatccacagattgattatctcacaaaaaagtccaaaggaacagccgggcatggtggctcatgcctgtaatcctagcactttgggaggccgaggcgggcggattacttgaggccaagagttcaagaccagcctggccaacatggtgaaaccctgtctctactaaaaataaaaacattggccaagcacggtggctcacacctgtaatctcagcactttgggaggccgaggtgggtggatcacaaggtcaggagttcgagaccagcctggctgacatggtgaaaccccgtctctactaaaaatacaaaattagccaggcgtggtggcacatgcctgtaatcccagctattcaggaagctgaggcaggagaatcgcttcaacccaggaggcagaggttgcagtgagccaagattgtgccatttcactctagcctgggcaacaagagcaaaactctgtctcaaaaaaagatacaaaacattagttgggcatggtggcgggtccctgtaattctagctactcaggaggctgaggcaggagaatcacgtgaacacgggaggtggaggttgcagtgagccgagattgcaccactgcactccagcttgagctacaagagtgagactccgtctcaaaaaaaaaaaaaaaaaaaaaaaaatcccaaggagcaatgccaaattttacaagcatataaaaactgacatcctgagagggttgatggcttgccctatgttgtttttccctctatgaattctttatttttttcatggtaaagctttactttcagaacagttttagagttacggaattatatactctatacccagtctctcctttattaacattttacattcaaatggtacttttggcacaattagtgaaccaatattcatggaatattattcattaagttcatctttattcacaccttctcagtttttctctaatgtcctttttctgtcccaggatcccattctgaatgccatattacattttgcagtcttgcctccataggctcctcttgctggaaacaatttcttagactttctttgttcttcatgaccttgacagttttgaggagtaatggtcaagtattttgtagattgtctctcattaggaattttttaaagattatgatattattcacataccataaaattcacccttttttaaaagatggagtatacgatccaacagtctttaatctactcacaaagctaccacgatgaattcttagcctgaattttttctccaatgatctgtggcctcagggtggccgagctattagagtaatatcatttcccctgataaagagaaatcaaaatctctaggtttagacacagacacagtttcacccttacaaattccagccacttgacactgtgtggtgtgaggaaggaaatctgcaggccagggtttggggctgggcgccaatactgccccgctgtgtggccatgggaaagtcatgtaactgtgctgggcctcatgtcctcatctctgcagaggtcctggtccctgaatgaacttaagaaccatctaccctgggtcttttaaaaacactggatttggccgggcaccgtggctcatgccagtaatcccagcactttcggaggctgaggcgggcagatcacgaggtcaggagatcgagaccatcctggctaacacggtgaaaccccgtctctactaaaaatacaaaaaattagccgggcgtggtggcgggcgcctgtaatcccagctactcaggaggctgaggcaggagaatggcgtgaacccgggaggcggagcttgcagtaagccaagatcgtgccaccgcactccagcctgggcagcagagcgagactacgtctaaaaaaataaaaataaataaaaaataaatgaaaaaaccactggattcaccccctgagatgctgatgatctgtagtttgagccatcaggaattattcgtattctatcctttttgacttacaaaaatcagttcagggatgtgctggagtgagctcatacctgttcccaaaagctgattgcttagttttccagaattttttgagccagttttgaaacagacattgttaaaattaaatcgtataaacttaaaattaaataagttatattaaaaacaaaggtaatctgaatgcaatgtggtatgctagattgtatcctggaacagaaataggacatgagtgcaaaaactggtgaaatccgagtcgttcgtgtttagttaatagtaacatatcaatgttagtttcttagttttgacaaatgtaccttactataaaagatattaagagaaatgcaatgaaagtcatataagaaatactacctttgtaacttctctgtaaatctaataataactatacaacttatacttcaaaattaaaagttcactttaaaaaggtaaacctagtcccttcctaataatttcactatatgctacaatatctaagttcttccttctttacgtttactgtgtctgtgtgatggaaatattatataatggtttgctaccacactgcatttctatgacatcgtgttggtagattgaaatcagttatgatgaaagtatttgtggcacaaaaattggcaaatgctacaaattacccctacccccctgacaactggttgttaaacatttgccagcacaacacaactcagcctcatattgaaagcccctttcagtaataccactttctgatcacccaggaaagaagtggtctgcagctattactgacagccttgatctttctatttttctttaataaaatgaaaatattaaatttttatgtggacagggttagcaattttcgaattattttgttgcatggggagaaaatgtctgatagagcatgagcactccacttcccttcagaggtagtttttgacaatgtattggtgtttaggagacagcgtggtgcagtaccgtactaaaccacagagagacactgttcccacacattttttcctggcgtcccctgaagtcacagactcctagaagggactactcagcagcccagattcttaaatagtttttaactgtaggttgctacacacaaactattaacgggtgttgtctcaagagcaagtaaaattaggtataacttcactgtctttgctttgttttatatttacttatggcaattgttttacctttgtaaccaggaaaaaaaatatgtataaaaaaatgaattctgaggttgtgatttccagatgtctggcttacctttccatggttggttgactgttaagccatggtttgtgtattttagatcgccgatcgcaactgcagccgaatgtcttactattgctctggcagtagtgatgctccaagttcacctgcagccccaaggccagccagcaaaaaggtactgaagagagcaatgtgaggttcatcccaggataagaacagaaggatttcctcatgccctcacactgtgcttgggaatagtcaaagtgctcccctgcctgtccctgatgtgctaacacacacacaccccacacacacttttgcagccctgtcctttacgccacatttgaccacctaattgcccattaactcagtgtttctcccactttctcatgcatcagaattacctggaagccttgttaaaactcatcgctggaccctacctcctgagtttctgattcaatagatctgagctggaggctcaagaatttgcatttctaacaagttcccagctgatgctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgcttaccaggatttttaaagcaacaaaattccccaatcatagtcccagcctatgtggtctgagggatggagggaaaaaaaactgtctgccctaatttcctctcttctaggcactcaagaatctcaccattatagtagctacttaagtttttaatgtctttgaagacctgtattaaaatgtaaatatggcagggcacagtggttcatacctgtattcccagcactttcggaggccgaggtgggtggatcacctgaggtcaggagttcaagataagcctggccaacatggtgaaaccccctcctactaaagatacaaaaactagccgggcatgatggcaggcacctgtaatctcagctactcaggaggctgaggcaggagaatcacttgaacacgggaggcagaggctgcagtgagctgagatcgtgccactgcactccagcctgggcgacagaatgagactccatttcaaaaaaaaaaaaaaagaaaaaaagggtaaatatgcttattgcaaaggataacacaggaagccatttgcaagagctgacatcacagggaaatgtttattaaacaggcaaggagggaatgagcctccccaagtctccctttggactggatgagggaaagaccaagtgtgggagggccggggcctggtgctgtgcactttgcagtattccaggcaccatatgtctagtgagaggtaccaggatttaactataaaaggaaaagtgaaaaaagatatggttaggctaaaaacaaattagtccacttgctctaaaatttaatattaggctatcacaggccctatgcagtgactggttataggtattataccattttcctttcttaaaaaccattatttgcctacagcctgacttctttaacccatgtcctgtttggtttcgcagttgccatgttttgacttgaaatgaccagaatagagacattttatttcaaagggaagtttggccaatatgtttccttaataccttagcagacagagttttgctgcttggctattttatataacctccagagcaaggtgttcttgtaataatgctgcccagaaagcagcatgaattactttaagaagcagcttatccttgtctaatctcttcttgccataagaccctggcagacaaactgacctattttctagaggcgacctttgaagctgggggagcatgtctttcctacaatgagaagatcaaggtgtagtccagttataatatgtgcacagttagaccacctgctagactaaaactcaaccccacgcctctctcaagtgagacagcttcacttcagactcacaacagcaaacaaatgtgttaacgcatattaaaattattaaggtttgactaacctcacaaaacgaagtgaaaccagtcgataagctgaaacacctaagcattctccattcctcaccactaacccgcctgggatctaattggttaaaatacccaagcatgtatacagagattttccttttgtcatcttttagtttagctaagtagctctcaaattttaatgtacgcaagaattagtacattgggttgcatgcgtactggactctgtgggtaatttttttttttttttgaaacagagtctcacttactctgtcacccaggctggagtgccgtggtgcaatcttggctcactgcaacctctgcctcccaggtttaagtgattctcctgcctcagcctccagagtagctgggattacaaccgtgaaccaccacatctggctaatttttgtatttttagtatagatggggtttcaccatgttgaccaggctcgtctcaaactcctgacctcaagtaatctgcctcctcggcctcccaaagtgctaggattacaggcatgagtcaacacacctagccctctgtggataatttaaacgactgtcaagagcaatgtttgctgtaatcagtttttgctttaggtgttgactttaaaacttaatttgcaaataaggatatgatattagggtgttcaaatagctttagctttcttacctactttcttaccagaaaaaaaaaatgagtttatctacgtttattccaggttttgtgggcataagatgaaagaaaaccacagaaaattcccagacatcatttttggcattaattagggtgaccaactgttctcatttgcccaggactgagggagtccccaagatgtaaggttttctattttaggaccaggacattatcaggcacactgtaatggattgattgccctacctttagtcttgaacttcttcctcatcaaaatgattgtcaggaatatgaacacatagccagatatgctgtagaatggaaaaggtataagtcaccctgtgcactatttgctactgagcagtaggtgacttgaagggaagtgaagacgcaaagtggagctgggggactttccaagcatctggccctgggacatagacatttagatgttgtaagttaaggctgatactactatgcctttcagagcccaagatcctctcataaaccccaccgatcctgcttcccacaatgccatatgggcattataaaaacaaaaattgtccagtctcctagagagtttagacaccatctagacagtggtccctaaagtgtaaccctggaccagcagcagcagcagcagcagcagcagcacccaggaacttgttagaaatgcaaattcccaggctattgaatcagaatatctgggggtggggccccccagtctgtgtttcatcaggccctgcaggagattctgatacacagaggccgggcgtagtggctcacacccgtaatcccagcactttgggaggccaaggcgggtggattgcttgagctcaggagtttgagactaagtgggcagcatggcgaaaccccatctctaccaaaaaaaaagaaaaaagaaaaaactagctgggcttggtggtgcacgcctttagtcccagctacttgggactaaagtaggtgggaggattgcttgagccagggaagttgcagtgagcgagattacgccaccgcattccagcctgggcgacagagtgcagccctatctcaaaaaaaaaaaaagtttgagaactgctgccaccaaccaactgattttatggatgagaaaactgagggtgaagagaggaatggcttgcacatggtcacacagagagttttcagcaggacccaagaggaaagtaagacagtaccagttttaatggctacccagaatgtttcccccgtagaatagagtttcactcccaggctgagtccactccctcagatgtgtctgtcctgtgcagcactgaccccagccttctatgcaccgaaatgtcctccagtctcaggtgatctcagcactgactttgccatccaccacttactgcctagaacatctaagacacatgcttcaggaacgaacaagctattaaattggggggaataaaagaaaagaaaaaaagtgttggtgaataataatagcctttgtttcacagcctaatttttgtggttcttatttagcatttccatgaggagcttgcccttcagatggtggtcagcaccggaatggtgagagaaacagtcttcaagtatgcctggttcttctttgagcttctggtgagattcttgcgcgtttgtatctgtgctcaataggccaagagaagcacacagcagaaaggaattgacattttgttcactgagttgcccctgctgaaaacctggggtggtttcttgaaatctaataatctctcacccctcccatccttcttccactaaattgtgttgcttctaccatgaaaatctatcgccgtcctgtgagttctcatcaccttcaccactctccacctggccacacaccatcatctctcatgtgcctctcgcagtgacatcctctttttcctgcctgtatccatttttgctcttggcccacccattctgcacatggcagccaatactaaacagagaatgtcacgctccttttaaaaaccgatcgatgattttcactgcactgagaagaaagcacaaatttttatcatgacctaaaaagcccttgtatgattctgttgttttcctccctctctaacctcatctcacgccacattcccccatcattcagccacatggtcctcttttggtgctttgaagatgccaaggccattttggcctcacagccttttccagattctcttcctgctccctaactttcacctccgcacccccaacacacacagtttctattcttctctgtagatttcagcttcagtggaaccatccccaagaggccttttctgaccacctaatactgtaatatatcttcctctattatcctccttctgagcaccctatttatttctttcctagtggttatcacaatttctaattgttttttctgtctcagcggttagattttcaggatttgggtctctcttgtgtattatcccatctctagcctcagcacactgcttggtaccatgcaaggcccaattaatatctgttggaaaacagaatgaaatttgtatatctgtttatcctaaaacttctaccattactcgagcagaaaagcaaaaggtatagccataataccttaattttaaaataaggggaataatagtgataactatttttttgtttaattattaatggaagcaaaaggattttcccatagaggcactaaaaataaacattttctcaatgttgataaacagagatgcataatgagatgatgttgaatgaaagaggtctaaagacatagacaccaactatataaaaatatatatgcaaacagttcagaggatttggagtaggttgagatttagtgataatgttagctttatattcattgggttctttcccctgtcccattaagtgaatctttttttttttttttttttttttaaagagagtctaggctgggtgtggtggctcacacttgtaatcctagcactttgggaggctgaggcaggcaggtcacttgaagtcaagagttcgagaccagcctggccaacgtgacaaaacccatccctactaaaaatacaaaaattagccgggtgtggtggcgggtgcctgtaatcccatctactcaggaggctgaggcaggagaattgcttgaacctgggaggcagaggcagcagtgagctgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgatccactggtctacaccacctctgttctgtgaatcctatacagagctacaggtcttttggaatttgtactcagacaacaccagaatttttttttcattccaaaagccgagctaattaaggtggtggctgcagctcacaagtcttggggcaagagcattaacaatgagacatgagctccatgctctggcaggaaagggactgggccataagacccattcccctcttgtttcttgaggcatgagaagtatcaaaaccgtcaccccatgccctttatatcctgcttctatttacacatcccacccaccatcatgtctctccataaagaagattcactcagcctagctctgcaaaaatgaaaaaattacctgggtgtggtaacatgtgcttgtagtctcagttactcagcaggctgaggcaggagcgtcactggagcctaggagttcaaggctgcagtgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatcttagagctctctttccaaaggaagtttgcattctctgcaggtgtaatgatgtctctgttcttcacagaatcccaataatagttggcataccaatagttggcataccaatgggagaaagaataatcacatcaaaactactgagcatcttactatatatgtgccaggcagtgttttaagcattttaaagcatcatctaatgtaatcattatgcaatcttgaggcaggaggaacttttattatcccaaatttacagatggggttggaggaagggtggtggccataaagagagtctccaagtcagccaaatgcttcagcagtaccacttcactgcccctaactgcttttggccttgcacatttatttactagggcttcgttggcccaggagagaaagcataagctaaagcacatggcccatcttacctctaggaagtcccttatggtaaacagatgaagttttttgggaagaaagcccctgctgatctaagcatattgcaggggtttgtcaacatgcagatcacccaagacaccagttctaccagcagcctaaaacctaagtctgtcaggttctggcaggacagagtttccgttgcccaaaagggttaactgaaaagcattgatcaaaaggactctgctcagcatgtatgggaggttcaggggccaatgaggattggtgagagcccccagggtacagcagctggcagaagcctttctctatgctagctctaaagaatcaagagtatagcagagtaactggggcctagaaaaatctggaggcagatgagacaatcttagaaaaggagcctggggccttagaaaaatgttgccactaccaggacctcactgcagcagggatgagggcagtggaagtgagtaactacctgggcctctctgttctcccacgtaatgatccccttgtttgtgctcctgttggccaactccaactggaagccaaaggttaagggggcctgagtgatgtggtccctcgagacccccttcccagcattcagagacagacagagaaggacaagaaatccatcagggagctggggtaggggcaaatggaaactatcatcccccagccagaactttgcaaggaaattgatctcagactcagacaaggtgcccaattcttcatacattgtttatgcatttgcctgaccaatgcccaggaagttatttgaaaaccaaaacagttttgttttgtttttttccaagaagcttgagaaagacaacagcttccttggccttagccaacaacctgggcaatttaacaccctctagttgtgtcagtgcccaagcgctaatgaacaaccactttggcattagagctgttaaacacaatgcttgggcgactttcacacttgctaatgaataaaatccctgtgcttctagaaactgctgagccagaccttggagaaatagagataaatgggtgacctagtttactcactcaggacatgaagttccacattaaggggttctttagaggtacccttactttaaatgggccacaaaggcccatatagggggaaagatttctgtgcctcgccccactcaacagggccaggcctccactagtgtttctactggatgttcttctctggagatctggaggacacagtagctggcaagctgctgacagtctggaaagaggccattggttggaagtatggtattgtgagaattatgtatttggttgtaggatggccaaactcagcagacaggagccaaatacagcagtgagttctgaaagccttagtgctgggatggttagcctgcccagaatcaggattggcattgcccaaaacaaagaggccttatcttcttaagtcctttgttaggagcatagtgagagagaggcttttttcggacaaaaatgggtccagttcccacccttcattcgggtcttctcaccaggtgcatgcggccttgtgggatatgaagccatctctgtgtcccaaaccaaagaggatgccgccatgaggagaaaccatggtttctctactgagctttagggtttgatgtccttaggtcttccctgagctggccatggcgttgtctgaaaacatgaaacacataaagcctgtgtctctggttttttcttattttgccttccctttgttttttctgtttgtttccatgctaacaaaaattgccagtgctgcatgcatccttagaaactgaattctgctgttagtgtattaacgttctctcatgtagctcctgggagtggaagtcccctcttcttccagtctcaacacagagggcaaatgtgggtggttcaacttccagtgccattagtagtagtagtagtagtagtagtagtagtagtattgcagtggctgtctgactaatctagacgcatacatgaaaacgttttcagagtgtagggacccaaccacaagaccttctagtcttccccatgttcctaatagtgtaagcaacttccaacaaggataagactcaccctcagatggtgacaagggggcccatattgacctgtgaatctcctggccccaagaagatgtccaaaaaataagcatgatcttgatttaaaattgtggtaggcattgagatagtattattctagtcataatgcagacagtcaccaattgacacaaggatatctatatatagatacgatatgtatatgtatgtatatccatatagatatatctgtatataaatatctttctgtcagttgacgaattgtttgcattatatatgtaaccacagtatacaccagtttgtgtcaattggtgacttgtattgacacaaagatatctatatagagatactagatatagatagataatctgtatatagatatttttgtgtcatttggtgactgtctgcattatgtaactaaaaattagacttatggaactcaaaatttcccctagaggtaatgttttccctggaggcaatgttctaaatagtggttctgtttccagctggccaacatttcctgctcaatatataatatagctaaaatttataggagcagaagataactgctggaaactatagaactgtttctggaaaaactgtgctccctcgagaaacactgaaactcaagataggaggaacatttctcccacgttctccttactgtagtttcaggaacagaaaagactttagttcgcatcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaagaggacacccttcccacctcccgccaccatggtaaccattggtgtgtctgcagcattttagtccagagcttgctcgggcaccaccagcacagataaagtgtcagaaaatccattgttagagagcatttctgtgagtctttcccccttttctgcattgtacaagcaggtcaccaatctccatgttgacatttcctccatccccctccgcaggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcattttaaaacaataattaaaatataactgtaatgacagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgagcatggttgtgcatatctgtaatcccagcaactgggaggcagaagcaagagaactgcttgaacctgggagacagaggttgcagtgagccgagatggtgccacagcactccagcctgggtgacagagtgagactctgtctcaaaaaaaaaaaaaaaaagaaattgcaatatggactgtggtttaaatgatcatatcaggctgggtgcagtggctcacacctgtaatcccagcactttgggaggcaagggtggtcagatcacttgaggtcaggcattcgagaccagcctggccaacatgttgaaaccccgtctctactaaaaatatggaaaattagccgggtgtagtggcacgtacctgtaatcccagcttctcgggaggctgaggtggaagaatcgcttgagcccaggaggcggaggttgcagtgagccgagatggtaccacagcactccagcctgggtgacagagtgagactccatctaaaagaaaaatgtagatatgaaagataatatttttgctcttaggaaatacaccttgaagtgttatggggtaaatgggcatgatatttgcaacccattctcaaatggttcagaaaaaaatgtttttatgttcatagaatgataaaacaaatgtagcaaaatgtcaagtattgataagcttcgttaaagggtatacagtagttctttgtactattcttgcaccttttctgtaagtttaaaattgtttcagaataaaagctaaaacatatataaaatggaataaatcaaatgtttaaaaggcagctacaaaaatcttaggaagcaatgtttattattaatcgctttgtcgttattgagaatgtgcatagtaccaagtgctcaggagattttcattcggttattcctcatggcaaactttgttggaacagcatggtatctccacattggcaggtgtgagaataaggcacagtgaggttgataaattttccaaaagtcacacacagccagcagtaaagccaagactggagattttagacccagatactgagtcacgtaaggcacccaggaggagtggccatgtggagaatgcggagagagttcgaggacctctcagcggcacggtagcaacctctttatcaggtccccatccatcccagtgacttgactggtcagcatggcctgaatttgcaaattgcatgttaacaaaagcaaaatagtttcaaaccatatttttaatagtgtcaaaggaaattgatttgtcattctgagaataaaggacataaacatgaaaaactgaatcccagattgctctgaagcactgtaaaatccctcataaacaggagcactgagaaataatacaaattaaaaattttaaaaataggcgtagcttattaattgggattcatggaggaatttaccctacggagtgaatacaccctgcggagtatgactctgacctctcttaggctggaaatgctgcctaattgaggaataaatttcttaggtaaaaactaattcttttatcctgattggattttctgtaataatccttaaaaattaagaaactgtctcattgaaaacagtaagtatttttcaagtcagtttgccaaaaaaaaagaaaatagttacaaaaaaaaaagttaccaggatataaaaaaaagtaggatccaacatagtatatagagaatgaggttaattatacacatataaatatgcatgtagaaaaaaaagtgactggaaggaaatgcacctaaatattaacagtgcacgaataattacttgattcaacctcacagtcatggctttagttaaaggagactcaactacttcgcccagtgccacccagaaggacagtggctgaaataataggacctgtctctcccaatgttcccaccagtgacctggaagttcaaatccagagtgtcccacaaaatgatttgggtgtttgtttgtttttaaggaaaatgaacaggcggaaaagatgaacatcagcctggctttcttcttgtatgaccttctctccctcatggatcggggctttgtgtttaacctcatcagacattattgcagccaggtgagtgtcccccccacccccacccccgagcgagccacttggttccttctcatataatgtgatgttcgttgccatggcacgctgtcttcttcattactgagttggcatgaatcctacacatcctgtgttttgcagcacgtccctcatgtctgtgccatggacattcctcagacatgctggtttaccttgattcctggagcatttaccgacagtgtagaagggtcaacagattcatctgtgggaattaaaatttgtgatatgatctgaatcttcaatttgacattcaacagaaaattaacatggctatacagtgctttcagtctttgacaagtccttgcgctcccagtctgaggtctcttttcacatattagggtaattaattaaattgctgttgtgatgctccgacttgaaagaacctttttaaagtgttcttaaataaaatcattcaaagagatttaatttcactgagcacatagcaaatatttcataaaccaagtgcatctatcagtgccatccccccagatttttaaatggaattattcatgtgctgtctccctcaaactaccttaacaatagtaatataaatagcagttattgttgctgctcctctccttccatatccctaatctagccactagtaccatcattactgctactactaccaccagccaccaccattctcattagtcccatgcccactatcaccaccttctccaccatcaccacctcccaccacctccaccacctccaccatcaccaccacctccaccatcaccaccaccacctccaccatcaccacctccttcaccatcaccatcaccaccacctccaccatcaccaccaccacctccaccaccaccagcatcttcaccatcaccaccacctccaccatcaccaccaccaccacctccaccatcaccacctccttcaccatcaccatcaccaccacctccactatcaccaccacctccaccatcaccaccacctccaccatcaccaccacctccaccatcaccaccacttccttcaccaccaccaccatcttcaccgtcaccaccacctccaccaccaccacctcctccaccaccaccacctcctccaccatcaccacctccttcaccatcaccatcaccaccacctccaccatcaccaccaccacctccaccatcaccaccacctccaccaccaccagcatcttcaccatcaccaccacccacctccttcaccatcaccaccacctccaccatcaccaccaccacctccaccatcaccaccacctccaccaccaccagcatcttcaccatcaccaccaccacctccaccatcaccaccacctccaccatcaccaccaccacctccaccaccatcaccaccacctccaccatcaccaccacctccaccaccaccagcatcttcaccatcaccaccacctccaccaccaccaccacctccaccatcaccaccaccacctccaccaccaccagcatcttcaccatcaccaccacctccaccaccaccaccacctccaccatcaccaccacctccaccatcaccaccacctccaccatcaccatcaccaccacctccaccatcaccacctcctccaccatcaccaccacctccaccaccaccacctcccccactaccaacagctccttcaccatcaccacaacatccaccaccaccatcaccaccaccaccaccacctcctccaccatcaccacctcctccaccaccaccaccattagctccaccatgaccacctccttcacctccaccatcacttcttccaccatcatcattgtcaccatcatcaccaccaccacctccaccaccatcaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagcttcattgagcagcacttggacagggttacataagagcggaagcccctcccagcatgagaacagccataggcctgcagtgaggaggggaccatccagaggagcaggggaactcccaggggagaggaggattagggcagaagcttatagatctgggtgaggctgctccacagcacagtagggagtctctgggtcagagagctccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcctccaaaaaaagaaaaagacatgacttttctaaaggaagtcctgtctacagccataccaccctgaacgcacgcagtctcatctaagggaagtcctgataaggaagcagaataataaaaaagaatcctaaggaaacatcagaagtccccaagcatccccatcccatgcaccctgacccctgccctgcagcggatcttctgtcccaggacccaccagaatagaatggcagagggacacttcactcctccttgccctccctcttcagtatttaggattccaggttagtctgttttcaaaactttaagttgagtgtatgaaagataccctagatcaccactgcagacccaggcttagctactcacatgcaggctatcttcattcccgacagggaaataaggcaacccaaggtagatatctgccttccctgcaaaactcatgtttttattttctctttctctttcctttcttttctcttgctcactatctttctccttaaattcttcccttttcttttagttaccatttctttttttgtttctctccttgactcaaatgccaaagatccctagaccaggagtcaagaagcctgcatgctgattcctgggacaccattaattacttctgtgattgggagcatcagcctttgaggcattcatttcctcatctgcaaaaaaactaggctggattagatttatccactgattctgtggtctgtgtctgccagtgacatccacggatgttacttagcaccattagtggcactcaggcctcagaaggtcactgacccccattcgtggtgatttaattcattgatcccagctctctagatacaggatgaacttcataccttaagcaagttgtattcttacaaagtcgtctgactttatcattttgcataacctattatgttttctgccatctaaagattttgtggcaatggatataaccttagtcttttttaatagtcactaaaaatagacaaatccatttcctcaattactgtctgtcacttacaatgtgccactaagcaaacacccatcccttgggtaggggcattgtgggtcttgacctttgggaaggaagtttttggaatgcaccttactcctcttttcaaaacatcactcaaattgtttttgaaatgtctattttttttcttttgagatggagtcttactctgttgcccaggccagagtgcagtggcacaattttggctcactgcaaactccgcctcacaggttcaagcgattctccttcctcaccctcccgagtagctgggattacaggtgtgtggcaccactccccgctaatttttgcatttttagtagagacagggtttcaccatgttggccagactggtcttgaactctggcctcaagtgatctgcctgcctctgcctcccgaagtgctgggattacaggtgtgagccaccacacccagcctgaaatgtctgtcttgaatgatgtctcaagggacctatgaaagatacccatagtggggccttcttttaagtgccaatgtgttgtgggttcaagttccgatagccggcttgacccgacacctgttaatgagtaacctaagtgacaggcacatgaccaagttctaatcccttcaatgtgctggtggctccactggtccaaagtcagccaggagtgcacatcgaaaggttatgggatctggtaactgtgcttacatagaagtcatatgttttggttttaaaataatatataatggcatttacttattttaagtggatgtctaactatgaattaattctgtaggcaatatgtcccacaacacattggcttcttgtaaaatggctgaaaatatgtgttcatttaaattatattgtttagtctgtaatcccagcactttgggaggccaaggcgggaggatcacctgaggccaggagttcgagaccagcttggccaatatggttaaaccccatctctactaaaaatacaaaaaattagctgggcatgttgatgtgcacctgtaatcccagctactcgggaggctgaggcaagagaatcgcttgaacctgggagatgaaggttgcagtgagccgagatcatgccactgcactccagttcaacagagcaagactctgtatctctctctctctctctctctctctctctctctctatatatatatatatatatatatacatatatatatatgtgtatatatatatgtgtatatatatatatgtatatatatatatatgtgtatatatatatatgtgtatatatatatatatatagtttaaaaaacaaactactcttgaagtgagtgaagaggaggcatgtctatcacaaggatgatgcttcatatttctgtgctggggtggggggtgataatgatgaaatattgaggagctcaaggtgcatcagcgccccttccttcccctattttgcctttagaggagctgcctctgagtctgggtctttcagttgttcagcttgcctgggggaagcaaggggtctcttccagacagtcacctttttctgcttttcattgcttgcttcatggtttattttttaaaggaagatttttcctaaaaactcttctagctttctttctctttcttctccatttcctcctctctcagtctgggacaagctccttgagttttttgcaggtactatgtactttgctaaacagtttgatgcctttctctagggaactggttctacaactttccaatggggcctttaattagaaactacgagagaacacttgtagtataaaagtcatctagtcatattctattagtttcatacaggctcatatgaggtcaactcctttcatttagtttctcgaacatagtagagtttttgtaaaattaattatgttacggtgaagatgtacctcaagattttcagcacaggcttcccatggtattaaagatttgataaagtggaaatcgggataagaatcctcattctggacagctactaggctagaatcactaaggggaacagtaatgaatgaaaatttattagacctctctgtaatgcagaatttaccatctgttgcactatcccattagtttttattaaattgattgccttaacctggagagaaaggatatttttgtgtctgccaacctcaactccacttaccttgtaataaatgtttcattcctcttttcatttttcttcccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaagaattattcaagctatttcatttaactagctcagtttaatcatgtatttcctataaaggttagtcttattaatttgacaaaaaatcaaacaattcaaaccagatcaagtatgctaccctgaagttacaccactagctaagaattaacaatctaagtaattggtttctccccaggctcaaggctccctgatcaggttaagtaaagccaagaatccaataagccctatgaaatttagaaactcatagaaaagtctcaaatcttcctttgtctgacattagccaattgttatattatgcaaatagaggattccaaagtaaataagttttggaaaccatgtattcaccaggtttctttgcagcaggccctctaagaggttttaacttgttcatgtcaattgcaaatgcacgagaagcagaagaggaaatgggaggaggtgtgcatgataagcagtgattccccaaatgatttaacatggaaaccccaccccacctcatacattttttgaaatgttactctggaataactttaagaacatgctgtttgatagtcacattccatttatagggaacacatcagtagctcagagcatcaggcaaaatttctcattattaggttatatttctgttgcatattccttgatactagtacaaaagtgaaggcttgtcttactaattgaaaaaaaaatcttagccatatatgccatatggcatgatccagatattagctacatgaccatcttactgtgaacagggaaagatctgactcacaagcagcaattcaaaatgtataaactttttgctccatcctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccggtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaaaaaaaaaaaagaaggtacctgagtaagcagggccttaaacaaagggggcatttggttacagaggaattgcctgttcccagccccaggactgggtgaggttcttatttctctgtccaacttttatgctaggatttttatcttcagcttttgatttcaggtgggaaagggagcgtcattcatttttcaacagacccggggtgctttattttcatctttcccgctgggcagtcttctctctgtgggtatgggaaagtgcagtaaccactctgtgcctcagtttccttgtccgccttatctggcaccagagtacctacctcactggggagggctcacgaagcctggctggggcgaggactcagtaaacactggccatcgctattttcattccagttcttgtggctcataaaatggctccttacgtttctgtagaactcaagctcctgctccagcttccaggaccagaagatcgccagcatgttcgatctgacttccgagtaccgccagcagcacttcctcaccgggctcctcttcacagaactggctgctgccctggatgccgaaggggaagggtatgtttctggcatttaaaatggaagatgaagccaaaaaaacagatgttctttaataaaatttgcagtctagcttctcacacttggtaaaaaactctactgtagttgaccagttctgaggagtagaaacatctgtcttgagaatatggtacccataagcacaaggcacaagaaaggcctttcttgtgtagaaaggcaccagggatgggtaagaactacaaaatgacttttcttggtcaactatttcagtggaatttaccagttctgctatagcaggtttcccaaggatgctttgattagtgaactccctaggagcaaagccatttttaacaaaggggatagcatgcagaggcaaccacaagatgtcacttggttcaaagctgatgaaggaaataatggctgctgagaaggcagctgtcccatgcccagattaggtttcttgcagacagtgcttctcaggccaagagacaccacacatccagggcttctgaatccttttacctcttatctatctgattactcagggacatgtggcagtatctagcctagaagtcaacagacagagaggtagaccacccccttctttccttctctccctatgctccgtgagctcatggagtcagaaacccacagcctatctgattggactgaaaaagataatgccttctaaaatattattcattccgttcaacaattattgaatgccttccatgggacagacacagttaggtgttagagtacatcagagatatatcagtgcacaaaacagacaaaattcgctgcccctcaagagctcaccatccagggactcagattcaaagatgattaggattgcaaagtagttgagattcaacacttctggtgtttagattaggcatacagaattgcaggaacttgcccactattccataacagagaacgaaatctaaagccatggtcttcccagtcccttcccaggacccactctcctataccaaaccatctccctgcacagggaacctgttcccatgactcctatgctaaagaggtttccagaataatgtttgctaattaatggtagcattgctgtatgttatggatggatttttatctaaatggaatttctcaagttctctcaaagtgcttacaatttagtgaaggaaacaggaggttcctgcatgaaacaaatacaggagcacatcgagttcgtgcaactgcaacagtcacatgtgtcccaagctatgtacccaggctgacaccgctgaagtgactctatgtctgcgtctcctggcaggatagtgtggggaatctcatgcttttagctctcaattctgcctccttccagataaactggcctgagtatatcctttgagaacttcactttccatggcttcaattctatcttctcttctcaactctaactaaatttctcccaattatctcagtagaatgttctaccctacaactaacataaatttccacagcaacaaaaagtgcaccgaacacttatgctaataagtaagatactgagaagaaagtttgaacacaaagaaaattgccttcatgcacaaacatgtacatacattttcttagttgtcctttaatagcagtactttaagtgatttctagaaacatctttagtatttacaatagcgtagtttctattttctattttcattctagctggaaacagccatgacattctgttctggattccttgtaaaattgttgctgttatattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgctgggttgtcagttactctcctggaaagtcattagatacactgtcacaacttcatcatgtaagctaaaacctcagaaaaatgtcatgcttcaacaatacttcctattgatcagcacttcctttttttttttcttttgcttccaagacagttggtagacttgccaacacctgtacatccatggggcaagggccagaaggacgcatctcagtacctgaacccctagggagctacagctccagtttccactgggtttcccttggatctctgacacctgggtatatccacaagtgtctatgcatcgttaaatccacagtgtttttcaagcatttagaaattgtctatcatctttgtgttaagccagcaaattgcaatgcctaattcaaaacacaacccattgccgggaccacagactaagaacaagaaaaacttttgaaatgcaatttacaattatcttactttagccacagtgcaagagtctgagtcatttaaaattttggttaatattttctatataacgttgaattctgatgtagccttattttgtttgaaagaaaaaaatgtatatatatgtatatattttttaaatctggattctttttttattattatcatactttaagttctagggtacatgtatacaacatgcaggtttgttacatatgtatatatgcgccatgttggtgtgctgcacccattaactcgtcatttacattaggtatatctcctaatgctgtccctccccactccccccaccccatgacagtccccggtgtgtgatgttcccacctatgagtgagaacatgcggtgtttggttttctgtccttgcgatagtttgctgagaatgacggttttcagcttcatccatgtccctacaaaggacatgaactcatccttttttatggctgcatagtattccatggtgtatatgtgccacattttcttaatccagtctaccattgatggacatttgggttggttccaagtctttgctattgtgaatagtgccgcaataaaaggattataaatcatgctgctataaagacatatgcacacatatgtttattgcggcaagatgtatatttttaaaattgaacatctatgactaggttccagatactccactatatattttatttactttttattatagtataatttatataaagaacctgaatcctaagtgtaaagtgcgattaatatttcctgtgaatatatttgagtaaccaccagtcagataaaaaatataatattccattatcctctctcagttacaggcccccctcaagtaaccactattctgactcttattattagaaattaatactgcctgttgttgaatttcatagtcttttgctgaatgttgtgactgtgacatcctttagtgtggtcgcatgtgtcagtattcattttttttcaactgtatgtcatattcctttgtctactataatttctcttctgtaaattgacatttgggctgctttctatttgtgggtattgggtattatgaaaacagctgccgtgaacatgcctgtgcatggttttgggtggacgttagaactcatttctttggggctataaatacagcctattttttattttaatatactgctcttgaatagtttaataaatatgtgtacatggtcttaacaaaatgtcaaaagaatatactctgagctaggaaaagaagagcaaacaagtcaaagcaggaagatggcagggaataacaaaggtgatagccaaaataaatgaaataaagaatagaaaaacaatcacggaaatccgcaagatgaaaagcttgttatttgaaaagagcaacaaaattcaccaatctttagctgagctgaccaagaaaaaaggaagaagactcaattactaaaatcataattgaaagattcaacacaatcatatcacaagagaccttacagaaataaaaaggattataaaagaatacgatgaacaattgaaagccatcaaattgataacctagattaaatggataaattccttaaaaggtacaaagtactaaaattgactccaagaagatatagaaaatccaaatagacctacagaagtaaaaagattgagttagtaatcaaacttcccacatacacctactatgtacccacacaaattaaaaatttaggctgggcgcagtggctcatacctgtaatcccagcactttgggtggccaaggcgagtggatcacctgaggtcaagagttcaagaccagcctggccaaggtgatgaaaccccgtctctactaaaaatacaaaaattagctgggtgtggtggcgggaacctgtaatcccatctactcgggaggctgaggcagaagaatcatttgagactggaaggcagaggttgcagtgagccaagatcatgccaatgcactccagcctgggcaacaagagcaaaactccatcacaaataataataataataataatatattttaaaatttaaaacttcctacaataaaagctcaaacctggggggctttactgatgaattctaccaaatatttttaaaagaattaattctaattttttaccaacttccagtcttctcttccaacgaatggaagaggtggaatacttccccacttgttctatgaagctagcattaccctatactaaaccagacaaagacatcatgagaaaactacaggccagtatctgatgaatatagatgtaagaccctcaacaaacactagcaaactgaatccaacagcatataaaaaggattatacaccatggctaagtaggatttatctcaggaatgcaagataggctgcatacctgaaaatcaattgttgtaccatattaataaaataaaggacaaaacccatacaatcatcttagtagatgcaaagaaaagcatttaataaaatctaataacgcttcctgataaaaacactcaacaaaccttttaggaaataagagaacttcctcaacttgacttaagggcctctatgaaaaatccacagctaatgtgacacttattagtgaaaaacagtgctttatccctaagattaggaacaagacaaaaatgtctacccttgccacttctattcaacatattaggagttctatctagggcaattaggcaaaaaaataaaacaaaagacatctaggccaggcgtggtggctcacgcctgtaatcccagcactttgggaggccaaagtggacagatcgctttgagcccaggagactgagaacaccctgagcaacatggcaaaacgccatctctacaagaaatacaaaaattagctgggcattggtggcttgtgtttgtagtcccagctacttgggaggttgaggctggagaattgcttgatcccagaaagcggaggttgtagtgagctgagatcacgctactgcactccagcctgggccacagagtaagaccctgtctcaaaaaaaaaaaaaaaaagaaaaagaagaaaagaaaagaaagcatttaaattggaaaagaagtaaaactatctctattcataggtggcataatcttgtttatagaaaaccataaggaatccacaaaaaactccattacaactaataaatgaattcagcagtgttgcatggtataagatcaacatacaagaatcaattgtgtttctatacacttacgatgagcaatctgaaaatgaaattaagaaaacaatttcatataaaatagcatcacaaagaaaaaatatttaggaataaatgtaacaaaagaaacacaagagttatacactaaaaatgacaaaacactgttgaaagaaagatataaataaatggaggatatcatatgttcatgaatcagaagacttattattaaaatagcaatactccccaaattgatccatagattaaatgcagttcttctcagaattctagcttgcttttttttttttttggcagaaattagcaaactgatcctaaaattcgtgtggaaattcaagggacccagtatagccaaaacaaccttgaaaaacaagaacaaaattggaggactcacacttcccaatttcaaaacttactacaaagcaaaagtagtcaagactatggggttctgacatatgatagacatatagatcaatgaaattgggttaagagtccaaaaataaatcttcatatttatagtcaattgatttttgacaagagtgccaaaacaattcaatgggggaaaatagaattttcaataaatggtgttgggacaactgggtatccacactcaaaagaatgaagttggaccctatattacactgtatacaaaaactaactcaaatagatcaaagacctaaatgtaagagctaaaactataaaattgttacataaaattatagaggtaatcatcatagacttagaaaaggcagtggtttcttagatatgacacactcgaaagtatgagtaacaagaaaaaaatagataactggacttcagtaaaattaaaacttttgtgatttataggacaccatcaaaaaaatgaaaaggcaacacacaaaatgggagaaaatatttgcaaatcaaaaacctaataggggacttgtatctggaatatatattttaaaatcttacaactcagtaataaaaagacaaataactcagttttttaaaaggcaaaagatcagaatagacatttctccaaagaagatacagccataagaccatgaagatgttcagcatcattagccgtcagggagatgcatattaaaatcacaattaaataccacttgatacccacgaagatggatataataaaaaagacaggtaataaagtgttggcaagaataaaatggagtcttcagacactgctggtgggaatgtaaaattgtgcagccaccgttgaaaacaacttgctgattcctctaaaagttaaacagaggctgggcgctcggcggctcacgcctataatctcagcactttgggaggctgaggtgggcagatcatttgaggccaggagttcgagaccagcctggccaagatggtgaaaccctgtctctactaaaaatacaaaaattagccaggtgtggtggcaggtgcctgtagtccccgctacttgggaggctgagtcagaagaattgcttgaacccaggaggtggaggttgcagtgagccgagatcgtgtcattgcactccagcctgaacaactccatgtcaaaaaaaaaaaaaagttaaacagacagttaccatacaagccagcaaatgtactctgaggtatgtacccaagaaaagtaaaacttaaaacttgtatacacatactcatagcagcgttggtaagtcacaatagctcaaaagcagaaacaatccaaatgtttatcagttgatgaatggataaaattcaccaatggaatattatttagcaataaaaaggaatgaagtactgatgctacaatatgataaacttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgatatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagcagagaaatattgcccttggcactaagtgactaattttgaggttaatatgtctagattagcaacaagatgaaaggataagttgtcttaaaggggttttgtgaaaccccagaatctatttacaaattacattgtggattaaggaatgtagagggaaaaaaatcctcccaaatagaagaacttcttatgttgacctgagaaaggcagtccattggcctaccctctccacagcgtacgtgtgtgtgcacgtgtgtgcgcgcgtgcacacacacacacacacaattcctatcccatcagagtagttcttgcttttcctccagctcaagggaagttttggaaatgtccatgctgctctcttggcagctgaagggtgctgggatctgggcaatgcttccctgagccagcctctttatagtcagtcatccttgaaatcttggaaccatccaggttttcccacctcctccaaatggaaagtgtcatgtgtgactaaattgtttataatactattacggtgacaagtatttagttcatgaaaatgggaccaaacgcctatagtctttaattcatacaaatcataaaatgaaaagcaagtattcctgtggaagtaattctctcctttcttgaaaaaaatcctctagcaaactgctaatggagtaactcagaagagaaaggttgagacaggggttagggtttgtagagttctgttggggccagagtgcaaggaaatgatagaaacaagctcagcacacagggctgagcaagctgcaccatgaggtcagcagcttcctctagcagcgcctgattgcgcggaattgaaaatggagttgtttttaacatttacagacataatgcagagcatggcatgtgacttgtagcccattttgagaatccttgatggcaagtttctaaaaagttccatttcaagagcttgcttgttcccaaagccaggaaccactttagcacacattatccgaagttttcttgtcaattagaatattccgtatcagtgactcggaatcagaacttttcaacatttggtctccaagccttttaaacctcaaagacttctttgtatatgcgttgaactttatgatcatgatgtagctgatgagagaaaaaaacagtgaaaagtattttattgttataggttacacagtacatctattaaatatggaatctttaggttgataaactcataagaatacagtctttcaaaaagatgcatctgaattcagattccagccccatttattaatataagtgacctttgaaaggctcaacctttccgtgccttcctttcctctgtaaactataaaaatgtgataacgatgtctaccttttaggtttacgataaaggtgaaactagagaacttctataaaagcattttgcacagcacatgtttgtatctttcccgatttttcttgtaactataaccctatggcaattaaggggaaataagaatgtgtctctatgttagttgtgataatgttatcaggtcttgcataatttccatgtgctgtttatttaaccatttgtttaaaatcccaatggccttaataagtatttctaaaaattgggttttggctcggtgtggtggctcacccctgtaatcccagcactttgggaggccaaggtggacagatcacttgaggccaggggttcaagaccagcctggccaacatggcgaaaccctgtctccactaaaaatacaaaagttagccaggcgtggtggcgcacctgtaatcccagctactcgggaggctgaggtaggaggatggaggggcagagattgcagtgagcggagatggcgccactgcactccagcctggatgatagtgtgagactttgtctaaaaataaataaataaataaataataagaactgggttttgttttcacaactttagtagaagaaatgttatttacactcaaatttttctaaataattgaaggcccagatggctgtaatgtcaacaggtctagaaaaacatgaatttttaggaaaacatgagtgaatcaatcagttgtgaatgttttaccacacttttcccagaactgcttgaaatattaatagtttttgattgtatactggtagcattcttaaaaaccagacttttaaacggtttatcgtttttttgcttgcatacatctagacctatctataaatatgggtatgtctatattacatagatacaataaattgacattcattttaaacatttgaaatatgacaaattattgctgaacttgtgataatagcttattattctatataaggtagttgcttaattctgtaattgtaggtgtcttctatttggtcattatttaaaataatgccaattattagaatagagaatgaagtttaaaaaattatgttacaggaaacaattatggaaggtttgaaaactttttgttcacacaatttgaaaaattaatttctagcctaatcttgtgctagacattgtctcttagcctgctgtgttttcctataggtgatagcagatacataatgctaaacatcaggtttgaaattactgtgctgactttagtgactgagaagtatcagtctcttattgggtaggggacatggggaaatgtcatgtttgacttgacatcacaaacgatgttttcattgcagttgcagatactcgcagataccgcaccagtggctcggatgaagaacaagaaggagccggtgccattaaccagaatgtggctctggccatagcagggaataatttcaatttgaaaacaagtggaatagtgctgtcttccttggtatgttggtgcacatgtgtctggttgatttttcatttcatgtcttctgtcttctgttttgttttgtttgtttgtttgttttgagacagagtctcactctgttgcacaggctggagtgcagtggcgcaatctcagttcactgcaacctccgcctcccgggttcttcatgcctcagcctcctgattagctgggattacaggcgtgcaccaccacacctggctaattttttttgtatcttttagtagagacggggtttcgccatgttggccaggctggtctcaaactcccaacctcagatggtacacccacctcagcctcccaaagtgctgggattacaggcgtgagccactgtgcccagcctcttctgtcatcttctgatgggagaactcagcttagagcaggcattgattatttccgcctcattttgctggaaagaatcattgtgaggctggcagctgaggtgcacacaagtcagaaagggttctggcaacagcaagagatgtgcagatcaaattcaggcagtcccagtggtgctgagttcaagttcaagaaaccggaaaagaggaaaacttgggaaatctgaaatccttgcaaaggagatcaaaccaaggctctctgagggtggaggcttaggctgtgttcagtctatgtgtgtgtaattcatacagtgtaatgcctccaaaaaaaaagactgaaggaggctggtagcttagcgtaagggcttcttaaacaagactgcagcttttctaggaccccagggagcctaaggagggttgtttggctctgtccttttgcatggactctgtgggctcaaagaggggctcctctgggaatgtatcctctgattcagttgaggtgggattcatctctgttcattgatgagctctgactatcccttgtgaagacagcactgcatcctccaatgtcatttactttcacatttcaatgtagggtatagatgtgcagagaatttaactttcttctcccgtgagaaagcagcatcctgacctaactcttcttgctggatgactttcttgtcttccttcctgcacttagcaagctccatcaccatgaggattggggggacagtgaggcaggaagatgagacagagaaaagacatttgagatttgacatcaccgatcttactgttggagaaatattgtgtgacctcctccacctttctaatatccgtcttaccaaagttagctgcttgaggtggtatatgccttttacattatttgcctctaagggaaaaactcaaaagcccaaagttcacctgttagaacatagtccttgtgaggttgtatctcaagatttcctttattcttgtcaacaaactcagaataactaaagttaaagttgctttataacctctattatttccatccaaaactaacatttccctcccatacccacaaattcctcattgcaatttcaccagtacattccactggatattagctacgctgcatgaaccaagggtgcagcctcattgttgttgtttgtgttgatgagatgagtaacagagagtgcgctcagcactttaaaatgaatacttgtggccaaaatattaaagcaaatagcctgaacccccacaccccagccccaggcaaacataaattatggttaaacttccattacagagaactccacaaacatggatttgattaatttgctgagcagttcatgacccttatgttatactttgcactatgtaacaaagaagctaaatcttgaacagcaagcttattcatggcacccagccagtttccttctcccctgtaagtctaaccctctgctgcccagcacgaaggagaaatacttggagatcttagcagcatgaaagcctctttgtatcactgggattgcagcacgcatgatcaaggcccaggggtgatcaccaggccacactgctcctaagacagaggtactcagatacgtggctgaaagcctagctcaaatactgccccaggtgagcctctttgctgagtagcgctactcaaagaacacagcttcccctgcctagggaaggcagggctactggcaatagatctccagcctagcagtgatgtacagtcatggtattttaagagaacactttgaatttttctgttgcttgactgttaagcctcaaatttttctgttgcttgacttcttccctggcctccatcccccaatctgcctcccttcagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataaggtaagtctggagtggcacaactttataccagctcttatctctcaattgcaattctgtcttcttactcatcccctttgtttgggccatggaggcatcattaatttttctcatttctgtattcaaatccataacccatttgtaggtatagatatgatcatttcacagggaaaggatctctgccttctgcagagagaaccccatttctgttgacagagttttggcccataggatgctccagagcagcatctcagtgaagcacatgtcaaacttagctggcatcactgtggagtgtactgttttggtaactctccccatcaacggagatctcaccaaaggacatgtcctcctacctctgtcttgtccagggaaaacagagttctgacaaagtcagtacccaagtcctgcagaagtcaagggatgtcaaggcccggctggaagaggctttgctccgtggggaaggggccagaggggagatgatgcgccgccgggctccaggtgtgttggactggcccttccctgctctctgtcaagcagtttttcactgtttgtggggaggaatgtcctcccaacatgattagacaccattactttcttgagatatttacggtagtgtcagagacagcggattctgggagtctgtgtgtgacatttgtgttagccctgtgcctgtgagggaaagcgctgttctacaattgtaggaaccctgaaaacagcaccaaatgacatcttttaattaaaactcgttgatggtaaaaggtcacctctaagaatgtcagtcatggatgaggtggaaggtgtttccctcaaggctgaggcctttctatgtgacctttggctagtctatccggagcatggtcaagaaactgaacagttctggccccaagatcatcttctcgatcattcagggcactattagaatggaaccagttccctgaaatggcttcagagtgtcccagtcattcaaggattccaccacaggaggaatgatctcaaaaaggctgagcttgaatagaatgaaatccccaggtaccctcagtcttattcaccatgctcaaagtaaaacagagtgacagcttattgtattcgaagggacacagtggcagggaacttggagggagctcatagttttcagtggtggtcaggcaccctcatttgacacccatactttcatacccaataattcagtaagcccccagagtttcacaggaatcctctgctcatgagaaatgtctctctgacactcagaaaggcagaggttcttcttatattctagtctatcaatcaaagagcgggccaacttggacataggtgtggcgactttgtctcctaccagcaacctgcatggactctaattagcccgagaaatggtgctgaggcttctcagttgagcttgttatgaacttctggttatcttggagggtttcatgctaatcaaattcctatcatgcatttcttaactcctagggaacgaccgatttccaggcctaaatgaaaatttgagatggaagaaagagcagacacattggcggcaagctaatgagaagctagataagtgagtcactcggcaactttctgctacttttacctaaagtccaaaactatttttcccaggctgcttgtattactgaaacaactgcatccttccaagggttagaaaatgaaacatcattatctgtgtaaatacaattcatccagggacccaggataatcaaaggtatagggagttgtggtttccagctcttaaaaatttgtcacattgataagcatgtaaagaaaactaatatttctttagcaacctcagatggcttaataaaagcagctgattttgcagggagggtagcagggaaatagagaaagcaggacacggtgcctaggaccgtatactttcaaatcgatatttcctttctggaaatatgtacaagatatacattcagatatatttatgtcagtgctacttaaagttgttttttaaaattgaaaacattctaaatgctccagaatagaaaaatatatttaaaagttggattgccatcaaaatgttttaaaatcatcttaatgacatggggaaatgcttatgacataatgttaaatgaacaaaggcagggtagacacttggttttctagtagtgtgtggctcacgcctgtaatcccagcactttgggaggctgaggccggtggaacacctgaggtcagtagttcgagactagcctggccaacatggtgaaaccccgtctctacaaaaaatagaaaaattagctgggcatgatggcagatgcctgtaatcccagctactcaggaggctgaggaggaagagtcgcttgaacccgggaggcagaggttgcagtgagccaagatcgtgccattgcactccagcctgggtgacagagcaagactccatctcaaaaaaaaaaaaaaaaaaagaacctcaaatctctgatgacatatagtcaatgtattttttaaaggctagaaggaaatttaccaaaatattaattgcggttttctttgggtgctgggaatatcggtaattgatgttttctcttttatactttgctatgtttcctacagtagatgtgtattataatatatattgttaccagaaaaaaaattataaagaaatgaaagaataaaaaaacctgtttggatcaaaatctatgctatagatgaatagatatattgacgtgtattgctatatatgcaacaatttagacatatgaaagctaaaagtatatatgtttgactagatagcacatgtttccgataccgtttagccacaggtagcctaatgagtcccagggtttgctgagcaaaatgtcgtagagctaaaatcacccctcacacacagttgacaaggtaggataccccatgggtgatgaagcacccatcaaagggggtatggggcagacttgattagcagtgctgttttgtaaataaatgtgagttaatatctttattgttaccacaagaatgaatcattctggttaacttatgggactttggggagtcacatttattttaaaacattaaagaaataagtatatttttattatagatgtgacttggaaacccagttgttggtatcatgcctatttgctttgggtatgttattcttgcactaaattccctggactgatttataaaatacttggatcggagagtccatacattctacttcgggcaatgaacaacaactacaaaatatgcatgccgtgggtgctacagaattgcttaggtggtttagctcatctactctactagattaaaagaagacccctaagtaggcctgttttgcctgggctgtgtaaactggtgttttggaaaacctttcccttttgcttgcaggagcaacacaatattggtccttaccacgcatggcctaccggtttgctctaggttagttctcagccctgcgctacctggtgggctgctggttgtcagagctaatgattcacatctacaaattctcaggggctttgtgctttttttttttttttaaaagggaaaccatagtaaaattataactgttcaacctacctacctggaaaatttataattataataatggtgtctttcaccctctttctgatcatttttcgattattttggctctgtttcttttagagcaatgatcttcaacttaggctgcacattagaatcacctggggagctttaaaacctgtcagtgcccagctgcaccctagactacttcaattggaaactccagcaggacccagaaatcagtatttggtaaaacttcccaggtgattctattgccaccaaatccattgttttaaaggaatagatggtaagcttttcttttcttttttttttcttttctttttttgagacaaggtctcactctgtcacccaggctggaatacagtggcacaatcacagctcactgcagccttaccctcctggcctcaaacaatcctcccacctcagcctcccaagtagatgggactacaggtgtgtaccaccacaactgcttactttttgtattttttgtagagacagggtttcaccatgttgcccaggctggtctaaaactcctgggctcaagtgatccacctgttttaacctcccaaagtggtgggattacaggcatgagccactgcgcctggtcagatggtaaagcttttaaaaaaccagattagtgttagtgatggttgcacaatatgaatgtacttaacactactgaactgtatacttacaaatggttaagatggtaaatttttatgttaggtgtactttatcacaatacaaaaatttgggaaaaaacagattaggacactctagatttgtgctgtccaatacagtagccattagccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcaattaattaaaaaggatgataaggggccgggcacagtggctcacacctgtaatcccagcactttgggaggccgaggtaagtggatcacgaggtcaggagatcgagaccatcctggctaacgcggcgaaaccccgtctctactaaaaatacaaaaaagtagccgggcgcggtggcgggcgcctgtagtcccagctactcgggaggctgaagcaggagaatggcgtgaacccgggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatataaaaatttgatggctcatgcctgtggtcccagatactcaggaggctaaggcagagcatcacttgagcccaggagttcgaggcttcagtgagctatgatagtgccactgcactctagcctgggtgatagagcaagaccctgtctctaaggaaaaaaaaaaaaaaaaacttttagatttcatttattttacacatatattatcacttggaaaatgagaaaaagtgtcaagtggcttgggaccagagagcctatcctaaacatgaaaacaagtaaaacacacagaagtacttattttttgagtcctcagtggtatgtaagcagctgcagtgcccccattattaggttaatgggacgcaagaacaggtaagtggtaaccctggcccaggacatatgagctgatataatgataccccaaccccatggtaacatcttggctactgaggcatcttggtaaagtcaattcttcatacctccctttccttgcaactagatttggatgatgatacaaaatatccctttacagcttcacttagatttcataagaatggatgggctagcaaaaaaaaccattctgattccttaaagtgaaacctaatagaggagcgagcaccaggcaatttcccattccctagtgggcaatgaccagtaatgtccggcaggatattagatcacctgccctacaggaatacagtcttgtttcccaatggaaaaggacgaaagaccccacgcacttggctgagcaacctcaaggtgatctttgggaagttaagaggctgactctcccctgacttggctctgaagctccaccctttcctaacccagccgcatcactgccaagttcacatcacatccagtctcactctctctcgcatgttgcaggggcttccccttactcagatctagcaatggttttcatgcgtgaaatacagccatggccctgaggctttaggcaacaatctgagaggggagcttaattgctagtagcaactaataactgcttctctacccatagtgttatttttataattgtcctcatcattattaataatagtggggatgaggatgaccaggaaaccttacctagacagttgtttcgacaagacatgaatcacagaaggcacctgcactgtagttactcagggccagttgctctgttttcatttcaaggttgactattttggagatttctttacaccttggtgtatagattgccatcatgggaacctggccaggtttgacatgcgctttaatttgacctcttgttgtttcctagaacaaaggccgagttagatcaagaagccttgatcagtggcaatctggctacagaagcacatttaatcatcctggatatgcaggaaaacattatccaggtgaggaaaacaaacacccaatctgatttgttggccatgaatatgtttactagaataaggacttctttatgcaaaattgtgaaagacataaatgtgatcccatagtaccttttttaaaaaaatgaagttgagaagtttactatttacaacagtgtctaccttataaattccagagataccaaacattcttctggcttctttgacttagggcttacttggagagggttaggtgtttggccagctgaccctcttggttaaatctgtgtgagtatgtaccaagtttataatatggatgttgggtttatcgtttagtatctagaacagtagtggtaagtagaattttttctgatgggtcaactccagttgaatgatggtcactgtctgatatgggagctatgattatgactaggctaggtaaaaagagtgctaaatttgacaaatgatgtcttctttggacttaaatttgttaaggaaagtcatttgtaccatgaatttgccatccctgctgtagaaaaatatagctttgtgaactttgtaccatactaattttatcttctatgtgattatttccacaaattcccaagctgtctaggtaataatgagtttttaattaccctgaaaaatgagttcttacatgtttccattgagaagtcattcattagagtaggtccaggattgcttttagggctagaagaaatatcgttgaaacacagtgaaatcttaattctctaacttttgaattgtctaaaatcaaagtaatcatcatacaaaaataaacacaaaaagtatgtgatatttttgttgactttaatatctttgataacttaaatgcttggtatcacatttaccttatctttatatagcacaatattaggtgccaaatatctatactagcccccaaatatatttgcagttttcaaagaaagctgaaaccttttgttattatccttggtgttgttagtccttctgtaggtgataaacaagcttctatttagaaacattgctgccaccaagcagcccctgttgtactgggaagcccacaattgtgttttgcatcccataaggaaagctatgtcttgtatacaaagaaagaactttccaaaagatgtgacccaggatgagggagatgggccttataccttcatttaggaacccagaattaggtataaatcccaaactcattggaagcattgaaataaagccatttggaaataggtcttcagttcccatggttaatggatgatacccatggtggctcaccaaactcttaagactcaccactggacatggaacatcagcattactgagctaattgtcaggaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaaggtaaacttgggatgcttgttttcttcctcttaattaagagtaagattctcatctagcttcatacttctctcttcaggtggaccaaaagtcacagagcatattaagtggcatcacagtaaaggtcttaagtcttcctaggaagaaagcagatgccctgattctgtgggaagccaccatggagaggaaaagcagtggctcccatatttgaagtgtggacctaactctagaagtttaaaatggccattcgctgaaggtctatgacatgagaacagagatcaactgagtgacttagcaatttcactctttctctgtaatacctctgctgagtgagattaaatcctctatgtgacgcccattagtcttacaaaatgtcatgccataaaatgccaggaaggtcagaaatgaatttctcacggcctgaggaatgaggattatcctggggtaacatgcagattatttttccctttatttatttatttatttatttttgagactgagtctcgctctatcgcccaggctggagtgcagtggtaccatctcagctcactgcagcctctgcgccctgggctcaagcgattctcatgcctcagcctcctgagtattgggattataggcgtgtgccaccgcacccagctaatttttgtattattagtagagacagggtttcaccatgttggccaggctggtcttgaactcctgacctcaagtgatccacctgcctcagcctcccaaagcactgggattacaggcgtgagcccccgttcctggcctatttttccctttattgaagatctcaattggtgccttctacatggggtcttttaaatttaaaaagtaaaattcttctgctcatccttctcaggaccattttctctttcttcatcaccagtaatttcccaggaacccaagaaactcaggtttccttccatcatagttgtgatttcaccagtgaatgcgacctggctcacagtgcagttgataacacagctctgacccttttagctggacagttcattattaaatctcaagtctactccattgcttaaatccatcttctgattcacatagctcattatctttatggaataatgcattaactcttctaggctttttgcttgtccaaatggacatttgcatatttcaacggtccagaaagtgtatcaaactgccaagtgatgcctaatggccctttatgtctctcctagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtgtaagagttcaaaccagctgagtgacctggaatcagtagagaaaaattgatgtaaagcatcagctgcgaaaaaaaataaggaaattttgcagtattgcagtttacttctgtcctgtgagaaagaaacaattgagtatgtagatagatagcagcttccattttaatttgcatctaaaagtgaattcatcagataaatgcagtggtctctatcagtgtgtttctaaaatagacagccaggggccaggaacgatggctttcacctataatcccagcactttgggaggccgaggtgagtggatcatttgaagtcaggagttcaagactagcctggccagcatggtgaaatcctgtctctactataaatacaaaaatagccagatgtgttggcgcatgcctgtaatccaagctacttgggaggctgaggcaggagaattgcttgaacctgggaggcagatattgcagtgagccgagattgccccatttcactccagcctggacaacagagtgagacttcatttcaaaaaataataataataaaataaaataaccaggtgcagtggctcatgtctgtaatcctagcacttcgggaggccaaggcaggcagatcagatgaggccaggagtccaagactagcctggccaacatggtgaaacccccgtctctacaatacaaaaaattagccgggtgtggtggcacacacgcccgtaatcttagctactggggaggctgaggcacgagaatcgcttgaacccaggaggcagaggttgtagtgagccaagattgtgccactgtattccagcctgagaccctgtctcaaaaaaaaaaaaagaaagaaagaaatggaagagtattttagattaaaagttatcatctgtgggggaaaaaatacaatagacaggttagaattcagaagagtgtttcctgtttctaaattctgactagctagtgccagaatgacctgtggaagaggattttaaatgatcggtgtcatctaacctgagttttattttaatattttatttatttatttattgagacagtgtcttgctctgtcacccaggctggagtgtagtggcactatcagagctcactgcagccttcaactcctgggctcaaatgatcctcctacttcagcctcccatgtagtaactgggattacaggcacgagccaccttacccagctaattttttttgcatttttgttgagacagggtcttgctgcatgcccaggctggtctagaacacctgagctcaagtgatcttccctcctcagccccccaaagtactgagattataggcatgagccatcctgcctagccaagacttgagttttattcaaagctacgaagactttggagttcagctttattatagaacagtcaagtttgctttagtttgtctagattttgataccttctttggaatttccatttgtggccatgttaataagtatgctcaagtgatatataaagataaattggcccatggaaaaaagtcagcctcctccaaatgtattagggatgattatttaaaagacattcctcaggggaccttgaggtagccatgtttttccatgggcctgtaaagaaagaagaaacaaaaccttgttgcttacccggagttcaaaatctcagaaatgctggccacagaagtcccctgatttatttatttagagacagggtctcgctctgtcaccgtggctggagtgcagtggcgagatcttggcccactgcaacctctgcctaccaggtttaagcaattctcctgcctcagcctctcgagtagctggaattacaggtgtccaccaccatgcccagctaatttttgtatttttagtagaggcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacaaaaggatatactgtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattgagagaagaggaaataattaagacggggcaaaggaaacactgaggagttgtttgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtacaccgaagcacataccttgtctcatgcatgagtttgggatctgccaactattgtgtatgtatgtatgtacatatatacacaatttatatataaatatataacatttgcaagtatttattgtccaatatgcatgtgctctcagcactctgagaggttttaaaaagaaatacatccatcactgtccccagtctcaatatgctaacagtctatttggagtgctcagtctcaaaacaattaggaggcagtacaagacaagtgatacataagtgcaaactgtgtggtaaggagctaaatgctatggaaggttagaggaagagaggtcgtgatcaataaacaatctggtggccaggaaagcctgcagggagggatgacactaaaggctggggtaggattccgctaggcaggggaaaagtgagggggaaattgtgagtagttgaaacaatgaattgtttgtatctgtagggatggtaaagggaccagcttgtctggtgaggggtaaggaagggccgagtttgagagagcttgtaaacaaggttgtcctaaggaaatgtgtaaggacagtcatctcttccatgtccattacgatgaccgtggaactctagcctgtcccatttgtcttttaactccagctcctagcctgctctatggtagggtcttaattaagtgagaatgaatgaatgaatgttttcttttattcccttagtctgagaaccctatttccggagtctgttttgccctctcgggcaatgttgcatcctcattctcagaatctttttcctctcctctacatcaaatcgttcctctctcatttcatcttgaccatactcctttagttccatcatttatatagaggtattcaccaacaagaccaatcaaactatgggcagtttaataaaggtcttcagtgccttcacccaatgaaatgactctagtggtagaaattttaggagccctggcaagctggcagaggggaacggggataagacaacattctgtggctgagttacctgccagggtctctagatcaagccatagtctctccctgtttttgtactgcaggctcccctggacctccactgttggttttataattaagaataaatgattacaagaggttctaaaatctctgaagccctgggaagatccaggaggcttctgagacatggaactcaagctgaggtcctaagctgcttcctacttggtataaaaatccctgatattccagagtagagtttagaacttttcaggttacaaataactgaaactggttcaaactaatttaaacaaaaatgttggagatagagatagtatgaggattcaggcagatttctggatctcaagggccaacacacatccaggtctcataaactcctgggctggcgaagatgaaaactacagagtcaggtctagatgactccgccatccctagtctctgctgccctctgatccaacccttcccatggcttccccttgcatttcaatgtaatcctaactcttcacctgggactacaaagctaagattattttgaggcttacactttttgcaggtggaggaacttctctgtaatctgaatagcatcttatatgacacagtgaaaatgagggaatttcaggaagatcctgagatgcttatggatctcatgtacaggtaagctttcctgacacactcaagggacaccatttgggggtcgaggatttgtcactgtggagttcttactaatgtaatgatcacagctaacatggatatagtgatttggatgatagccaaataatatatagaaattaaacattcagagtaggttaattcatatgtaagttttcagaaggatctccctaatttaaagtgaggcataataatgttattaaatataataacattattaaatataataacactatcttctacttaccacagaatcagagaaagaataattaactgttataggaattattttccatatgcttttgttccaattatattcagacatacatatatagttttactttagaaatcattttttacgcgtagtttaaaagttggtcttccagtccttgttcaggagaaattacttacagaggcaaaattgttctgatgcaacatcatacaaagggcagtacttttgtcttctgttttattttgagagaaaggaaagaaaaggcagaaatttgcctgagagccattaaaatagacatcatgttatcaggtattttttccccataaggcttttactaagtactatttcttggaggtcagcacagcttaaacatggaataaaaatagttggactaataaatgttttcttctgtctcgttttctggaaatatagggcaaaatctcaggtggaggggtacagggaactcttggggagaaaaaaagaaaaggtcacacaaagtagaagaacagtgtcattaacccactgtcctcaaaactacttctcactcaatctgtcttcagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccaggtagggtgtgtgcagcttttcccttagagcagtggttctcaactggggcgattttgtcccccagccccagggacatttggcaatgtctagatacatttttggttatcacaactgggatgggtgagtaggtgctactggcatctgactggtagaagccaggatgctgtgaaacattctgcaataggagagctcccctgacaaagaattgtctggccccaaatgtctgtagtgctaaggttgaaaaattccaagttcatacattacatttgcttcttctaattgctttcccatcgtcgttgggttttttttaaattactgtttacaataatggcacctagccattattaatagcactttaggagacatttgcaaacactttcacatgcatggcttcatttgaacctccccgtaaagctgtgaggcaggtaggtagggaaggcggttattattcccacttcgcggatgagagaactgagagagcaagttttctaaggtcacttaaactctttttcaaagacttgtagttgacacagtatactgacattgtgaaagtttggaaaacattggataaatgattttcctcctggcccattcatttgattccactcttcaactttataggggcccactctccaatccaaaaatcaagaaagaatcaaattgacctgagaagggagacaaaaggctgaatcagtaccttcttaggataagctgaaaattacccacatttggcaaagggaaattgtctgccagacctaaaagctggctcggatggggatgctcagtggccacttaaagtgttcttactgaatagtttaatagtctttagagagagagaaaataaaaaagcacaatgttgggtactttttttgtaagagacatagtttgtagagatgaccatccctgaaaccatgaacaatatagctacagtaatagagtgtttttcaagccagactcacgaagtcatttacaagggtttgtattattcttgtttgaatttacatggctgattttatgaaaagctttgttcttgttattgttcttcaacacaattttgtgatgttgtatgaaccagaaagaaagaacaattcaaagtagcttccccaggcttagagaataagtcactgaaactatgctggtgcagccaagagcttctggttttccagaacacagcaaagctgggtattgcctcctatgaataactcctcctttcttatggtcctcaagaacaaaaatagtcattctgtgatttcatgcttggcaaatgaattttcttcttaattcagaaatgtttgttataaaagctgataattaaatctcatccaaaagcataaaaataacacctgatttcaaatcacatagaagtgtacaagaaagttataaaagttattttagatgtatttgcttcttttctcaaatttattttgaccatgtgatactatcaaaaataaatattatagtactactctttcaattcccaggaaattgtaaggtttagcacttcatattgtttcatttactaaattattttatacttcttttattccttttcccatgactatattttattttatatttatcacttaaatatcaattgcatttcattattgacttttatatttagtaagccttactgttctaattttacctagaattcagttgatttgctaataatgacatgccaaagtgaatcattattacacaatcaacagaaatattccacattattccgacatgggggcatacagctctatctgttcacatatatttatccattgattccttcttttagagaatatttattgaatacttattctgtcctcatgaacgttacattctaaccagagagacgtaatataactaattattccaatctttgttcagttataattatgagaaatactgttataaagaggcacaagatattgtgagcatttatggtccaggccctgtgggtcagggaagggtgaagaaggtgaaaaggaaggcagaagaaactgaagtgtgagggcttcttgatgtagaggaggcaatgagttaggtgttgtcagctacagaagagaagccaaattatattaatgtgtatgagtgaattcttacttctctcaaatgggacataccaaatcaatttggaaatgtagctggcaagtgaaaggacacccaacccagactgacagaaggtaaaaatggaatttatcagcccgtctgaggaatgtgagcctggagtagcacctgccatactggacctaggggcccaaacaatgtcagcagagctcactgtcatcaccacttcccatctctgccatctgttgtgtcagcttcattcttcacaggcttcccacaccacagtttaggtttacatctctaggttcaagtctaggagagaagagagatgcctcctttctagcagttgcagagaaagcctcagtgcatcttactgatcctgtctgaacatctgatcctgtgctcatccctgaaccagccatactggccagagaaatggagtgctctgatttactgaccccgggtcatgggtccacacctggaattatgggtgatttcttcccctaaatcaggatgccttactttatagaaggaggaaagaattctagacagcattaacaacagatgtccagtgttgattttgcaaatgctctgtgctttaattttcaaccttgttctgctccaatgaaatagagcttttggaaaagatttataaactagagataaataaatatgtgcaaggaaaataactttgaggtcactgaattccaggaaactgagatcactgaaattctgtgtcccagagtgcaatatttatttcacaactgtagatacggacacattcttagatactgctgttacttgtacctccctgatcctgaagccaagaaagtctgcagaatccttttcctctgactacagctaatgaggctacatagcttcaaatctgttcctctaatgtggaaaattgcatacattctaatagtattagtatcttgggttattaaatgctttcaactgaatttcttggatcttctgttgtcacagaaacatcataatacatagggcaggtttggaagaaagactggccacaaaggctttgagagcctcctcctatattcctaaaactacgttacagtattgcatgtgaagagatagggctatctatgacaactatgtcctgactgattgctaaggttgattcacatgatcttgctaaccaggccagaaggcagacagcttttagttcacaagccaactctgatcagttagtagtggctgactggagaactatgcttaagaatttcgagactatgtccaagctctggggaaaaagtgctacagttgattagttatgcctgccatgattacagcaataggaaggagtggcatgtgtgccacctgtttgtaatccctaaactgggaaggtttcccatttcttctgtttttcatatgcatttcttccatagctgtgagctaggaagaaaatgattcttgacctgtcacatattcactgccagggccagtgctagggtgaagaggcactcaccctcagggtcgagcgggtacaagatcagtacttccatggccctaaaagcgagtacctctctaaattttgtcttgggtttctcatttggttcaccccaaccatggtctctgcatgctctgctagaggctctaaacgcaatagtttatgtaaaggaaacaaatgcatggaaacaaaatgttcaggaagaacaaaaacacacacacagtaactgctgcaatgccatgaaaacttccttaatgaagacagcctcgcttgctgttgtcgtatgtcatggctgtttatctgagtcaactccagagtagcaacatacttcagaaaaacaccactgtaagtcagaggtccactcggtgaaacagggagcctagttaatgttaattgggtctttgccttttgaaaaccaggacaccagccctatgtcccttagggttgtttcactaaagtaactcagctgttgtgacattgaggtaagtgtcctttatacaaaatctcctaatggttaaaaagaaaaacgtgaggtttgaagaccagttgctcagtgcgcctcttctaaatgaatggcagacagatactctcggggtagaattacagacctagtttagtcacggtcttggtaaggatctgcacaccagcttcctcgtttccccattcggggttcctgtggtctcttactagtctggtcgccctgttctccaggcttatactgtggtctctttcagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacggtcagtgcccagagggcatcccggggcctggcctcccatactccagctggacttggggtgctgggaacacctggtcttaatggcccagtcagccccacttcccgaggacacgtgccagggtgtgcggggcaggggatgggcccggggaggactttgatgtatgcaaattgcatgagcttcccaagggagctgagataacctttcatcacagtgccgatctgagcttcactgtatgctcattggttgggcagcagtttcacagtattatttctatttaataggggtggaactaagccacagagaggtgaaatggcctgcccagggttacacaataaatgatgaggcatgttttcactccctcgtttttcctctcagagagaaaaaaattagggaggaaccactgggaggagagaggaggaatacacagacagtgtcttccctcctagccactgtgcagtctgaaggaccatcacagaccaggaccagcttacagaaatgtgggcacagaaaccactgagactcctctggttaacgtaatctggatctaaacactcctagtatatatactagaaaaatatatagagagatgaagtcattgagattcagggcaaagaggaaacactcttgtctattttcttttctttttttgagacagagtctagctctgtcgcccaggctggaatgcagtggtgcaatcatggctcactgcagcctctacctccagggttcaagcaactctcctgcctcagcctcatgagtagctgggattacaggtgtgcaccaccacactcggccaattttttgtatttttagaggagacaggatttcaccctgttggccaggctggtctcaaactcctggcctcaagtgatctgcccatcttggcctcccaaagtgctggaactacaggtgtgagccaccacgcccaacttgttttcattttaataatctccctcctcctttacattttaagccaagaaagtattcagtactttactatatttagctgacccaattttgttttcatctatactatactcatccttattttccagtttttatttccaagtttcctctctacaattttatttattttaattattgttttaactgtcttctctctattcttgctttccttttcaagattcagaaaatgtctaatatactctcatttttcctcaaactcaacaaaatgaattagaatcctactaactctttggaggcatacatttagcatctggctagaggaggacctctgatgaaatttaaatatactaaaactgcctttctgaattgctgttagtccctgctaccaaacttctctcctgttttttcttttcgttttgttttgtttttgtttttgtttttgaggcagcgtcttgccttgtcacccaggctggagtgcagtgatgcagccttggctcactacagccttgacctcctgggctcagcctcccacctcaaccgcccaagtagctgaggctacaggagcatgctaccacacctggctgattttttaatttttttgcagagatggggtctccctatggtgtctaggatgatctgaacttctgggttcaagtgatcctcctgcctcagcctcccaaagtgctgggattacaggcatgagccactgcactcagccagtatttttttttcccccgaaagctcttctccttacttatcgccatacaggactacttagcgaggtgtctagttcagtttgaaggctaccactgtcccaaaagtgctcagataccccttcttgccctgtgaaatactgtgatacaacaataaattcactctccagcacattgtttggacaatgacctctggttgctcttcttaagtttccagtggattaaattctctctgatgctcttctcctctttccaagggaggcttatatgagacagttaatgaggtctacaagctggtcatccccatcctagaagcgcatcgagaattccggaagctgacactcactcacagcaagctgcagagagccttcgacagcatcgttaacaaggtagccggggagcctggctggcaggtcttgttacctggtggcaggcgaccctgtcctacagatgcttagccatccttcctctccagggagtgatttatctttagcacattgcttttgctctcacctgtcaaacagaaaagggctgaaattcttctaacagaggaccaaaattccatatgtgaaaacatacagcttaaattactttataaccaggaaatgtgagaaatttttaagtgtaattaaaagaagtcccagaaatctttcatgggattccttttgttgttatttctgaagtttattccataagcattaaatttttttaaggagtaatttctgtttacatcagccataggagtaaaatgctttgttaacacaatgagagacccctgccctttgcaactcagtggctcctcaggatgacataactaaggagagctttttatattttgttcctcaggatcataagagaatgtttggaacctacttccgagttggtttctttggatccaaatttggggatttggatgaacaggagtttgtctacaaagagcctgcaattaccaagcttcctgagatctcacatagactagaggtaagaaaagtgattctgtgcgcctgacctggtacactttacaaaaacaagttagagtgggtcatcaccaaaaataaacaaataaagagttatggattcatcattgatctctacataaagttttcccctttgcatttataaaaggcaaagtagaaaggtattaggtgagatcatgaggtgatgtaatattttgatagtttttccctaatactctgtgtatgcttttcacagtttggaattttatatggtgaatatttattttgaagtctgtgcaaaattcaatcaaggtcatgtgctttcttatcaccctttccaaatattagtagtttatactagtagatagagagtagtagagtttttcaacatgaagtttagcatcttgactttgaagtaatctagccaaatgactgaatcacccctagataatggtgaggccatcctttaggtatcactggatggcacctggggtccttctgatgtggagctactcagctgtggccagcccggctccaacctgccagtgagtgacatttggtccataatacaacagaaaagtgtagcatgttgttagaagcaaagctgaaagcatggagaaaaagagaaacagcctagagaaaggtcaggacaaaagaaacacaggttataagggccaaacactaagaactcagtcaaaggtgcctccccgatgggatttggatgaacaggaatttgtttacaaagagcctgcaattaccaagcaggactggggtcctttgaactgctcacaattaaccaaagattcactccttaggctttcattgctttgaatttgtgccctcctatgagtgtaaaacttaaaacatttgtgttgcctaatggcttcgtacactctccatccatgccaaaaaagacaagagggtttatccttacttgactcaaagaagccattgcccagggtggctgggtgagttgccccaaaattgtttagcacatgagaaaaagagctagcaattgaccccagtccacttggttccctatattgtttcccctacttagaattagaggtatatattttatcttcttgtgcactgtgatttgccacaatatgggaaggctggtgacttccaagttcccagggtacagaaggcgagaagtaaagagtgtgataccccaggagatacctcagcaaatataatgatgttagctgaattagaggccaagcatacatcttatagggaagcatataccagttgacagtgctatttttatttttgtcttaggaaatgctgaactttgctcattagctcagaggaactctcaataatcagtgaacatcattctaccttgcacttgctccaaacttatttcacttccaagaagacaaagagttgcattatgttaaaataacctttataaactgttggttcttcttacctaggcattttatggtcaatgttttggtgcagaatttgtggaagtgattaaagactccactcctgtggacaaaaccaagttggatcctaacaaggtatacaaaaatttacaaaaactaaccatcaagctctaaatcccttcgttctctacccaagaatacctaatgatctcatctatctggactctccaagtcacttaaatgcagtcaaaccttttcgtctagagttcaactactaattggtcagatcttaaagaaaatatagtcaaaggcaggaatcataataggagctaccacttattaagcaccaactgtgtacctggaactgcattaggccctctacatacatcattttatttcatcctgcaacgacccctggaagtagattttgtcattcctattttagagatgagaaaactgagacatggaagagtcaagcaagtttcaaggtcatgcaagcagcagagccagtactcagacttgaggtctgttgcttctgaacccctactcttcagcactgctctttactgcctttttataaaacctttaaactctccatttcaaactcgacaacacttagtggcttccttctttaggctgcaagtattccttccatccaagtccgggatcactgtgctgttgggggaatggtaaaaacggcttgggtttgggtttcctcactttcacaagagggtatgttccatttcaccccaaaatgggtgtacagttctgatgctaacacgtggaggtggtatcagctcccacagggtaaaggctcagtcctcctcaagactgccctgacttcagatgccagcttcaagagggacccccaggccagccacgcttctgatcagccagctacaaatttgggagtttctataacctgttagcttgaaaataggagaaaacaaagcaaataataataataataataataataataatttgggagtttctatgatacctgttagattaaataattcactacaatgactcacagaattccaaaaagtactctggttactatcagagtattatgataaagggtgaacatctttttgtgcctttatttatggcttcctggctcatcagtgtgttctccaaccaggaagctccgccaagtctcagtgtccagagattttgttggggtttcattatgtaggcaaattgaatacagtctccagcccctctcctgtctccagaggtcatccagttcctaccctgtaatcacagaattggtctttttggtggccacttggcatcctgaagctatccaggggcccagcatgagtcacctcattagcatcacaaagacacccatcactgaggaaattctaagtgtttctaaagctctgtgctaggaaatggagacaaagaccagacatattctttattataccacaagctgatgctgcccactcagcccaactcacatgtccatgaatgagctttctaagttactggaaatagtgcaagtgcaaggtatcattaagggccctgggacagaggaccattcaccatctagcaaacctataaaatgaaaggtccaaactcccagttccatcttccaggatatgaagaagataatggaagaggggaagaattggccaaattgaagagtttgtttttctacatttttcagaatgctttctcacttaagacacattccctagcctcggcttgaaagcagtggctgtggtaagagtttaactaatcttcagacacacatgtctgggagatggagttggccgtgtgcccacagtgatctgtacatagcacaagctgtgtaaaatgtgacctccctcagccaaggtgcccttttcccctcttttaaaattcccagggtaggttgtgagagtttggaatgagagtctgaacccagagttacaaccagatttcattatactaagtcgtgatttacagtctgaggtcagtgaccccactcatccctttcagtgggtgagtgtcccagcatctgaactcatggtcactttttttcctaagagattgtcgtctttaatgagtacttattcgctctgtgtttgagggtggaggtgatgtgagtgtgtgtttaaatgaggcctaggcagtaaaattcagttttggtgtttagttctatgagttttgacaaacacatgtgactaccttcataaccaagatatagaacagatccaccactccaaaatacttcccgtgcccattggtagtccatgttgcaatagttccttcctttccgttgctgagtagtattctgttgtgtgactacctcaccatttgcttgttaattccccactggagtgacatttgggttgtttctagtctttgttatgaataaagttgctggagacatttgtgtacaggtttttgtatggacataagctttcatttctctcctgtacacacataggagtggggttgctgggtccaatggtagtgcagtttaactgcataagagaccgccagcttcttctgcaaagtagctgtgcattttgcattcccaccctctgtgtatgacagctctagctgatctccatccttgccagcacttgatattgttagttttctttagttcggccattcatgcttcctcataactgtgaggtagtcattgtcattctgtaaaggaaagtttgtctctttggaatagcagtttgcaaactctcataccaaggcttccactgtggatcagtttgctctgctaggaaggtgcggccggtggccctcactctccccacaggcacattcccctctccctccttgcagccccttctgtccttgggggtggagaggaggaacttctgctggccacattctcccctgcatctgtagcttttctgcactgggcagggcggtgccggcacgccgtgttcctgcatgcccctccattgcgtcagggatggccgtttgcagaatagctcatcttctccctccgtgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagttatatctttagtataagtgtgtttatgtatttaattataatatttaatatatatttcaattataaacttgtacaacagatatatttaccttttaaatattttatataaaatttttctatatttcaaagcttagaggtgattcaagcatagtcgtgctgttaattattggagacgggacctgcacgtgggcagccccagtgaggcggtggtgtgctgtgggaaagggccgtgtaaggtagacaagttcactgactagcttctagtcctagcttcctcctgtgattttaaacaagctacgtaccttcagtttcttcatctatgcattagcaggaaagacctctaagtacagtacaagattatactcattttattaataaaaggactggtcaagaaggtctctcaaaccacagaattgttcaaaattctacacaccataaacaacttattattctttaaaacacatatatatacacttatttgtcgtcctttttatgcagggccacagacttctctgtgactgtgggtttgctgatcacaattcagcattttcttttataaaccacacccgtagtgctttgtccatgattttcagttttgctttgtgtaagcagagtgagagcttaaagatccttgttaaacaatttgagagcagaagccttctggatgtttatgatgtttttctccccgagactttgacagcagtcttgtgcacacctaatatgacaggaatttttatagcaactcactttcataatatcttgtccaaccatttggcttggttttcatagaaagaaatctttttctttccacacccatggttcatcagtttctccattatctaattagattgggtcattaaaataacaagtataacaggcataatcaagttggtgaacaaacacagatgaattgtggtgaatatatacctcatcaggcagaagcagaaatagctgagctaactggagagtcatccagcaggtagtgttcagctgggtaaccacatcagggtgtggctttcacagaagctgaagaaagcctgaagcagtgactcagtcgggaggaggtgggtttagaagccatctgctgtacttcctatacttcttggtttggacttttgaacactgagacattctaggcataacacagatataaactcatggtgcccaaaagcatttcaaaaccttttcttttcttcattcctgccttcctttcctttccttcctttcctttcgttcttcctttttttctgtgtctctgtctctctttctctctttttcatttttgagacaggatcttcctctgttgccctagagtgcagtggcatgaacatggctcactgcagcctcgacctcctgggctcgagcaattttcctacctcagcctcctgtgtagctgggactacaggcttgtgccaccatgcccagctaattaaaaatacagagagatatatattttgtaagagacaggggtcttactttgttgcccagtctggtctcaaactgttggcctcaaacgatcctcctacctcagcctcccaaggtgctgggattacaagtgtgagccactgcaccagcctgaagttttcttggccttccttcgttccccaacaacctcaacaacagttctcagctgtttgctagggctgtagaacaaagttccatagactgggtggcttaaacaactgaaatttactgtctgcacaattctagaggctagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctcgtaaggacaccagtcatattggactagggcttaccctgctggcctcattttaacttgattgcctctgtaaagaccctatctccaaagaaggtcacattctgaggtactgaaggttaggacttcgacatatacattttgggggaacacaattcaacctataaaattcagaaaagactctaccccaaaccagcagaacttagcaaatagattgattgacccttaaaagaattccatttactggaaattcaccctcagttggagaaggcacaggtgatatcaaaagcctgtgttatgatgggggagaaaatcttgagtgctgtgcttctactacagctttctgcattgtaagttgagtaacatgaggctgtgtgcggtggctcttgcctgtaatcccagcactttgggaggccgaggcagggggattgcctaaggttgggagtttgagaccagcctggccaacatagagaaaccgcatctctactaaaaatacaaaattatctgggtgtggtggtgcatgcctgtaatcccagctacttgggaggctgaggcaggagaattgcttgaacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacctcctcccttactacctgtggcattctgtggaacttaaccttacaaatccccctttgactgtaaaatggagagtataaagaggttgttgagaggaataaatgctaaatgtatgtaaagttcctggaacataaggaatcaagaaatgttaggcccatctttctttttaacctgttaagagtattttaaattactctgaaagtctttccctagctgcctcttcaaattcaggtggcctctctgtcatagctccaggcttgtccatagcttatgagaccagacagtgacttccctatgtttacgtctcatgttcagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcaggtaagcaaaaccagaggtggcagctcctctggttcttattatttaggttgtcattatacgtctgcacccttcttccttggggttgatgaggactttgatccatagacaaacacagaaatgttcctacacttaacctgaacacctgtaaggtttagaagacttttaggaaacctcttccctttcatgtaacaaccccaggtaaaaaagaaatcctagagatgagtggaccaggctttaaggagtaccactttctcagaggagtctccacttcggggccagacctgacaatatgatgcaaatctggagtcatgttgaagaatgcttagtcatgaccaattcacgcagagtaattgcagggcttgagactcacctacaaatgcctataggagagaaggaaaaggatctagaacatccaactcttggctcagtcagcagatgaacccagcatgccaaggaccttgacaaccaggaatgacctgggacctgacttcttaggctacttcagacaagactagatcttcctatcagacttcttagaacgctgactcccaagttcagcatggtgctcaagcagtctcagatgaagggaggtaccagcctaatacctctgtccagtgggcctccttaattcaaatctagatctgttcttgtccacacttccacggcagttattcagtgagcatcatgagtcttttctcattcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatggaagactttccaagcccacaaccatggtctatctgtacacgatggatatctctgactcaatccagcagttatgcaaaatgatgtttgccatgaaggcaactagataagtgaacaaaaatgaatagatcaaggcaatcctgatttttagaaaagcaactcaaagcacataccatttgatgtagttgtattacacttatatatgaatgaaaatctattattagtagtatttgattgataaaataatattcggcgccaggctcagtggctcatgcctataatcccagcactgtgggaggccgaggtgggtgaatcacttgaggtcaggagtttcagaccagcctggccaacatggtgaaaccccatctctgctaaaaatacaaaaattagccagtgtggtggcaggcgcttgtagtcccagtacttgggaggctgaggcaggagaatcccttgaacccgggaggtggaggttgtagtgagctgagattatgccactgcgctccagcctgagtgacagagtaagactctgtctcaaaaacaacaataaaaaagaaaataaatttgggctgtgtatggtgcgcacgcctgtaatcccagcaatttgggaggctgaggtgggtggatcccttgaggccaggagttcaagaccagcctgggcaatgtggcaaaatcccatcactacaaaaaaatacaaaaatagccaggtatagtggcacacacctgtagtctcagctacttgggaggctgacatgggaggatcacttgagcctgggaagtggaggctgcagtgagcagagatcatgccactgctctctagcctgggtgatagagcgagaccctgtctaaaaaacaaaaacaaaacacacacacacagggaaaatacatttatacttctgagtgttcctctaaaacttcagattcctcctaagaaatcaaaatttcctgagatgtccaagaccttccttatttttttttgtttatttcaaaccaactacaaaattaaatgttcaaactaagaagtcactccaatattttctcccaagcaatttaatttccttcatatatgtatgaatatattcatatatatgtgtgtgtatatatatatacatatatatgcatatacatatacatatgcatatacatatatatgtatgtgtatatatatatgtgtgtgtgtgtatatatatatatatatatatatttttttttttttttttttttttttcccaccagggaccactggaagtagcccaagtgtttttggctgaaattcctgctgatccaaaactctatcgacatcacaacaagttgaggttatgctttaaggaattcatcatgaggtaagaaggaaaatggctgggaatttcagtagagcagtggttctcaaagtgcaatcttagaccagcagcttcagcatcacctgagaacttgctagaaagacaaagtctcaggcaccctccagacctgctgaattggaatctctggaggtgtggctcagcaatgtgcagtttaacccgccctccaggtgatcctgatgcacactgaagtttgaggaccactgcagcagagcaacactacttgaactactaatgagtaactaacacgtcaactatgaaacgcttttgtggctagcatcccgtgtgcctcacaatcacttgttgtaaaacaagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtatgaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttgttttttcagtacataatacgtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatctggctaatttttgtatttttggtagaaatggggtttcaccatgttggccaggctgatcttgaactcctgacctcaaatgatccacctgccttggtctcccaaagtgctgggattacaggcatataccaccgtgcccggccctattttttattttttgtggagacagggtctcactatgccgtctaggctggtcttgaattcctgggctcagagattgggggcttaaaaaaattttttttcatatatttttatttaaaattcattatggttgaatgcttccaaagttgactatgccccaggacctctaaaaggacctatgaaatgtttgaagagcactcactatattccaggcatgatattagttatgggactacagagatctggcttgttcctctgttcttaatgacaggacatagccctgcatggctgaataatagaatgcagcatatgcacagaactttaagaatgactaactacaggactataaagatcagaaaagagaaatcagtttcaggctggagcatttgtgggaggcgttatggaaaaacaccacttaaatcttgtcttgactatatacgtggaagaaaggcgctagtggggaagagggagccaggacagtggccctgcctgatccaaggtatcactttcagctgctttagttacccatggtttgaaagtattacttacaatatgatattcagagagagagagagagaccacattcacataacttttatttcagtatattgctgtaattgttgttaatctcttactctatctaatttgtaaattaagctttatcataggtatgtatgtataggaaaaaaacataatatatgtagggttcggtaccatccgcagtttcaggcatcccctgggggtcttggaacctatccccgagaatgaggaggactgagtaccactgagtggaccagcaggaccacgagactctgtcaggaatgcctgtgatgcaccgggttcctctaagtccagctggagcagcgtgttctcatgagcatgctaggacaaggaggaaagattggaaatatgataatatcagtaaatgaggctctgaatacaatttaaatgtttaagaaaacttgtcaggagagtgattttcatttacttcagtttgcctcaattttttctactagttataaatcttgcaatccagtatctcacgggtatgatcctttccatgacaccacctaggtaaaatgtacttacaaaatccctactaaacatgcgtttctcattagctcccagccccaggaaaagttactccaaaaagaaccagtgcccagtaaaactagtcccaggcaagagatacaagaggaaatggactttcctaggggtcgctcctttaacaaagtcattagagtttcaataatgaggctatcattctccccagatggcctacagaaatgttggattttcaaaatcaaattcaccattttaaagttgttctcctacccttttaatggtgattccacatgggaaccagtcccacctttctccccactggctgggctgctgcattgttctaggaggccaggagactgtccatgcttcccagacttcactgttcttacacgtcacctgaggatttgtcaaaatgcagattttggcctgatgcagtggctccgcctctaatcccagcactttgggaggctgaggtggaaggactgcttgagcccaggagttcaggaccagcctgggcaacatggcgaaactctgtctctttaaaaaaatacaaaaaaatacaaaaatttagccaagcgtggtagtggtgtgtgcctgtagtcccagctactcgagaggctgaggtgcgaggatagcttgagcccgaggaggtcaaggctgcaatgagccatgatcgtgccactgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaataataaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctcctactttgtgccaggcactgtgctacatatgtggaaggatgaagtcccaatatcagtaggacaaggctacagacaaaacagtactgctgctcattattcatctctatgtgcaaacacaacagatggcctgccctccacttcattctacagagatcagaagtcgtgggtgagagtgtgctgatggtgcacaactgtgtaaattactaaaactcatcaaactctaaacataaaatgggtgaatgttacggtatgtaaatcataccctgaatacagatagtagatgaggttcctctgttgcttaattgcttctcaagtccaatctggaagttacagcttttaatgaatagagtaactattttttcacgttgtttgtgctgtgtattttctcctccactctgctaacagacagcagaggtgacgcagaagtggaaaatatttggggcttgaacagctctcaggtttcccctttagtaagctccagcttctcagcagacttgggctgtagatcgataagcccagatttccaaggtgaccataaatgagtctctgttgctgagagctaatagcggaaacatttgcttgccaggtccactgcgtctagtgccaccacggggcagcgacctttctgactcagctgtagtggaagcagaaacagccataaagaatcctggcagcctgatttgctgcagccagtactcatccagccagtcctgcaactcttcaaactgttaccaagctgggacctcaatcagcttctgtcttttcctgcaataataaaaaacatctcgggttcagaagccaagacaagaagatagagagatacaatcttctatcttcctcttctgctcccccaaacaccccgaccatttagatttttaaattttcttctttatacttatctggactttctcattcttataaagactaagtgatgttaaatttgtttttaatttaaataaaagatagtagtactcactggcaccagttacagcttgcctttaagagaagtagtttcagatacaccctgaaagggttctgcagcatatatgtggtcataggctcagaaaacaggctgttgagtggtggcgtttttaaactggagttggggtctatgaagaggaaggagaaggaatttgtccgagtagccaaaggacaaccaaatgtgtagagtgtaggtggaaaaagaagcagtagttttaacttgagaccaaggccatatgcctggcttatagctggaaatggggaaatggctttcctaggcagtatatgtggcgttggggttgggaatatgggcactcaagccagattgcctgagttcagatcccattctgcctcaactagatgtgtgaccctgagaagttacctaccctcggtttccccagatgtaaaatcggaataataattgtacctctcccttgcagttagtgacagaataaaatgagttaatacatggaacttagaataagacttcatacatactaagggatcagtaagtgtaacattgttcagtggggcaaataggggactgatggatttgagtgggaaatagagaattaatctgacttaaatacggagattgtctatccatgatttgtctgtctctataaagtttgaatcataagacacagtgatgctgatgagacattggcctgggagcagcaggattctgggtttatatccagctgtgctgtcccacaggtatgtgactggacagggcacttcacctctttgcatgttagtttcatcaactatgaaataaagagactagaatacagcatctctaatagtttatcattctcatattgtacaaatagttcatttacttagcctgggtctgtcaggcataataacgctaccatgtgctctggcttcagctgtgtgcagggactcttctgaacatttgatatgtttcaactaatttaatctttacattaatttatgaggtaggctcttatcacccacacatcacagatgaagaaactatgacatgaagaggttaagtagcttgtttaaggttgcaaagccagtaagcagcaaagcgggattcagagttgagcactctggctccagagtccatcctcttaattgccatgctgagctgttccctctagtgactatattcagttgctagtaacagaaggaagagtagcttaaataagaaatttatttttctctcacattaaataagattggaggtagtcgatgtagagctgtgtagtggcctcataaagtcatcagagaccctggttcttttccaatcctttgccatgccatcctggttctagtgtacccattctcgtggtcatgatatggttgctagggctccagccatcatgaccacatctaggcaagtcaggagtagaaatgaggaaacagcaaaaagatgtgcccatttcccagtgccttcacctatattatcagcgatccctacctgcatgggaggctaggaagtgtaagttttcaggtggtcacactgcctggagttctgccagtagggaagaaagaatggatattgagaaaacaactaacgaatgtttgtctgccacactgaggaacccatgtatgggctgtgctgaaaaaggggggccaaggctgggtacagtggctacgcctgtaatcccagtactttgggaggctgaggtgggcggatcacttgagctcacaagttcgagaccagcctgggcaacatggcaaaacctcgtctttacaaaaaatacaaaaaaaattaaccgggtgtagtggcgtgcctgtagttccaactgctcgggaagctgaggtgggaggatcacttgagcccaggaggcagaggttgcagtgagctgagatcatgccactgccttccaccctgcatgacagaatgagatcctctctctaaaaatagagggggtaccaagagatgcagggggggtgagggcagcatgactactctctctgtaggagaccttaactctataaatggaggccccaaaatgttactgccatcaaaagccaggaatccttttctggaggcgtaacttcctgccctttctaatccctatcaatctggtttctgtagaactgtgactgctagaaaaccccaggcatatttgttctaagaaaatacttgtgttcggtgaatttaccaacaaagggagcatcagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttttgcattataaaagtttaaagacataaagtaatattactacataaaatctaagttttttactccagctattaatatgtttttctttataaaacatcacatttattaattgctgtgtaacaaactacctcacaatttagtggcttaaaagaaaatttaattattatgcatgtggtacataataatttttgctttcctcatttctactcctgatacttgcctatgatgtggtcatgatggctggggccctagcgaggtgtattgtggccatgagaatggttttgctgcaacttggggttggctgggctcagctaagcagtttttgcctggagtctctcagttgcactgagacagtgactaggacttgaattacctgaatgcttcctcactcatgtctggtgtctgggctgagaatactcaaacagcaggggctcctcctctctctaactctccttctctccacatggtctctcctgcatgacagctttagggtaactagacttgtcacaggatggttcagaactcttatagtacagaacgagagagagacagaggccatattaccttttattagccagtcacacagtaccacctccaccacatcctattcagtgtggctgtcacaaagaaccatccacctcttgatgggggcatgggcaaggttctaggagagcacattcttgtggccattttcagaaatacaatctgctacactccagaagcatctgtttgccttattatcatagcttctgatttaattctcccagcaaccctaggagattatatgagcttattatccccattttccagagaaaattgaagatttttatggttaagtcatcctgctaatgagtagcagcttgtttcaaccgcagttgtctgcatataacacatttaactcagtcaagggcacatggtgagcaatcagaaggtgttagctagctgctgctacttctgcaaacaaagactaaggagagtttagctgattttaccaaagttgtccgagtagacttccccaaattagctgttagctttggcaggactcatcccacctcctgtagcctgccaatgttataaacttgggccttgaagtcatcctgaaactgatcttattttacacatggtggtaattgtaactgttagttaagaagcaataaaaaaataataaggggtgatatagatttctcaggattcaaaggccatatgccttcccttctatttcttccctaaaaccgttaattcataaccttagctatcctataatttgcttcaattaatgacaaacataaaagataggtgaaaatccagttaagggagttctttcagattctgtgtgagttaaatcaagtccttcttctatagcaggctaattccatgatgaagctgtggtgctaagtttatttttgcctaggcaggtagctcttccttgccacatgctatcctcttcctctttgactgtcatcctgaaaatgtgttcagtgttaagaggatttgataacaatgtctgggtatctccataacttagtccaaatctggtaccactgttaggaaaataatgtaagccatattgatcacccacgtcttattcatttgaaggataatatagttattactaattattgcgtgttaggtaacatacagccattattctgtccctttaaggtttattgatttgtaagttcccttgggtagaagagtacaaaacaaaaggcaaaacttcatcatgtttaaataacgtgattttcttctttggtgtgtaccgtaccgtgcaggagacagggaaaacaccaggtttaacggtccacaagccagataaccatgatgagttctaaagattttctctgtctttaatgttcttcagttttgtcatgagaagactggatatagctctgttgttgttcattagaggatttatatctctcttcaactctagaaaattaccagctgttatctctttaaatattgtctccctctcattttccattcccttggagattctattagatgtgggttggatcttccttatatctctatgtttcttaaccaattttttcatatttttttattttttaaatctcattggtgatttccttggatctgtcatacatttacttctccaattatgtctagtctattatttaacctttaacctttccattgagttttttgtcttttagcaactgcatttttttttttttttttttttttttttttggtgagacaaggtctggttctgtcacccaggctggagtgcagtggcatgatcttggctcactgcaacctccacctcccaggctcaagccatcttcccacctcagcttcccaaatagctgggactgcagtcacctgccaccatacccagctaatttttatattttttgtagagatggggttttgccatgttgcccagtctagtctttaacttgtgagctcaggcaatccacccaccttagcttcccaaagtgctgggattacaggcatgaggcaccacacccagcctagtgactgcatttttcttttttctagaagttctgtttggtccttttctgaacttttcctggtctcttttttcattttccctgtttatttgtttttatcatggattttataccttttatttattttctttttttttttctagttacatgattacttaggattttatacattttattacctctctatattaactttggttttttacattgttttattatctctaattcttattggactaattcttttgtttgatgcatctgttagttttccctcgtggtggttggtttcttcatatggtttgtaattttttattgtgagctcatctttggcgagagtggctcatatgccctgattgagaatgtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtacgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatcctaacatttctgagtttcagaaacaaaatagagataaatgctgactttttagggttgttgggaaaattaaacagataatgcatgtaaaacttcttgaaacttcttctggcacatagcaagtcagaggttctcaattctggctaggttggcttcagtatcccctgggcaactttttaacattagacatttctgggccagaagcaatggcccacacttgtagtcccagctacccaggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacgttcttaaagttattcgaaaaatcgtaagtaatttcattgttctcagatttctaagcacttcaaagtcatttatttctcccacactgatattttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 1688 - DNA, 192212 bp, Homo sapiens
  source 1..192212: mol_type = genomic DNA
cattttgtctcctgtaacaatttacgcgccgtgtaactgtgaatctttcaaaggtatgttttactggagtgatttctggttatttcagaaggataatttgtgtgttgcgtcattaatgaaatagtagtacgaaaaacctatagcatcttttactgcaggaggtaactttccatgccattttttcagaaaatctacttatgacttcagtggcttgctagactggcctttttatttgtacttttcctgtgtttcagaattgcagagtataataaaggcatgtcaagtgcatattgtgtccattttcaggtatattagataagctttacaccaagataaattagatatgcttattggtttaatttgtgctaatatatatttaattgaaaaatcaaaaaaatttttttaaattgactgaagttgtattccaaaacatgcaaaatttagtttaaaatagattggatacacttttaaattttaaacaaggtagagggtttagtgctttgcttttttaaaaagtaaatgaaggctgcagctttctgcagtagttgtcttgggaagtagtgtggacatcactcctaagagacgttaaggaagtttagctaacaggctttaaccctttctctccataccagcttttactcttttttttttttttttgagatggagtttagctcttgtcacgcaggctggagtgcaatggcaccatctcggctcatcgcaacctctgcctcctagttcaagcaattctcctgtagttcaagcaattctcctgcctcagcctcccgagtagctgggattacaggcatgcaccatcacatctggctaattttgtattttgagtagagacggggtttctccatgttggtagggctggtctctaactcctgacctcaggtgatccgcccgcctaggcctcccaaagtgctgggattacgagcatgagccaccatgcccggccaccagcttttactttaatgccacagccttaaattttctttcaggagaaattattttatgtaaagttacaaaggaaaataatgcttaatatctgtaagcattcgtttggtaagtttgctgcctcctcagtaagttttgatgaaagtgaattttgatgaattactaccttagccgggtagtgacgttaacatgtggcttagctgtccattttctaagatatcaagaaaccagcaacaataagtaaaattgttaaattatgcaagaatcacatgttcctacctgtcatcatttagtcttggttctatttgcatgtgaatatcctttagaatatattactcccagttattccgctttacttttctgaatctcttttcccatctcttgacttcaacttcagtatatggctcttgttccttctacctggagaacggaggcatgtggaagcccagaggattgaattcttttttttttcttttctttcttttctttttttttttttagatgaatagtctgcttaggaaatccatctccataatgtttacctggtatcgtgttgtaatgtcagaatgaagtggctgttcttccccttgagtcatcgtcccgaatgaaggttccccaaaagaaatcatcaacttatgtggtgatttccttttacctttaaaaaaaaatttcttttcatggaaagataatggaacatgtcggtaagattcatttctaggaaggcaaaggagtagtttatcatctaaagactctcaacctaaagctgttttagaaaactttccttaaaatgagaagccgtaggttttcgttgcattattttggctaattgaaaaataagaccaagtgcgttctgaccttcgtttctcttacctttatttttacaaccaccatttcaatggcccacttgctgatacaaatgattgtttaattttaaaaagcatttaattgaagtcaagttatttagaacctaatcatttacacgtctttgttgttgctgctgttttgcaagagtgaagagcttggagtcaggtgaatctgggatgaggtacagttgtcatttattagtcatgtaatttgtgacaagccacttaatctctctgaagacttcagtttcttcatttgtaaaattggcataataatgctgtccctagtagggaatatagaattatataatgggtcctttgtatatattggctagtattgctctcttacgatttggcactatggagacactgtgggagattaaaagaagatgatgaataaaaggtgacttcagctctgaagggctttatgatccatttgggagaacaggtaatgtagaatatactggcttcaaaagtggcaggtgtttagaagagaaaaggatacatgatgtgataggaggcaaaggcttgattgagaaggctgagaagacttagagtaagggttctcagccctgactggacattaaaattatctagggacaattcaatcagaattcctgggggtggggaccaagcatcagtattttaaagttccctggggactttaacttgaagcccaggttgagaatcatttaaacagctctgttatttatttatttaaaattttaatgtattttttgagatggagtctcgctctgtcacccaggctggagtgcagtggcgcaatcttggctcactgcaactcctgcctcccaggtccaagctattctcctgcctcagcctccccagtagctaggaatacaggcgtgcaccaccacaactggctaatttttgtacttttagtagagacagggtttcaccatgttggccaggctggtcacaaactcctgacctcaagtgatccacccacctcggcctcccaaagtgctgggattacaggcatgagccactgggcccggcctagttttactttttttttttgtaatggaatttccctctgtcacccaggctggagtgcagtgatgtgatttctgctctctgcaacctctgcctcctgcgttcaagtgattctcctgacttagcatcctgagtagctgggattacaggcagctgccgccatgtctggctaatttttgtatttttagtaaagacggggtttcgccatgttggccaggctggtcttgaacttctgacctcaggtgatccgcccgcctcggcctcccaaagtgctgggattacaggcttgagccactgcgctcggcccatttaaaaaaactttaaaggtagacgtattccaaatggggggaatatataaagaaaggtaacacttattttgccctgtgtgctttgaatttcagaaggtgtagtaagcaaagaccacttactaaccctacagatatatccttagaaaatacagtggtttctgtcataaatctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatgataaacttgtcccaggtctatttgacactcctaccaaaatcctttgtgaccagggctagaaggcagctgtggctagtaaataaccctgtgtgtagactcacttattggctttggcattctctattgccacagctgtgtgaatagattaaccagagaccctctggtgccagccacctattcaggcaaacaagtctataatcagtacctctgttaaaatgaaactgtaatatactattgtcttttcatttatttatttatttatttagagacagggccttgctctgtcgcccaggctggagtgcagtggtacaatcttggctcactacaacctccgcctcccaggctcaagcgattctcctgcctcagcctcccaagtaactgggaccacaggcgcaccattgcgcctggctaatttttgtattttttttgtagagacggagtttctccatgttgtccaggctggtcttgaactcctgagcttcagtgatctgcctgccttggcctcccaaagtgctgggattacaggtatgagtcattacacccggcctattttctgattgttcaaagtagaagccaggcacaatggctcatggctgtatgtaatcccaacaatttgggaggcagaggcaggaggatagcttgaagccaagagttcgaggccagcctaggcaacatagtgagaactcatctctacaacaaagttaaaaagaaaaattagccaggcatggtggcacatgcctttagtcccagctacttgcgaggctgaggcagaaggatcacttgaactcaggagttggaggctgcagtgagccatgattgagccacagtactctagcctgggcaacagagtgagaccctgtctcagaaaagaaaagagaagagaggagaagagaaagagagaagagaagagaagagaagagaagagaagacatacaaaagaagagtaacatacaagagaagagttaggagaccctgtctcagaggaaaggaggggaggggaggcgagaggacaagagaagaaagagttaggatctatgccctaaggaagtaaggaggatttgagactgtgtaggtggttaataaccttaagctacatattttatggagggaaaaatcctatttttaaaagtgagaatagaacaattttgaagtgaaatggaatgaattagctggaccataacggctctgactgaagaaaaggatgtaaaaagccacatcctggatatgtaccaaacaccatggttacatggcatgtttgtatatgtaacatttatttaaaaaaaaagtctcatagcttagaaggcatttatttttgttatgtgtataggcttctgtgcaataaagcagccttttttattttacagctcatgatgacttaaatggttaattgcctgataaatatggtcctcttttattcttctgattctgttgttcttttgcacttcatctttcaaggggttgggctattcttaggtttcactgattgcactggaagggacatgacggaaaatgaagatctcaagataattttcttgcaaattcacaatggaagataaaaggaaagagtggcaggcattctgcacacagagcagacgtttctttattgtcattgttcagcagaggaatcaactcagccttggtgaaactagagtgatgcccatggtggcatgtcagcatctccctcttagtggcatcagtgctagattgttgttgttggaagcaggagagtgtttagtccataaagtacagaacttcgatatcacagaagctagaagaactttactgccttcagcttcgtttaaagatagtagagagcttactcattcgttttagaaatatgtattgggtctctatgtcaggaactgctggcacagcagtgagattgaagatacaacagtgaatacaatagagggcctatcctcatagagtttgcctttcagaatgagggacagacgcagacaaatagaaaatgtcgattgtgtcagggagtattgagggctttgaagaatgaaatcgtgacccagaagagatgcttttagattggatcatccgtgaaggcctctatctagaaaggagacacttgggcagaattctgaatgaacttgacggacatctgaaggaaaaatattccagtcagaaggaacagtacgtgcaaagtccccaaaacttcaataagtgacgtgctccagaagcagcaaggaagcagaatgaggcctgaacagagtgggcagtaggaaatgcagtcatagagaaagcagggctgggtcacaggcctcagagactgtagaacattggctcctactctaagacaggaagctgctgtgagcattgaggttgggcgtggaaccatttgactttttatgaggatcactctggctgcagtgtggaaaatagactggacgagggagggcagttaggaagatgtcacggtaactcaggaaagcaataccggtgctttggacgagggtggtggcagaagagaaagtgagaagtattctggatatatttcagaagaaagtggataggattttctgatgggtgatatgtagagtgtaggagaaagagaagaagcaagattgactttaatgttttccacctgggcaattggtggactggaattgccacttgcagaagtgtggaggtatggaaggtatgggaagagcagattgccaggaaagttgagttagttttgaactcattgtgtttgagaggtctgttaaattatcaagtagtgatgttgaggtgtaattggaaaagtcaacctggaatttatggcagaagttgaggctgcagatataaacttgtaattttaaaaatgtatatttaaagccatgggagtgaatgagttcatttgagattgaatgcagattgagaagagatttagaattgaactccagggcactgcatagcaggaggaaaacctagtaaaagtggtatctgtaaaatagaggaacgaactgtcacaatttgcctggtactgaggattttctcagtacatgagactttaagagactgggacaccctgagacaattggttgccttccatgggaagaaagtatgtcaagagggagagagtgaacaactgtgtccaataaaccaggactgagcaaaaaccattgaatttggcatcatgaagtcttaggtgactttgacaaggcttgtctgttgtgaacagccaagtaaatgtgaggaccactctccaaaaggtaaagaaacatgcatgaggatacaggtgcgccagctggagacatcatgcctcttccccgtccccaccaggagtggcgtgaagcctccccagtgctgtaacgaggcagccaggtcctgtgtgactgcacatgtgacttggggcaagtcatttaacctctctgttttcactatcctatttgtgaaatattgtttagatttgtggtttgagtcagctatctgtatactacactgtgttaggagctatgtagattaattttcaacagatatggttctggggttgtaggaattttcaatttgagaacaaattgaatcttaccctttgtcaggagaaatagcctttgacatgtgttaggggcaagggaaatctcaaacttgcttaattttaaaaatgaatatttggttgtggataatttaagctttggtgatatttctaattattttttgtgtgtttctagtctactgaccagaagtctgaaaaaaacaactaaaaagaaagactgcataagccttcactagagaagtattgaaaattgcttgagggaagtgacggtttctttagcctagtgtctgtaggaccccagtgtagtgtttgttgaatgaatgaaaggaggcgtatcagtcaggttcactcagagaaacagaagctgtaggaaatccatatggatgtgtgtgaaggtattggcttgcctactgctggtgtgtggctaagcgagcttaaaagtccgcagggcagatagtcaggaaggaaatattcccaacagactgagctcccttgggcacaagctgaagcctggagtctgaactgccagagagcctctaccttcttagaaaaggcttcccactggctaagtcaggcccacccaggggaatctctcctttgattaacttaaagtcacctgtttagggactttaattacattggcaatagtcccttcacagaagcacctaaatgactgatgatgtaactgaaaaaatgtgtgtgtatgctacaaaatggctgcagtctcccttctgtcctccagctcttgcaggagaactctcttgtagctcaccctgtctgaaaacatactggaaaggaattcaaggaaatgtagttcagcctagccacgttgacacatcatgaagccgtcacaaaaggtaaagcctggtttaggagcatttgcatttgcagtcttaagtatttttgtcttatttttcaaaaggggttgggcacggtggctcacgcctgtaatcccaatactttgggaggccgaggtgagtagatcacttgaggccaggagtttgagaccagccaggccaacgtagtggaaccccgtctccactaaaatgacaacaattagccaggcgtggtggcgcatgcctgtaatcccagctattcaggaggctgaggcacaagaatttcttgaacccaggaggtggaggttgcagtgagccgagatcccgccactgcagtccagcaacggagtgagactctgtctcaaaaaaaaaaaaagtagttttggtttttaatttttgattttttcttatgttattacatataacgaatgatatgcatactctgaaaaatcatgacataaaggtgaccttgaaattactttgatgttcatttaaactagtctttggtctccactggctaggagaccacatatagcagaacagcagagaaagcaaaacagttaattttcatgtttggcttttgagcttccagggacccaagtcttgccttgaaccgatcttaggaaattcctcattccctacccgaccctgtttctaaactgcatccctgctgaaatgcaatgccactgtaactctctccaatatttgttttcttctttggcttaccactagatgtatgtatatatgtttgtgtgcctgtgtgtgtgtgtgtgtgtgtgtgttgactgcctcatagtaaagcctactcttgagattaagactcctgatagtttagagaacagaaatcttttttagttcctggttattacttgaatttgcaagaggaacaactgctaggaggcctagttaacagtagttagggtctccacccacttgccaagggcaagactagtttacaccacatttggaatgaccagtttcctcccactttagtttcagtgtagaaagagtaggggagacgaactattcaatgtcagcttgggtgtagtgccagaaccgtactcagtaatgctgtcattgctgttggtgcttaccagctcttcagtactggaatagcttcagacctcgagagtttatgactttatcatcaactgggtgtgttgcccttggcacattgccacacagtgcttaatgatgatatatgttctttatcaaattccccccaccaaataatggcattatttacgtgtgagaaagttgcacatttcaccacctcatggtttattagagtgcaattccgtgagaacaactgcctgtgatcctctgtatccccagtggccaactcaggagctcagtatgccctacccagtagatgctcagaacatcattgctgagtgaggaagtcagccatcattttctccctggatagtctctcctgtagataacaggggccgttatcagccaggtttttcatcatttgtggctttgaatttcagggacatgacaagtttgctttttgtttcgttttgttttttttttttttttggttttctagagacagggtcttcctgtcactcaggctggagtgcagtgatgtgatcacagctcactgcagcctcgaactcctgggctcagtgtttctcccatctcagcctttggagtagccagcagtataggtggtgtaccaccacacccatctaactttaaaaaaaaaaaaattgtaaagacagagtctcacttttttgcccaggctggtctcatactcctggctcaagcaatcctcctgcgttggcctcccgaagtgctgggactgcaggtgtgagccaccttgcctatccaacatgacaagtattattctctggcaggaagtgaaattttttctcactgatgattgcacacaaatgtcatatctccatgaggcttctactcactagttttacggctcatgtcaccttgcttcaaactatgcttcagtataattttgaagtgtatatttccattgcctctccttgagtaattgatattcttcacaataagtttacatttattatcacttttatttacttactattattactctgagcagccaatcttatgagaagctcagagtggaacgtgtgggtcctggtaaatatattatttgactcacttccaaacacacttaatattgcctggtgttttgattatttcaaaatatacagatttcttgaaaggcctgcaaaaggaaacaatcaaaattatagcggttaagaatgtgagtctgccttggtttgaattccagatgggccagtccctagctgtgtaatcatgggaaaattattaaatctctagcctcgctttcttcatctgtaaaatgagcatacaggctgagcatccctagtccgaaaatgcaaaattcaaaatgctccaaaatctgaaactttttttgtgcctccatgacgccacaagtggaaaattccacacctgacctcacgtgataggtcacagtcaaaacattgtttcatacacacaatacttttttttatttgtataagtttaagtggtacaagtgcagttttgctacatgaatatactgcatagtggtaaagtctggacttttagtgtctccatcacccaaatagcatccattgtattcattcaggaatctagcatccctcaccccctcccatcttcccacctctccaagcctttcatgtctagcattctgtgtccatgtgtacacattatttagctcccacttctaaatgaaaacatgtgatatctgtctttctgtttctgagttttttcacttaagataatggcctccagttccatccacgttgctgcaagagacatgatttcattctttgttatgactgaatagaattattcaggcacaaaattattaaaaatattgtttaaaattaccttcaggctatgtgtataaggtgtatatgaaacataaatgaatttaatgtttacatttgggttccatcccgtggatgtctcattttgtatatgtaaatatgacatgatatgaaaaattcaaaactctgaaacaccaattgaactcaatttgcagtaagaatgcatacctcacagggttatagtgaggattgaatgagacaatcctagtccaatttctttgcacatagtaatgctcaataattattacttaaatgggtataaactttatagtaatgaggttggggctggaaaaaatgcagtttcataatttcctatagaagtcattcaatcctgactctaaactctgtattccatgtggtggttgggtggcgtgggagagtcctctttatcctgtggggttggtcctatggaggtgtctgtggcagattggcagatgcatttgtcttgtgcatagatggtgtctgttgtttcctctggcagagttcaccagtgtcctaatgcaaacttagtcctcatctggctcctgcacaggctgatctctggctcctttagcccctcatggttcctgttgtttcattttcagagggacccttgtaaggactatagtcctctcttcagctgaccttcaggtccccagtcagaaccaagggaaccgactctgtcccttctcatagcacctgaaaaccccgggaaacgaggggaatgctttgctctcagctactgaggttgtcctgtcaccttctcttctgccctcctttgccatggcataggataatgtaagtcagcaatctcattactcggtatatagccagaggaatataaatcattctaccataaagacacacgcgtgtgaatgtttattgcaacactattcacaatagcaaagacatggaatcaacttaaatgcccatcaatgacagattggatgcagaaaatgtggtacatatacaccatggaatactatgcagccataaaaataatgagatcatgccttttgtgggaacatggatggaactggaggctattatcctttgcaaactaacgcagaaatagaaaaccaaatgctgcatgttctcacttataagtgggagctaaatgatgagaacttaccaacacaaagaaaagaacaacagacactgtggcctacttgtgggtgaagggtggtaagagggagaggagcagaaaagataactatgtggtcctgggcttaatacctgggtgataaaataattgtacaacaaacccccatgacatgactttagctatgtaacaaaccttcacatgtacccccaaacctaaaagttaaaaaaaaaatcccagacaggaagtagggcatattttgcctaatttgcagcttcatcctcactccctaacttacgccactcatgtctcctccatcatcagggacagcaagagtggggaggggacgaggcctgccacatctccattctctgatcttatttcctcttgcctcttcaacagcgctttgtctctcctctccagcttgaagcccttactctggtatgtgatttcaaagcgatgaaaaactggtttcgttagtacttcccttggatctgcccttgtctcccatcaaggcagtgcaagtaaagaatccaagatatttgttttgttggtccactggagggtagagatagagaaaaacagtaacttccccaccacccccaacctcccttgggctgatgactccaaagactgccataaatgaacacttcatagagctgctattaatatgacacaaatctacttgatctaagggattcttttactttcttagggtggtcattcctaagtctttggatttcacagaaaagaaaatatattttaattgaggactgacaaaggttgccaactttttatcaattataagaattgtttttataattaccatcaatttctattatttcttttactccccctctttccaactgtggaaggtaaaattgaagagcaaagaacacttatttcaaagtgagtaaatttagctatatgaaaactcagcagattgccctgagtttccttgcgtagctgcagtccagtggaaatttcttccagaccagcaccagtcgccccagtgacatttagaaatcactgccctggattgtttcagccaccgaaacactcggtgttcactgtcagctatgattatatatgaagtgctttcgagaaccaatgtatagcataacttaggccaaaagaaacactgtgcctaaacactcagccaaggagtgttgagtttgcctggatttctggaaaattgtctccgttccctagttcactgtatttgggtaaacaaaacatggcctcggagagcctttgcgggagaaattataaaaattcagcaaagctttgtgatctcattttggatctcctcaggattcctcatcaagttgcaattaaggagagaaaaattccgccttggggtgggattttaattactcatcatgttatgacttgactttctgtgctgcatttttttccatatcactacttctgtgtttgacagctcctccaaagagtcgctccgttttatgccaggagcgaagtacttactaagtcaaaggaaagcaaggcaaacatctactattgcctttgtgcttttaccagaaaactgggtgagaacctccttttccttttccctgcccctccagcctcagttttatgaccctgtggagccagtggactttgaaggacttctgatgacacacctgaacagcctggatgtgcagcttgcccaggagctcggggacttcactgatgacgacttggacgtggtgttcacgccaaaggaatgtaggactttgcagccctctttgccggaggaagggtaaatagttttctaaaatgtagatgtgattgggattgtcatgattgttttcaataagtgggtaggggagatgccttcaatctgaacttaaaaataaaataaaattactcaatccattcaaatgtgtgggacagctatatgatatcatcatgtaagtatagatagtttttaaattagtttggccagagattttgaaaagctatgtgaagactaagccagtgcaagggatgcaggaggaccaaatgaaatgctcaagaggaggttaaaagtgcaggctctggagccagaccacctggctgccagctcagtgaccttggctgtcacatgacctcccaaatcctcggtttctccatttgtaaaaatgtcaagatttttaataataattactgaaatgccaccatccagaagcattttaattgcttacagttatgagactggatcaagttagaaacataaggtaaacccacatttattgagcatctactatgttctgggtactgagataaaaagatgaataagtcaaagtccctcctttaaagaaagtgtcatgcagtgctaaaacagtggggagagctctgtagaataaatatgtgaatagctaattagggcttgagtttctatagttggctcttctatatgtttataggcttgggcattagtttttggcatcaaactaactgtggaattgtagctaaatgaaacgcctgttgcttctaaaatgtaaaaaaaaatgtctctttggaggtttaggataaacttttatttacatttattttaaaagccaaattaagattcatatcctcctggacaggttccatcttctcatcttccccagaaggtcccagaaagaagatcctgacacacagcccctgccctctttactctgagatattctagttctattttggattttatttcatcacagtttaaggaggttggatgataatgggctggtattattgtgaaccgttgctctcttgttcagacagtcctcactcacataggagaactgaccatatgtgtagctctgatgttttaaaaatacacacttcccaggaaagaaaaacattgtcatttttgggaaacatactcccccattttcagtccatttattcaggtatgactttagtataagttaacacctactatttcatctttagtgaagaatcatttaatttattcctttatgtaaaatttatggatgtttccaaatatggtcagaatcttggaaaaagctgtttaaaatgcttacagtagccagtcaccgcagcttgttcctgtggtcccagctacttgggaggctgaggcaagaggatcacttgagcccaggaatttgagttcagcctgggtaaaatagtgagaccctgtttcttacaaaacaaaaacaaaaaacagtacaatgaatttagaggaaggaggaggtttttttttttttgaaatttgataaggaagataatttctttacttagcatcagttttttagtatactgttgccttgtcaaaagaatttataggtaacatacctgtctgatgtctttaagacagcctctactatttcagttgttgccaaaaagtcttctgtataattaaggcaggggaaggtatcatcatcacaccagagtaaacaatagctgactcctgttgaacaacctgtgcctagcccagaactttatgttgagctgtgatggcgtggtagtgaaaaacatgaacgctacaggtgagctgcctggattcaggtccctgctccaccacttgctgtgtgacttggaacaagatccttaccatctcatttttctgcaaagtgagaataatagtaatgcctgccctatggtgctgattgagaattaactgaattaatacatataaagtgattgcctcagtgcataatgcacagtaaatgctacctaagtgtaaactattaatatcatatatgcgtcttattgtgtgccaggcagtcttctaagcactttgcacactaaccgatttaatcttcatcaaagctgtctactaaaaggggcactcttactactctaacagctttaaggagaggaaactgaggcacagaagggttgagtgactggcttatggtcacatagctataagcgatgaagctgggatttgggcaattagggcccagagactgcatgtgtaacctttacaatattttatctaatactaacagcatgtctctgttcttacctccttatcacagatgagaaaattaaggcttgtagcatttaagcctgtttatttctggtactaatgcatttgcaacaatagcaaaaagctttgctacaattgttatttttgatttcaagactctgaagcacttgaagagtattgctcatggtgcattccttaagtagacatgacaggaaccaactgaattaatgatcaccaacaaaagccagtgtttgcaatttcatcaaagcataagacaactgttctttttcctggctttcaaaaaggagaacacgcgtgtcctaacaaggttacacatgcataaaaaatatgtccaaattaccctgtcagagataggtatttatacttattttccttgttttgtattcgaatacagctagttctacctgtcttgtgtctgaatgccttcggggatagttataatttaacatgattctgtataataaagaaaacccacaaagcaaaaaaatgccaacatgtttgtctcatcaaagtaaaaatgtttattgccccaggaatacttcagacatttggaatgattgggcaagaacatcctaagcattctcactgataaggatttaaattcgtgtcatgttccttgctcatgattaggggttgttttgttgttttacccagtaataacgtgtttatttcattttctacctcattagggttgaactggaccctcatgtcagggactgtgttcagacctacatccgtgagtggctaatcgtgaaccggaagtaagttactttttttccactttttgtatataaatattaattttatattgctagtttttaaatatttcttaatactttgaacagttctaggtttacagaaaaattgcatggcaaatagagttctcatgtatgccttccttatccccactccatatcacacacacagttccccctattatgaacatctcactttagtgtggtacatttgttacagtagctgagccaatatggatatgttgttattaactaaagaccatagtttacattaatgtttactttttgtgttgtatattctatgggttttgacaaatgtgtaatgacatgtatatgcctttacagtatcatacagaattgtttcactgccctaaaaatcctctgtgttccacctgttcatcctccctccctggcaaccactttccttttttactgtctccataattccaccttgttcttcaatgtctttttgtggcttgatagctcattttttttattgctgaataatctttcattgcatggctgtaccattgtttatttatccattaacttactgagaaagaaagttctattttaaacataaagaatagactgcaagcttgcccaacccctagcccgtgggcaacatggagcccaggatggctttgaatgtggcccaacacaaattcataaactttcttaaaacattatgaggtttttttttttgcgatttttttaaagctcattagctattgttagtgttagtgtatttgatatttggcctgagataattcttcttccagtatggcccagggaagccaaaagtttgggcacctggaatagagcctttttgttgtcttctaattctgatgaattcccagggggaaaaattaagtgaattgaaacctggcctcagcttcagaggtggcattcgagtttatgaccaagaaataaattacttgctggccttccagtaagggatctttctctcctggattaatcaaaccttctgtgacattgttctgagctttttctctccatgccatggacctggacagcactctctcatgagaaacatctatgcacattgaaattctcagcctgcatgggtgtacctgttggggagtgagatgtggactctctacagattagggcacaccccactagagacacgtcacagaacctttgacaagacattagtagtttaaaattctgatagcctcactcctcctatacctcagtaagaattactattctatggggtaaatgatgaaagactttgaggattgggttttatctagctcctggaagggtgccattgagtttgtgctgaggttttctggagtaatgtcaatatgcacacattttcagcagcagaaaaagagaaagcattcattattaaaagttattaagagaaagttagatgccaatccatcatctgttctaaaatgaatggaaaacaaagtttgctgggcagtcagataaaattatggtttgctgataataaataaaagatttcagaacaagttgttctcaagtttttaaatgctatcattagaggtactttctggacattaaagatctaaaaaaaatctgagaaggaacaaatagaaagatccattttgatacatttggttttcagatttattttctatttcgggcttgtccactttttcatttctcatggcaatgcacgcttcttggagtagtgatttttcttgatcttgcacaaatgtaagagaaaaaaatgactctttttggaatactcgttgaaattttagaaataattatgaaacacaaatcactcagtttcactctagacagataatcatcatgaacatttgatgtctgtcctttgaatagtgttgggtttttttggtatatatttgcgtgaaaactaaataagattataatatcatttttgtaacatgcattttcagttttcacagtaaagagtgattctcttcctttgctattaaatatgcttcctcaatacaatgattgatgattgcataatatatttataccaaaatttatttaaccaattttaatatttaggtgattccttccttttcagtgttgtgcttaaaatgcaaaaacatccttctcaggaaaaatttgtacatatttatgatttttttctttggaattaattcctacaagaggaatttctatgtcaaaggatatgcacaaatttaaagatttggaatactagatcaaacattatgccgggcgcagtggctcacatttataatcttactcagcactttgggaggttgaggtaggaggatcccttgaacccaggagttcaagaccagcctaggcaatatacagagaccccacctctaaaaaaattttttaaaaaattaactggatatgatgacatgcacctgtagtcctagctactcgggaggctgaggcaggaggatcacttgagcccaggaggtcaaggctgtagtgagtgacgattgcaccactgcacaccagcccaggcaacagaggaagaccctatctcaaaaaaaaaaaaaaaaaaaaagccaggcacggtgctcatgcctgtaatcccagcactttgggaggccaagacgggtggatcacctgaggttgggagtttgagaccagcctgaccaacatggagaaacccagtctctactaaaaatacaaaattaaccgggcatggtggtgcatgtctgtaatcccagctacttgggaggctgaggcaggagaatcacttgatcctctaaaaatagctaaactgggaggcagaggttgtggtgagccaagatcgcgccattgcactccagcctgggcaacaagagtgaaactccgtctcaaaaaaaaaaaaaaaaaaaaaaaaaagattattgacactacatgcatgaatcctcaagaatattagatgttataatttatcaacatttccaattttatttgataaaaggttgtcttttttttcattttcttttactattagattaggcatctttcttctatatatttcttggccattttttatttttcctggtgctctgcttattcgtgaaatttgtgcatccctattaatgtatttgtctagtctgatttatttttataagcacttttttggtaaagatattaagccttgtctaccatgtattaaaaatgtcttccccagtatgccttttgtcttttaaagttgtttttaattttcaacattcagaattatttatgtcattaaatctatattaatatttttccttatgtttaattttggcatcatgcttaaaatttgattcacaaacttattattattttctaagagtatgggattaaagcattaatccagatcattagccacttgactgttgcttctgttcccttatgtgtctccatttgtttttatcttttctacagaagcaatggttacccatatatttattatatgcaagtttttgcatcttgttcccctaaaaaagaaaggaatatgtgttttaattttatgtttggcaacattctagggatgggattaccattggcccagttctctgcacccctgtgtaatggagcagttcccttcttaacggtcacctagtggacagggagaagtgtacaacttcagaactcattgtcagtttctggcaagctttcttgtagaaaagttgcatctctttctatccctctgcctcattctcttgcactctgaatctaacactctgcccatgaaaactaaaattcctagcacacactcctcccagggatcattctgtctctatatgcacctgtcgtattttatctgtggggagaatccagtacactattgccagatgtccttcatctcccaacctcacacagtacatttttagcttattgttttctgtgagttgtatctgtattgttttagaatgatggtagaaggagaaggacaaggagaaggtggtgattcatataaatgaaaccagctggaagctgtgatgctttcatagataagccactattatgaagaaggagacttcagatttctgtatagacactgaccagggactcgtgggcaggaaggtgtgcaacaccttcttatctttattcagtgagttcccctttggggagacaaagtttggtacatccttctctttccagctccatctgatccacagaggttctgtccagattcaggcattaagttatctcttcatttggatgagtttccagtttttctgtgtcttcataagtggtttactagaaagtcggaggaggatgcaataggggttgctggccatttgttaattagtgattaattatttagctctcctttaattggttatgtgccaaatcatgtatgattgttttgaaagaaatcaagtaatatggaggtgcattaaggaaaaggcaaatctcatgcctcactacttaccagtgtcctacccttcccttaactcactcttcactgcgtaaagcccagctgtgtagcttccagatcttttcataccctcacaaaaaatatttgtctatttatatttttcacataaagatatatgtattaatgtatgtacttatatattacaaacatttctttaaaataactgtccatgtcagagctatatcccattctactgaaatgctgcctagtattcaaagggtgaaggaatgtgtcctaagttactgaaactaaatgaccattttggttgtcaccatttttcataattgcaaataatactgaaacaaacatatctgcacatttgccccatacatgtgtgtgaatatttctgagggtagaaatgaagccagtgtacatggtatgctctgataggtactgccaaattcttctccagaaaagtcgtgctgtttcattccattaccaactgggcattaaactggcgtgttcccatattcttgccagtgctggatattatttattaaaataaaatttcagttcctccagtcttcttttagttattattttaatctggaagctattacacctactttctgaatacagtttcctatcaccaagtttcctttccttatgtgttctaaaatcccagttaaatatgcacttaaccatacaaccgtaagtcccactcttgagtatttacataaaacctatgtgcaaatacagcagtttagcagttttatttgtaattgccaagactgcatagcagttttatttgtaattgccaaaaactggaagaaaacccagattgtactcagttgggtagtagataaacaaactctggtaaatccatacaatggaatactactcagcagtgaaatggaacaaacaattgatatatacaacaacatggatgaatctcagatacagtatgctaagtgaaagaagccagacaaaggccgggcatggtggctcatgcctgtaatcccagcactttgggaggctgaggcaggtggatcacttgaggtcaggagttccagaccagcctgaccaacatggtgaaaccccgtctctactaaaactacaaaaattagctgggcgtggtggcacgtgcctgtagtcccagttactcaggaggctgaggcaggagaatcgcttgaacctgggaggcggaggttgcagtgagctgagatcatgccattgtactccagcctgggcaacaaagtgagattctgtcttaaaaaaaaaaaaagaagaagaacccagacaaaaaagataactgcatgattccatgtatctgacattctggaaaagatgaagctacagggatggaaaacaggtccatggttcccagggtctgggagtggggaagagggctgactacaaaaggacacgggagtgccctttgcgtggtgctgggactgtagtgcccatgatgtaaaatctgccttggaccattacattagaagaaatcaattccagttatcccaatattccctccaagtgaaatactttggtagcatatataataataattcaataagtattagctattatatttattaagtagtacctatcagaaaacatacttatattagcatgtcaaaggaatgaacacaaaattctctcccatatattgaacgcaccatggaggggggacctgccttcctctggaggaccatacttagtgaagccactttgccttataaggacatgcctttgttatccagaaccaagcagtcaaacactgatttagttagctcctttatttctcagttatctcctgctgatattacatttctccataatatctagagataggcttttatgtccttgctagctgtggtaatggttttgaatcccacttagggggcagaggagtagagtaatggccacttgtgttccctcccaccctcatcattctacagggcatttgccactcaagtactgtaattgagacatttaaatcatacaaataatgctgcccatgaaggatagaggaaatttttagatttccttttaaacctaacagagaaagattaagttacataaaaatgtaaaatacatgatctccagtacattgaaggaaatgtattttcttacttgaaatgtttgtgttacttagactggaagatttattaaatgatttccattctatcactcatgtttacagcaccaaatttggtgtccttgttctaaaaacaatagtacttttctccccatgacttttgaaaatgattactggtttactgattagcatggcgccatgtttgcttgtttgtccaaccttttatctgcatattttgataatgttgtgtggattaatatttgatgacatcctttgggtgatattaacgattttaagctttatttcttctgtcattttctctaaatgaaccaaagagggataaacttcagaatgtttttgatgcctggtggagagctgaactcttaagaaattaaacttgtttacatactatatttattcttgccgcagagacagtgaaacatttcatgagtgttatgggcagcatcataaaagcctttagactttgtttttcatctggggtgattaaggtaattctgaaggaaggttgagctcaaggagagctgagatatcaaggaatggggtatcatctgttttattactccatattttactcccagtgaagtggtaaacaattaaaattcaaacacatcagtgcatataattcagttactcccagaacaccataaaaatgtttccctgatcaataattgcttattatgacatgcatttgttgtgctagctgtcaaggtgcttagctatttgctttctaaaagtatgaaaagcacgcccggctcatcagcctatgtggtaacaaagagcaatccagctgtggatgtcacagagccactcttgacctgttgtgcatagactccctccccacaaatccaaacccactaagactctccaggctctgttaacacacaccagcctggttcagcttggatgccctcctcacaccatgtgggttctgattttccatgccaggcagtccatcttaaatggatgcatcctcaccgtgtttgggcttcaacttcctattctggacctcctcggctactccctaccccaaggcatggagggctgccttgttctgatgcaccttatgattttagcaccaaattgtacaggaagggagagaagggaaaggagaaagaagatgtgaaaggaaagagagggtagggaagaggaaaaagaagatgaggaacacgtattattttctaatcctcacaataggtcctcaaaatgagcaacatttccccctatttcatacttgaggaagctgtgactcagagagactaaggcacttgcccaaggtctcttagtacattaaggagccagcgtctgcacccagttccttctgactctagagcctggattctgctggctgcaccacactgtctttaaagagaacactctcaaaacgcgcttggtctttggattgtctcaaatgtgttagaatagtgttttaagaaaaggaatgcagatctcctgggaagcaataggtcgagttcatttcatgagaatcatttttctagccattggcctacttccccatttttctcctgtctgcatctaggtgcaacaggaacttggctttatttgactccattgccagggtggggtaatgaagctgggactctcttgtagccagcggcagtgagccagcagtctcactgcctacccagtgatggttccttctgtggccagcacttctggaatgagtcatctttacatgtttgccaacccttgtcctctcctccccagccaggttcacccttgctgctgtcaaggagctttgagactttctgagatttttaaatggggaagtagatgttaaacctagtatgaggaagagagggaaagtttgctctggtttcaaacacacagtcatagaagatgctagtcttaatgctttccatagcaaaaaccctgaaggcttagagtgtacacattgtgaactgaacttttaacattattgtgtaactcatttgttaatgcctatttgtcattgactgtggggtccatgtgaaaaactcccacaaacactctaacaaaatggaagacagaaaagaaagcaagcatcatttgtgtacaatagccaaagaacaatagccaaataaatttgatggtctcaaaagttaagcatcttttgaagagaaaatttgattttagggccaggtggggtagctcatgcctgtaatcgcagcactttgggaggcagaggcgggtggatcacctgaggtcaggagttcgagaccagcctggccaacacggcaaaaccccgtctctactaaaaatacaaaaattagctgggtacggtggcgcatgcctgtgatcccagctacttaagaggctgagacaggagaattgcttcaactcgggaggcggaggttgcagtgagccaagatcatgccgctgtactccagcctgggtgaaggagccagactctgtctccaaaaacaaaaacaaacagaaaaaagaattgattttgattttttcagatacagtgcatgaactttttatcataaaatattaaagctggggaaaatatcttagaattcacctcatgttcatgctttaccctgtgaagaaacagaggcacagagagaaataacttgaggataatggaaacaagcacacatctgtaagtgtgtgtgtgtgtgtgtgtgtgtgtgtgtgtgtgtcagagagagagagagagatgttcctttgtaagtaaacactcttggaaatagccgcattttattataacacaaaaagtaatgctaaagctgatatagttctggttgctaagcttcacacacaaaaggtctttaggtagctgcttcctaatttttatttctgtggcccaaaagtctccttgtaaaccttcgtgtcatgtcatactaaacctttgacatcaataccctttaaaatgtacaagtccttaaaaaaaaaaaaaaggcaaagggcaaatactaatgtgggaaatttgaattttaattaactgtttgtttcaatgttaggataaattaatgttagataaattctttggtaatttttccccctaaaattggatttttcaagaaacatcactggttcagtatattgttatttggggtagcataattttaggcgataacttaatatttgcatatatttgtcactactttgagttggtttttgtcccctgacccccagccaggatgttagatcacacagatttttttttctttgagcccttagggagagtccaaaacagtcacttcatgtactaggaaagtttacccagtcagcacacacagatatgttgttgcctacatttatatttgtgagagtgactgttaagaaactagcaggtttataaaatccgtgtgagaatttctctcaaataactgttaatggacaatccagcaatcctcccatctcaggctcccaagtagctgagactacaggcaggtggcaccatactcggctaattttttgtgttttttgtagagatgcggtttcaccatgtcacccaggctggtctcaaactcctgggctcaagtggtgctcccgccttggcctcccagagtgctgggattacaggtgtgagccactgcacccagcctgtacattttccttgaaatcgtttttggatgtttagtcttatttccttattcagagttcacctgtttattttttttttcatttccccaatttagcctgcgtttcacccagccctagcaatataggtttgggtcagagaaattcaagcggccaggggatgctgaagatggcccattatggccgggcgcggtggcacacatctgtaatcccagcactttgggaggccgaggcaggcagatcacaaggtcaggagatcgagaccatcctggctaacacagtgaaaccccgtctctactaaaaatacaaaaaaattagctggctgtggtggtgggcgcctgtagtccaagctactcaggagactgaggcaggagaatggtgtgaacccgggaggcagagcttgcagtgagcagagatcgtgccactgcactccagcctgggcgacagtgagactccgtctcaaaaaaaaaaaaaaaagatggcccattgtggtaagccttgacttgaattagtcaccaagctagtcttatctcttttctaggctaattcttgttttttgtttggctcaaaacaaattgtttgtcttcagaacacaataaaatccagggagagtgtcctgttcttcctacagacgtcactgggacatcttattctttaattaattcagtcaactaaaattggtcaaatacctgctctctgtgccagagttataaactttgtatttgtataattgctagtagctctcttacatttcttactttatctatctggcatttgatctacctaataccttccaatatcacctcatgtccctttaccagcttggtggtttttctatagttcaggaaatcaaacaaaatggtgtgtgacctggaggtactagaaaaacaatagcaaaccaactccaaagccagcagaagaaaacaaataaccaaaatcagagctgaaaaaaattaaaacgtgaaaatccatacaaaagatcaatgaaaccaaaagtttgtgattcaaaaaaaaaacaaggttgatagatcactaactagattaataaagaaaacaagagagaagatcgatccaaataagcacaatcagaaatgacaaaaatgacactacaactgatgcctcagaaatataaaaaatcctcagagactgttataaatacccctatgcacacaaactagaaaacgtagaagaaatggatagattcctggaaacacacaagccccctaaaattgaagcaggaagaaattgaaatcttgaacagaccaatagtgagttctgaaattgaatcagtaatacaaaacccaccccaaaaagcccttaatcagatggattcacagccaaattataccagatatacaaagaagagctagtaccaatcctactgaaattatttcaaaaattcaaggaggaaggactcctctctaactcattctgcaaagccagcatcattctgataccaaaacctgggagagacacagcagaaaagaaaacttcaggccaatatccctgatgaacatcgacacaaaaatcctcaacaaaatactacaaaccaaatccagcagcacattgaaaagttaattcatcacaatcaagtaggctttattcctgggatgcgaggttggttcaccatacacaaatcaataaatgagactcatcacatagacagaattaaaaacaaaaaccacaggataatctcaatagacacagaaaaggcttttaacaaaattcaacatcccttcatgttaaaaaccctcaacaaattaggcattgaaagaacatacctcaaaataataagagccatctattattcaactatccacagccaacatcatactgagtgggcaaaagctggaagcgttcctcttgagaactggaacaaaacaaggatgcctactctcaccacttatatcaacatggtactggaagtgctagccagagaaatcaggcaagaaaaagaaataaaagacatcccaacaggaagagaggaagtcaaactagctctgtcacagtgcaggcaatataattctgtacccagaaaacactgcagaccctgctaaaaggctcctagaactgataaacaacttcagtaaagtttcaggatacaaaatcaatgtacaaaagtcaataacatttccacacaccaataatgtctaagttgagggccaaatcaagaatgcaattccatttattttatccttttgaataaaatacctaggaatacagctaatcaaggaggtgaaagatctctacaatgagaattatgaaacacactgaaagagatcagaggtgatacaaacaaatggacaaatattccatgctcgtggataggaagaatcaatattattaaaacagccatagtgcccaaagagatttttagattcactgctattcctatcttaattagcaacatcattttttcacagaatttaaaaaaaaaaacctattccaaaattcatgtggaaccaaaaaacctgaatagccaaagcaatcttaagcaaaaagaacaaagccggtggcatcacactgtgtgacttcatactacactacaaggctacagtgaccaatacagcacagtccaggtacaaaaacagacacgtagaccaatagaacaagataaagaaccagaaataaagctgcacgcctacagccatctgatctttgacgaagttgacaataacaagccatgaggaaaggtctccctattcaataaatggtgctggagcaactggctagtcatatacagaatattgaaattggacccctccttttaatcatatacaaacattaactcaagatggattaaggacttaaatgtaagacctaagattacaaaaaccctagagaaaaaaactgggaaatactattctggccattggccttggtaaagaatttatgaataagtccccaaaagcaatggtaacaaaaacaaaaattgacaagtgggacttaattaaactaaagagcttctgcacagcagaagaaactatcaacagagtaaactgataaccaactgaataggagaaaatatttgcaaaccgtaaatctgaagaatgtctgatatccagaatctataaggaacttagataattcaacatgcaaaaaaccaccccatttaaaaatgggcaaaggacatgaacagatacttctcaaaagaagacatacatgtggccaaaaaatatatgaaaaaatgcttaacatcactaatcattagataaatacaaatcaaaaccacagtgtgataccaactcacaacagtcagaatgcctgttattgaaaagtcataaaatagactgggcatgtggcttatgcttgtaatcccagcattttgggaggctgaggcaggaggattatttgaagccaggaggttgagaccagcctgtgcaatgtagcaagactgtgtctctacaaaacatcaaaataaatggaaaaaaaaaaagaaaaagaaaaagaaaattaactgggtatggtggcgtgtacctatactctcacctactgggaggctgaggtgggaagattgcttgagcctaggaattcaaggctgcagtgagctataatcacaccactgcactccatcctgggtagcagaacgagaccctgtctcaagaaaaaaaaaaaggcaaaaattaacatgttggaaattagttcagtcactatggaatgcagtgtgaagatttctgaaagaacttaaaacagaactaccattcaacccagcaatcccactactgggtctatacccaaaggaaaataaattgttctacaaaaacgacacatgcactcgtatgttcctcacagcacaattcacaatagcaaagacatggaatcaacctagatgcccatcgacagtggactagataaagaaaatttggtacatatacaccatgaaataccacacagccataacaaagaacaaaatcatgggggtttttttgcagcaacatggatgcagctggaggccattatcctaaacaaattaacacaggaacagaaaaccaaataccacatgttcttatttataagcaggagctaaacatcgggtaaacatgggcataaagataacacggtagacaccagggattactaaagaagggaggatggaagcaggtgtgggttgaaaaactgcctattgagtaccatggtcactatgtgggtgacgtcagtatcatgcatacatcaaacctaagtgacatgcaatttacccatgtaatgaatttgcacatgtatcccttgaacctaaaataaaagttggaaaaaaataaaagataagatatcccgtatcctcaataaaaataaaagtggcgtgtttgtgcacttgactttgtaacatgttttccaaagatgtctttgagtcataaaaatgggaaatacacatgttggtttctctagtcatcacttgacaacttacatgttttacctttcttatgatggtctgtctcatttcttcagtgacagggctagacattctgttttaaactcttcccacagctgtatattattcaacacaactttaacagagttcatagagtggagattgaggatgtttgcaaagttaaatcatttatttttattttttcttaaccatgtcccgcctgctttattcattattaagaacattgatgtgaagattaaatggttttctctatttttatcttcaaacgatctctatttgtggcttctgcacattgctagatttattccagccacttacactagggtcatagtttagcttcagctcggagccaaatgccccacagctgaaatgaccgcacctctgaagtggcattttcccaggccatgcctccctttaataatgagccagccagggggtaaatttgtatctcattacaacagagccttgtattaggcctggagaataattaaatgtgaggaattataattggttccctctttgaaagctctctcagcaccatgtctacacttaagccattacttttatttttaatctaatggtttgccgctctctctccctctttctctctccaaattaaatatcaaccataaaagaaaccaaggaagtccagaaatctgtggctttaaaaagactggatctcgaaaagattttcacaagacgcttccgaaacagacgtttgagtcggaaaccttggagtgcagtgaacccgctgctcaggtatttcctgtcaacaaacatggttaccaggttactgggctcttctgcccagggcatgctgtcagttttacaaactagaataaacgatagacgcatagaaagtttgagtaggaggaactttaccatctgagtcagtgattttttttttcaaacttatttgtagctgtagaaattggtgttcaaatgaaaacccagaaacccaatgattaaaatagaaaaaagtggaaaagctctaactgggggacagagacaccttgggcccatccctacgacagttcctgcagagactcttggtgcccctaaggcaaactacagagtaatgaaaagctctatgctgaggccagaatacctgcattctcctagtgattctaccatgtactaactctctaacttcaagcaggataattaaacttattgggcttcagtttcctcccctgggaaacaaggatggtaatactaactcatgaggttatttgagtattaaatgagttaatatccataaagaattagaataatgccaagtacacttagtgcctagtcaatgctggtcactgttattgttattgtcattattctttttcttttttttttttgttgagacagagtctcgctctgtcgcccaggctggactgcagtggcacgatcttggctcactgcaagctccgcctcccgggttcacgccattctgctgcctcagcctcccaggtagctgggactacaggctcccgccaccacgcccagctaatttctttttgtatttttagtagagacggggtttcaccgtgttagtcaggatggtcctgatctcctgaccttgtgatccgcccgcctcggcctcccaaagtgctgggattacaggcatgagccaccacgcctggccagttgtcattattcttataaagtaattacagtttaaaattcaagttaaagtgtacatattgtgaaatgagcttttaacactattctgtaactaattttttaaatgcctggggtcatttgaagaactccagcaaacactctaacaaatagaagacagaaagaaagcaagccttcatttgcataaaacggccaaagaacaatagccaaataaattccatgtttccaaaagttaagctctatacacctatgctcacagcagcattattcacagcagccaaaaagtagaagcagcccaagtatccatccataatgaatggataaacaaaatgtggtcgccaggggctgggggagggaggagtaggaagttattgtttaatgggtagagtttcggcatcccaagatgaacagcattatggagatggatgctggtgatggttatactgcagtgtgaatgtgtttaacactactgagctgtccaacctgcccattttatagatgagaaaaataaaattgagaagaaaaaatttgttcaagtttgcacagaacttcttgtaaactaatatagttttcagcttccatgtgtcttcataatacaggaatctcaccatgctggaaatgattcgaggtttttaaataatactaatttttcagacaaggtggtccccctaaagcaaagcccactacttacttggagcttcacagtagaatcagccatcatttccagcgctaaatatgacaggcttactgagggatagaatacctggatgctctgctctatgggagatttaaggaatttttcatcagtaattttgactgaattccattttcaccctacatgctgaccaattaaattgttcctcttaatgttagtcagatagaagccacggtaggtatttcagcagaagaaatttaacacagggaattgattaaaccggttttggaggtctgagagaaccaaaagggaaaaatggaggctatcctaaaatcgtcattatgggaaacagcacaccagcctggggctggggtatacggcagtggttctccacttcagcttcatcagaatctcccagagggtttgttcaaatataggttgctgggccctgtctgctggaatttctgattcagtaggtctggagggtgaacctcatactttttaattagcatttcctaagtgatgctgatgctgctggtcccaggaccacaatttgaggactgcaggtctaggggaagatcttggagttgtcagaacgtagaagctcagaagaggagcctgagagcaaggactgaaatccctgagaaggtactgcccagctggtggtgttgtctcaagatctcagagggaaaaacctcatgaagcctggactcacgcctcacaggaggagaaattgcccggctggtgctggtaccttcaaggaggtaagataagggtgattctggaagtaccaaaagaacctgaaggctagaaccagctgtcactacgaaggtgagaggaatagcaagaggaaggagccaggccctttgacctccttgaaccatccggtaaccctgtagtgctccctattgacagaacctaaagggagcagcagacacagcggaaatatgatttgctgacctagcatcaaagaacaaggcataaaagggtgaatttggagcccagaaacaataggtgaagaccagcgtacacacaaagcacacgctttcctgcagcatactagcagagaactcaagtcactgtgttgtgtgtggttttttttgttttttttttttttttttttttttttttttttttttttgagatggagttttgctcttattgccaggctggagtgcaatggcatgatctcggctcactacaacctccgcctcccaagttcaagcgattcttctgcctcagcctcccgagtagctgggattacagacatgcgccaccacgcctggccaattgtgtatttttagtagagacagggtttctccatgttggtcaggctgatctcgaactcctgacctcaggtgatccacccaccttggcctcccaaagtgctgggattacaggtgtgagccaccgcacccggcccactgtctgtgtttaagagccaacttgatcatatgatccagcagtctcactactagatatatgtccagaggaaaggatatcagtatatcaaagagacatctgcactcccatgtttattgcagcactattcacagtaaccaagacgtggactcaacctaagtatccatcagcagaagaatggataaagaaaatgtggtatgtatacacgatagaatactattcagccataaaaaaatgaagtcctgtcatttgcatcaacatggatgagtctagaggataagtgaaataagccaagcacagtaagactaatactgcatgatctcacttatatgtggaagataaataagttgatctcatagaagtagagggtagaagtggtaactagatgctgggaaggatggatggagaagggaatagagaggttggttaacggttacaaaattatagctagataggaggaataagttctagtatttgatagtactgtaaggtgactagaattaataataatttattctgtgtttccaaatagctagaagaaaggattttgaatgttcccaacacaaagaaatgataattgaggcaatgggtacactaattaccctgatttgatcattacacattgtacacaggtattgagatattacactgtattccataaataggtacaactattatgtgtctattaaatttttttaaagagccaaattgtacaaaagttgtttgttttgaaatattggaataatactcatcatggagagaatctcagactgcgagatgacagcaatgttttcaattccactctcattcttgtgcaccttcttattgagtagaatggtgaggccacatagctagatttataaaatttaaacaagtatatgataagattccttggtacacgtagattttataaaaattagattatattatgcataatattgcaaaacttcctttttcatattagcaatatactgtgattatctttctcttccaattaatacgtgttctttcttttttagagacagagtcttgctctgtcgcctaggctggagtgcagtggcacgatcttggctcactgcaacccctgcctcccaggttcaagtgattctcctcccttagcctcccgagtagctgggactacaggcatgtgccacgacacccggctaattttttgtatttttagtagagacggggtttcaccatgttagccaggatggtcttgatctcctgacctcatgatcccccggccttggcctcccaaagtgctgagattacaggcatgagccaccgcacctggccaggttctttcttttaatggctacataacattctattttatgaaagttccaaaatctcttaacacttcctttttgggggcatttagtttacttctattgttttgctatcacgaacagtgtttcagagatgcccttgccctcacattcttgcacacttgccagttataccctacggataaattcttagaagtgaaatttctagattaagggatgagtaatgttagatttttttacttatatgtatcttgatatccttttaaataaatttgggaaattaaagtcattttccttaaactcttataaattttaagaaaaacaaaagtattaataatcgaagtgttaatattgattatttctagcacattcagtttggggaaaatttatgatctagtagagtagtacttttgtgaggtagatgtcacaaaaaatgtgtagtatggagaaattgtccagtagtatgtccatttagtagaattttgagaataacattttgccataaattttatagatatttaccattaatccatttgtagtcctacaacatatagttgattacagttatacattttttgctgagtctttggttcaaagcatgcagttcccaattacaaagacattcctaatggaataaaacatccactttgtgactgatttaaggttgttttcttaaagcacaccgcagccaaaagtggacacagcttgaatagcaaattttttcctttttgttgttgttgcttcatccaataactgttaccaaattcccgtagaaaagtgttgcccactcccacatcgacctttggaagcataacattcagctttggtgtctatacacaatttaatttggaaggctcctcacaaatcatcttattttccagtttcaaaaaccaagttctgagtggagattaagacagggtctctttatttcccagtgcagtctcctatctatttatttgtgaatgaatgaattagttaattaatgagccagggtttcactttgtcacccaggctggattgcagaagaagtcatcgtggccaagcgtggtggctcatgcctgtaatcccagcactttgggaggccaagacaggtggatcacttgaggtcaggagttcaagaccagcctggccaacatggtgaaaccctgtctctactaaaaatacaaaattagccaggcgtggtggcgcgtgcctgtaatcccagctactcaggaggctgaggcaaaagaatcacttgaacctgggaggcagaggcagcagtgagctgagattgcgccattgcactccagcctggccaaaaaatgtgaaactccgtctaaaaaaaaaaaaaatccaatctttcctattggctttattaaatacactttaactttagaagcttagaagcacaataattagaactggcctaactttaaaaaaaattttcacaaagaaattagtaacttgtagggtcatttgtaatctttttctctgttgatttttacagttttaaaaagttaatacaataatttatttacttattttttgagacggagtctcgctcttgttgcccaggctggagtacagtggcaccatctcgggtcattacaacctccacctcccgggttcaagcgattctcctgcctcagcctcccaagtagctgagattataggcactggccaccatgcccagctaattgttttgtatttttagtagcgatggggtttcaccatattggccagtctgatcttgaactcctgacctcaggtgatccgcccacctcggcctcccaaagtgctgggattacaggcatgagcccaatattttaaaaatagtacattattacagaagctagatgtgcactttaaattattatcagaaaattagtatgacagacaaattctatgattgtcccatcatctgggcctgtgacattcacacctttgtgatgttcatccccgactgtgggtgggacctgggacttgcttctgtcaaaacaatatggcaaagcatgagaggatgtcacttgtgatcatattagatagcagccaaaatggattaaagacttaaatggggccgggcgcagtggctcacccctgtaatcctagcactttgggaggttgatggcggcggatcacctaaggtcaggagtttcagaccagcctggacaatatggtgaaaccctatctctactaaaaatacaaaaataaccagatgtagtggcggacgcctgtagtcccatctgctagggaggccgacgcaggagaattgcttgaacctgggaggcggaggttgcagtgagctgagatggcgccattgcactcaagcctaggtgtcgcagcaagactcggtctttaaaaaaaaaaaaaaggtaatcatacctcactgcagccttgaactcctgggcggggttcaagcagtcttcctacctaaacctcccaagtagctaagactgtaggtgcacgccaccatgcctggctaagttttgcttttttttttttttttaagagactgagtctcattgtgttgcccaggctagtcttgaactcccggcctcaagcagtcctcccaccttgtctacccaaggactgggattaaaggcataaaccactgcacctggcccagtctcctttttgttacaacttcctccagctctgttttgctctggtgtgagacatgagcatggttcattaagaggcttggcccccccagccccaggaaagaacaagccaacaaccgataggaatgtagtactgtttttagtcctttcctcaggactggtttgtctgcataagatgagtaactacctgcttccaggtgagaagaagacatttaattttagagtagtccagccaggaagctgagatgtcattcttatcaaatccgcagtttcttcagaagacttgaggcctggctgagattctgtagtcccaaattggagcagtcttgagacatccaagattcttcggttctcattttagacttgccgtctctctcacaaagacccactgttttctctcacaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggtgggtgccactgtttccatactggagaatctcagtgaagactctgagagtcatgtggacaattgtgttgttcattattactatatagcagcccatggtgtcagggctcacttgtatgatttctggggcctcgtttttcactcaggcaagcctgtgtgtcatagcagagccattattgattatcacacagatgggattctgataataataacaactggaattttcatagcactttacaaaatatgttcactaagagcatctcatttaatccccaaatgtttcaagggtctacatgtagtaatcacacccagcaagtcaaaccatcctattatttgaggggatgtgtggtcactaatccattgagacatacattacttaaactttgatgttctttagtgctttgttactttctttttaatggtctctatgagcaaccagagagacctgctttgaaaacatttcaggctaggataatcacagcccatgctcccaatgtatagaactttgggatcttgattgtttacttcttcatttattggagctgactgacaacaataggataatgtagactttgcctgtggtcactgcctgaggcactttggatgaaatgagaggtgacgattattcaagccttttgtctgtttgaactccttatactgtataggaggctctcagttttcccctctgcgtgaggttatctacacttctgggtcttgccagaacagattactgctatatctctgctgtccaaatggtattgaaagttcagttggaagaaacaggatttgaggaaactgcataaaagatattctatccatccatgcctctaaatatttgaaattcgatccttggattaagtgagacaatcagagagcctgatacccccacccttctggattgtgtttgctaacctgcccttcagtgagctcacgactggtcagcaaggaggacaataaaggaaacagcagtcatgagataggatatcacgtccacatggaaatactattgttgacattgacctactcaccatctagcaccttcctctttgatgatctaaagggcaattagccttcacatcttccgagaaagaagaagcacgcttctgctgagataatacaaacacttagagattgtgctcattttgtaactaactctcttaagttctttacttagagcaaacttctgtccaccttcaccaaatgtggcaacttaatgattggggtcctgaatttactccagctttcttttcttttcttatcctgattttctaagcaccttggtttcctcatctatttttattttatttgcagtttttgtcagcagcctcaaatggtcttctgaatgaggcagaatataaaaataaattatctcacttatatatagaatctaaaaaagtggatctcatagaaacagagtagaaaggtggttatagcaggggctgtggggagagggagaaggtgttggtcaaaggccacaaagtctcaggcgggaggaatacgttttagtgacctatcgcactgcacagtgaccagagttaataataatgtgttacatatttcaaaactgctttaaaaaaggatttttaatgttctcatcacacacacacaaaaggtaagttggtgaggtgatagatatgttaattagcttgatttaatctttctacaatgtatgcatagatcaaaacattacttgatttaatctttatacgatgtatacatagatcaaaacatgacactgtaccccatagatgttcacaattactacttgtcaattaaaaaataaattaataaagtatgaataatgtgagcaatatcatcatctcctttcctcagattaaaaagcaacaattaggctaaagagctttttcaagattcaacagataaattaaattacaaaatggggccctaacccgctaactacaaagttcgtgttcccttgtttatgtatctacatacatatgactacctggtatgttgggacacataactgaaatccaaatatgatatttttaaatatcatgtaactttttagtttccatccacgacattaagactttttaccagatttgtcaaaacatattaaatcagactgatttggcctttactttccttcctcttcctctcagttctgtgatggagatgccaacatgtaatagagggacccaaagtggatgccagaagagagagaacaattaaaggatgcagagaatatgtccagtgagacgtttgcttgtcagtgtctccctggtggtattagaggggagaatgttccatctgaacagattaaaataatgaaacgtagcctggttttagaggaactttgttttatgatctttgaaacaatgcagacgctccattgggactgaatgttataatctgggagcaggcctaatggggcctgcttttattgagtagagagaagtgcttcgtaattagtgttgcagttatttgtaaactggcgtgtctaaaatgcttgagggcctctataccagccctttaatattttgaagctgttgtcacagaaattgcatttgtatttataatttgtgctttctccaaagaaagttctatggaagaaaggtaaatttctgcctactctgacatgattacaaatgctggttttttcgatgacacaatcagatttttaaatatatcattacttgatttccctgtaaggaaagttagaagagaggtaaactagtatatccaagttatggctgagtctacaggagaagcaaaagttggacttaaccaccaagcttctataaggcaagttctttccctaattcattctgagtctacaaaaggcggttattctacaaaaggcattctatgtcaatccctaagaaagattccactgatactccaaattatagaaaagtttgctgaggctgttggttacaagtgacagaacccaactaaaaccaattcagaaaaaaaggctaggggagtacttcttggctcacctaagaaaatcacaggtaggcaaatgtggagttgacctctggatccattgggagagtaaatgaaagaatatcatctctctcatactgtctctttctctctcattatctctttcattccgttcatttatatatatttttaggatgatgaaaacaagaggtatccattaatgtttcacatttccactttctgtttgcttgggaattagttgccatttcagttagctataaagcctgaggaaattcatatagcttagaagagactgaggaaatatatcacccaaatgtcatatgtggaccttgtttggatcttgatttaacaaaataacagtaaaaacaaattgagacagtcagggaaatttgaaactgacaaaaattatttagtggcaataagaaattattaatttttaggcataatggtattgctgtatgtttttaaaagtctttatcttttaaagatatgtactgaaatatttatatatgtatatggtctctgggaagttgcttctatgtaatccagtattgagcgagaaaggtggtaagtgggtaaatagatgaaaccagaatgcccctgaattgaacttgttgaagctagatgatgggtgaatggttcttcattgcattgctctctcaacttttgtgtatgtttaaaattttcccaatgaaaatcttttttaaaaggatttcaaaaattagaatctagaccaaaggcagtcccagaaatccatgagtgtctctaccttcaggttgttttccagttagggagatcttccctttagatatgtctgttccaatgatcctaaaaggtccagattgccctgagcgagtaggcatcaaaacaatgtctcctctgaaataaactcagccattccacccagcaacatggccaaccgccgtaaccacaaggaatggggaccacagggagaggttggagtaatgatgagcttaccacattgatcattccatcaaagtgggtacatatttaccaggaaggtgactttactgctatttgcaagaatgttaagcttgctgtggggtattcactggaaagctcccaggaaaagacagtgagatgtgaccctgttctttggacccttgcgatgggcagagcactcaccagtgtttggaaagcatactgcaagagtgggaattactgttttcaaggatttgcactacttatttttgcatacatgaatataattaacatagaatgatagttcagatacagatgttaaggttacaataggggcttgatatttctctttaagtgtttagtttctgtgcggtaaaataaacaggtagagctcttaatttgtcattactaaatttcatatacctagcactttaggaagctctaactgcataagcctgtctagaacttgtcaattcaaccccaagtctctatcatctgtttaagaaaacagtgaactgagaaagtgactctgtattataggatcaatggtttacagccttaagtgaaccattctgactcagatttcaaatctgaaactcacatacttactagtaaagcccttgacaggagaaatattgcaaatgtgtaattagagtgggcaaaaaacacacaaaaacatcaacaataggtataagattttgcaatgccatctggtggatgttactaagccatatccatgttcacatttccttccttcctgcttcagtctctttgtcttgaatgcttgggtttctaaaaggagaaactgttttgctgcaaatgctggctttgaggttgggggttggaagagaaactttcttataaaaggcagagtgttagaaaaaaagcaaatctaagttaacttgagccgtggagggtagccttcccttccctgggttaactctaattggagctccccacagaattcactaatgatttccttacgatgtgattaaaaataggaggatgctgtggaaatacgtccagtaccagaatgtcccaaggaacacctgggcaacagaatattggtcaagttgctgaccttgaagtaagtatcaacaaacacactgccaccgctttgagatttatcttgccttttacatacaaatgttgtgtttattatcagagcttgaatcaaagcggagctcccaaaatacgtctaacagtgggcagctgtggagtagtagaaagggcacgtttgagtccattcctggattttttttctaccaacttcttgatggtcattcttctacaatagagaaggcaaacacacgtgtctactaaagttaggcaggtaaggtcattgagtgaaatgacctacattaagaaaaatagcgcttaagtcagtggtgtgctggagtcgactgtactaactcgtgagatctgacagtgcatatctcttcctgggttcggtgaagtcacattggtaactttaaattggccatggcgaaagtatttacaatgtagaaatcagccaatgctacacgtttgcaccaccctcagcacccggagattatttgtaaaacatttaccagtatgccactgttgaaacacaatgataaatgcaactgaaactcagtgccaggggacaatagggagtggtgaggactgtagtaaactatgttaagggggcactcactgctagcaacagactcttgccatccaaataaacaggcccatttttgtcaactgtcttttctattttttcaagagaagctgaaaacccagatttttctgcataatataccgactccctaaatatgttctcattccctttataaacaccatataattaaaacacgactacagtctggtttcatcttgtgggccaattatttgccacatctacttcaaagtagttgcatccaaacgtttcaattgtatactatgatagcaaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatacctctcttcgtctctgcagactgctattttcaagaattagttctccttcaaatccacagatgaaaactttaaagttgtacatattttacctaagcaaaactacagaagcgtaacatttatttatatactattagatgggtcatccatctctcaaagtcacttcataggtcccttcagcggcccctggtttgcagtgagaaggcatctggattctggatgtaaggctgggtttcaacccctgggaacttccctgggattttgagttcttccctataaatgaagttgatagaccttatggtctcaaaattcctacctaccacaaacttctatgattctaacgcatagcctctgccaacttcttctgcctcagaaaacaagccagcaagtctgctcacacagctatgggtggtctcttgatattatagtctcctcccgctggccagttctaccagagggtcttcagggccttttgtacggagaaatgagcagcccataaaccagctgagtgtcaagtaatgggcacagaaaagcaagctcttgcccttgcaaaccaacctggcagtgggagcttcctcatctgtctggttggcgggaggactgagtggaagtggctcttcccctctgcattgtttaggaagccttcgctattgtctgagggacacacctgccccgacaggatgcatcatcaggctacttttagatgcagcgactatgtcatttgagatggcagaaattctcctctatggtgctcatagccaagctttctagacctctccagtgaatgagaggcagctgttctcacaggtgggaaaacatggtcactaagagagatatgtgttattttaaaaaaatgttaatggaggccaagtgtggtgactcacacctgtaatcccaacactttgggaggccaaagtgggaggatcgcttgaggccaggagtttgaggccggcctgggcaatatagtgagaccccctctctaccaaaaactaacagatgtgttaatttttagccctagctacattgggaggctgaggtggaaggatcgcttgaggccaggagttcaaggctgcagtgagctatgatcatgccactgtattccagcctgagtgacagagtgagaccctgtctctaaaattaaaaaaagaggagtcacttgaatatctcttaatgaaaattgtaaagtgcagtttctagtgatgtccccgcaactgccaaagcagaaattaagtcgaattgacatatttgccaggtgcacttggcctgctcatgtgttttaaatagtatctatactaacctataactgcaagagaagagatagaccaaaaagacagccctccgagtaactacttagagtaaactagatgaaagaaagaaacaaattcttataggtaagcctagaatgtgacagtatgaatagtaaaaatataagggtaatattaatggcaaatgttttcccatttacattgatatgtaggattctattcataatactacatgttttagcccctgaggaatttgtttaaagttgtagacatctgtaactgtctctgtattgcttttcagaaatatagaaaccctcaaagatacagagagaattagggtcctgccaattctgcaaatgtttgtaacagaaaaaaaaaaaaagaatgacaacaaagtatttttctgttttgtgttttaaatggagaaatattttaagatttaataccatcttatgaaaagtaatctcagctcttaggagtcttcttgatggtgaaactttaatgtgcagaaaatttgcccaggcagtttcttttaaatgcagattttggaggaccttccataacaatctccctcaagagattctggttgagtaggtctcaggtgggatcaagaaacctgcatgctggctaacttcttttgcttcaaaatgctagattctggggactacacttaaagaacaaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaaccggaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgaccagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgaacactcacggaaaaagcccaggttctgtgatcagagatggctgggctcaaaacctgaccgtgccagtccctaactgtgtagactttggcaagttccttattccctgggaaccttgctttcctggtgtgttaaatgcagataatatctgcattacgctgtagttgtgtaaagagactgatgtgtggaaagcacttattataacacaattttaagtctttaataaatgtcaattctctttttctttctcggaaccacagaggacttactactcagtaccaacctaagtatatcacagcaatattcaggccctttgtgtagtagggagtaaacaattaaatatagattgagcatgccaggcagcagctggtgagcctaggcccaggaaagcctccaattggcctggtgcagtggctcacacctgtaatcccagtactttgggaggctgaggcaggtgagtcacctgagctcaggagtttgagaccagcctggacaacatggtaagaccccatctctactaaatatacaaaaattagctgggtgtggtggcacatgcctgtagtcacagctgctagggaggctgaggccgaagaatcgcttgaacctgggtggcggaggttgcagtgagccgaggttgcaccattgcactccaccctgggtgacaagagcaaaactccatctcaaaaaaaaaaaaaaagaaagcccccaattaatgtgcaattacctaataatagaaagaataatcatagaaatcctcaacactgggcttttcggtggtaaaatgtatgtaacataaaatctaccatctttttttttttttttttttttttgagacagagtctcactctattgtccaggctggagtgcagtggcatgatctcggctcactgcaacttctgcctcccaggttcaagtgattctcctgcctcagcctcccgagtagctgggattacaggcacttgccaccacgctcggccagtttttgtggtttagtagagacagggtttcaccgtgttggccaggctggtcttgaactcctgacctcatgatccgcttgcctcggcctcccaaagtgctgggattacaggcatgagccactgcgcctggccaaaatctaccatcttaaccatttttaaggtacagttcagtggtgagtacattcacattgttctgcaaccatcaccaccatccatctccaggaatttttctcttcccaaactgaaactctgtacccgttaaacaataactccttattctccctactccccagcccctggcaactcccattctactttctgcctctatgaattttactactctaggtgcctcatgtaaggggaatcatgaagtaactgtctttttgtgactggcttcttttactcataatgtcctcaggttcatctatattgtagtatgtatcagaatctccctccttttatggctaaataatattccattgtatatatgtagcatattttgttatggcctcatatatgtatctgttcatggacaagtgggttacttccaccttttggctattgtgaatagtgctgctacttggcattgtttttaagatacattcacacacatcattatacgtgatcctcacaacaaccaggaaaatggaaaggcaagcatccttaccttattttgcagataaataaatggaattcagaaaggcgagtaacctgattagggtcgcagaattagcagatggtggaggaggaacagagtccaggtctctgcctgggtgccctgggagtctgccatgattccaaattgcctcatttccaaaggcgccatttgagcaaataaccctttttgtctgtgctcatattctgtccaaatattcttctaaaaagtcctcttttgagacaaagctatccattgatgaggacatcctctcacacatacctggagacaaaacatgactttattgacatgatgtctgaggtaatggtggactggggcccttttcctggtgctctctgcaggtaacatccaaagccatgggacatcaagctgagaaacttggaagaccttcaccagtgttccatgtgcacctgtaatgtccaccaagatactaaaggcaaataatgcaccaggattatgctttgggattcaccgtttcgaggggaattggcaattagggccaatatgagggctcatctttctagctctcatggggcccaggcacctcagtgtttatctgctgtgctcaagcccctccctgacctcaactcagcaactccccagtaatggagttaggaagggccagacattcatccccatcaaaacccagccttcttctgactgtcccactacaaatctaaggaaaagcaattgaacttttcttttgttgccatctgaaaagccccattccttagaattgaataatacagattctatcctttaaatttttttatttcaatggctttagggtaagtggtttttggttacatggatgaattgtatagtagtaaagtttgagattttagtgcacccgtcacccaagcagtgtacattgtacccagtatgtagtttttttatccctcatccccctctactctcctgcttctgagtctccaaggtccattataccactctgtttgcctttgtgtactcatagcttagctcccactaacatacagcatttggtttccattcctgagttacttcactcagaataacaacccccggctccatccaagttcctgcaaaagacattaattatttccttctattttatggataagcagtattccatagtgtatagataccacattttctttatctactcattggttggtgggcaattaggttggttgttggttccatatctttgcagttgtgaaacagatactatctagcaataaaatgtgaaatgtgaacaagtccattacctcagacagaaagtctaccctctgaaaacacagtagttacaataagaaggtgaatcacactaaaggtccattcagcccactctctcttgcagtgagtgagtgaatgagtgagatattccaaaaatatccaccatgcttttgtaatgtccaccatgatctcaaatgattaggaatttttcacaaacctcctatatttctctattaatatcccagtgcgattctcatatacttggagttttccaaatatttcgggaaactgctcatatttttaaccagtttatctatctaggtgttttcagaaaattcaaaattatctaactcaaagccacatagattttcctctctttctatggtaggttcgagattgaaattgagcccctgtttgccagcattgccctctacgatgttaaagaaaggaaaaaggtaagaaagcaaagaaaaatccatccctaaggcacatatattgttcatgattctttgcatgtatgtttttaaatttctttgcagcaagaacctatcagatttgaaagcaaatgatctttgatgagtccagttctgttgcctttgcaatttttcaagcagtggtctgagaatgtaatttatgatctttgaagaattttagagggagaggctactggaggtgctggcctggttggaatagagaaagaatgaaatagcgcatggggttatgtataaaacaaacccatttaaatacatttttaacaagcttggatgcgcatgtaaagcttcctcagtttgagagttctttgcactgtgaaataggctcatgactgaagggcatcttacatggtagaggtctcaatttgtcacagagttcagaccttaccaactgtaatgtgcttttaatgaaaacagtgaccaagacctctcgtgtgtttttaatgtttagtcattttgtgactcctagaagaggacagcaatagcaaatccagagtaggatggacacttctgcccttctttacccataatcattctgtatttaaggaaacaagcatctcctgcataaatattaataatcactgagatttgtaggataggttaactgctaaaacaagcagaacccaatctcagtggtttaaagcagtagttctcaaacttgagcatgcatcacaatctcctggaggacttgttaaaacacagattgctggacctcacccacagagtttctgattcagcaagtccaggtggggcctgagaatttgcatttctaacagtcccctgctgatgctgaagctactggtcaggggaccacattttgaaaaccgctggcctataagcaagaagttgctgtctttgtttctttaaccatccagggtgggaggagggacccctctgttccacgcagccactcagaaatacaggctggcagtggctcctccatcttcagtatgttctctccccaaattactcttgtcactgccattgctgcccctgaagaagagaaaagaaggatggaggaggcctggaagtttgatacattgcttctgctaacaattcactggagagaattgagtcacatgatcacccctcattgcaaaggaggctggtaaatgtagtctctgcctgggcagccactcaccactaaaattctcatggtgatgaaggagagaacccaaccatacagtggctcttaagtaatacgacactaagagagccaggagcactgttcacatcatgctcttgctcagaatcttcactaagattcattccctacaaccaggctttcttcatgatggcattcctctaccttctttccatccatagtctatgcagagtcaagctagaccgctgactaagcttcccccagccgttcaagcctctgagatatttattcatactctaatctctccctggcacatcatcaccttccacccctgcctatcagaatcttctaaggcccatccatctccagtgctgcttccatgaaaagttgtccttgtcacccaactgcaaatggcctgtcactctggaacttccacagtgcttctttgtatgcatgtggtgacttgtattttgcttttactgtagttagttacatgtttaccttttccctcacctttttttttttttttttttgagtcagggtctcactctgttgcccaggctggcatgcagtggggcgatcttggcttactgcaccctctgcctcccgggttcaagtgatccatcctcccacctcagcgtcccaagtcgctggaaccacaggcacatgccaccatgctggctagtttttgtattttttgtagaggcagggtttcaccatgttgcccaggctggtttcaaactcgtgagctcaagcaatgtgcccgccttggcctcccaaagtgctgggattacgagtgtgaaccaccacacccagtccttccctcattcttgattgtgaattaattgagagcagaggtcctcctcttctgtagtgaagtaactgatactcaggaaataccggtgggttaataaacatttaaatgtttcaaggaacatctctcaaatggctccagaatacctagacattgtgacaaaacatttgtcagatttatccaggagccactttcctaaaccacatctgtgattattacacttactccttcagcaaaatttctctgtggtgtttttactcctttttaacatgtttaaaccatgaatgcaacaggtctaacttatatttcactttgctgctcatttacagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaaggtaattcagtacgatctgatttgcccaatctgatgttttcattgctgtgttgttcccagcacatgtttggggtgcacgcaatctcagaatgtgtccacatatcctctgagattcactttgtttccttctcagtttaccccttttccgttctaagtaaactgtttcagatactagaaagactaggttttggagacacacagacctaggtttgagtcctggctttacaacctagtaattaaatggcattggcagtttcctggtctttctgagactgagtttcctcatctgtgaagtggagataatcacactgacctcagtggatagtcatgactacagaataaagcttggcacatcttgggcacccttctcctaattaaggagagttccctcagtgacctggtgcaaagaagctgctgtggagaaaggaacaaaatctctgggctagagtttcctaacgatgttcatgttgctctagagatgcatagttacgtgttcccaagtccagcctcttacaagctgaagcgtgggctgtggttttcaagtttcatcctccttttttttttttcttcttaccatgtcacagactgtctctaatgagagttgaaatctatggggcaattgtaagtagaagagcctttcattctaggctatactctttgctgttgtaagaaaaccagatcctttctctgtacaccaaaatgactggttagaaattaacaaacatcaggtattttacctaccttaggccagataattggtcttattgattcttttttttttttttttttttttttttgagaggagttttgctcttgtcacccaggctggagtgcagtgtcaccatgtcggctcactgcaacctccacctcccgggttcaaacgattctcctgcctcagcctcccgagtagctgggattataggagcccaccaccccaaaccaggctaatttttgtatttttagtagggacaggatttcaccatgttggccaggctgatctcaaactcctgatctcaggtgattcacctgtatttggttcccaaagtgttgggattacaggcgtgagccactgtgcccggccgtaaaatcattgtaaaaacaaaacaacaaattcaggtgtctgatttcatgtgcccccagcctcttaggtttggaacattatctagttagtacagtgttttatgtctgtagtctcagtgatcgccccatgatctcatggattccaaataattcaggtagctttgaggtcacttaacagatggcaaatgtcttttcactctagcttctttaacaccatataacaaagattatgagaggttactgtagcttgaggggaacttatttaagcttatagaagtatagttaaaattatattgctgaaaagacacttctattgttgtcaaacttcaatgtgtctccttttcgttgcaatattacttagacatacaggaaaattaaagcccactatgatagccctgtaggtaagttcacaattctctgtcagcctaggaaactgaagaagccaacactagttctatagagccaaattttatctcaaactctacttcccagtggatgactttctcttgattaatccgtcatattctgccaagtaacagtggttacccattggttcctatcacttactaaatatgttccaaaattttcaaatgtataaatgtgttcatttggcataacaaacatactaaagtgtttggataggtttaagaaattgaaatctactcagcaagacagcccctggttggctttctgtttgcttttctttatcgtaatgccatcattgttgcttctttccctttaaatatatagtaaatggtgttaaactatttagcacatccaggcagacattatttggtaagaggggcttctttcttttttgtttatattcccaggccgaacatcagggtctttactgtattttaggtagcatcatctagttcaggtgttgcatataatacggctttaagggattatttccgcttaaaagtttaattcaagattttgtgaaatttttttttaaaaagaatttgttttacaatcaaggaaagaagagtgaaaatgggattgaattggaaacttttcaaaaattgtttaaaaattggtatgccgtgcccaatttaaatatttcataagttgcgatgggcctatccttatgtaagggccacatagtttgagaaaacacaaagcagagagcctagcactttagaagtcttgcagatgttaaatttcccatcttaaagagtttacaatccagttaaaaaaacaacttggcattcaaagaaatgggttcaaattcctattttgctacatttgctgtgtatggtagcaagtttagtctgtcagtctaattggacaatgatccctgtgcctgagtggttttgaagaaaattgaaataatgtatgtaaaaacacctaccctgtacctgacataccataattaggtaaacaataaatggccatgaaatatgaaaaaaataggtatgccaagtgttaatcctaccccttctgaatagagcagaaagtagtctgttcccttaagaaaagttttaggttaatctgataggcttatttgccctactttccatggttatgaggagtcatgcatttcattacacacttttgcataaatcatgagggaacaaacaataggttctcatgtcggtctgcagctccttctcatgaagtacctggagttctccttgcccactgcagccagggcatagtatctgctggtctggtcaaatctgacttctcctgcttcctgtatgttccatgatacacactactagtgcatgaagccgtggcattccccttccttgcttcagggtcctaattaagaagttcttcatctctgttcagaatttattctaaagaccacatttttaatccattcacttcatggaaaaattagcttccttccaatttgttctacaagctcctgactatgagcttcaggagaatgggggcagtgtttatcgccaccttatctcccagctgctaccatatagaaggtactcaacaataagtaaacgattgctgattagcaggaatactggtcagtttctagctcaagtgttacgtgcttatgttttcagtgtggtgcatctctcagtgggattcgccttctcttcatgctgtggcaatgggagggggttttgaacttctttgatgagaagagagacttcctgcttggagtcctccctgaagcagatattcattgagtagcctcatgctgcttcctttgaaaccccataaatgcccctttatcatgggtattgttaaatactttgtgcctaactcacagcacctattaagtatgtgtcccttttgtactgtgttgacccaaattctttcttcaaggatcatctcaactgatgggactaaatccactggttttactcttcaacatctaagttaaattttttttgagcagagagttaggaaatttcaaatttctccttgtctttcttttaaatatggtgcccaaatttatgacaactggccagccagtcactttacctgaagcaagacagaagacacttcattcattcttattaccagcattcattcctatcaacagccagttagcaaagcaagaagctgcacatcccaatgcttttgagtttctttccaagtctgttaaatccagagaattagccctgataggaattacaagggagacaattacagataatttattcggttcagtcattcattttgtggaaggttttagtccctaacccaactttcacagagaccatatctcttttttacattgtaagcaataataaagaaaatgagttttccacttcctacgtatgtctcctgggttttgttttataaaataacttttattgctgtttttattatatacataatacatgtttattgtttaaaatagaaaatacacataagcaatgggaagaaaataaaaatcacacataatcccaccatagaaagttaactactattaacacttgctgcatttgctgagtatctactgtcacccttttaatatgcctttatgatttgttaaataaaattgtatgctattctttatataaattttttaataaaaaaatatgtatcacagatagcttcctatgtcatcaaatattgtcataaaatgtaattttgatggttgcatagattcctttttatggatgtaatttatgtgccttattttaatattctttttattggtagattgaaaaagtcctgcagcagggagagattggagactgtgcagagccctacacggttatcaaagaaagtgatggtggaaaggtatggtaatttgagtgttgttaaatggagacatcttagaagaagcaggtattttcagaagtgttacacaaatagttaatgggctttagtccctaatgtgtccctatataagacactactacattttaattaaataaaagaggaaaagaaaactggtcaccgatgatgactttttttttttttttttttttttttttgaggcagtgtcttactttatctcccaggctggagtgctggagtgcaatcacggccccctacaaccttgaactcctgggcttgaatgatcctcccccttcagcctcttgagcagctggtactacaggcacatgccaccatgcttggctagttttttatttttttttagagatggggtctcactgtgttgcccaggctgctctcataattctggcctcaagtgattctcctgcctcagcctcccaaagtgttgggattacaggcatgagtcaccatgcccagcctgatgatgattttttagagaaataaatccttgaattttctaatgttgacatacagcaaggtctgactgcataacttgattggggcaaggccaccccctgttgtcttcattctgaggctctgactcagctggttgggaggtccgtggagaccccaaaactaaacagtgccagagctctcctggccttcctcaacagcatgggccgctgccctttcaggtatgcaaataactgggaattggctgccactaccatgcattatatatattcattagcacagcataggtgttgagcctatgaaaaggatatcttttctcaacagcaatttgcaaagattcccagtgtgatttttaaaacatggccttggccgggcgtggtggctcacacctgtaatcccagcactttgggaggccaaggcgggcagatcatgaggtcagaagattgagaccatcctggccaacacggtgaaaccccgtctctgctaaaaatacaaaaaattagccgggcatggtggcacgtgcctgtattcccagcttctcaggaggctgaggcaggagaatagcttgaacctgggaggcggaggttgcagtgagccgagatcgtgccactgcactccagcctgggtgacagagtgagactctgtctcaaaaaaaaaaaaaaatagcctttctggaataagacttaccttattagtattgtactctacagactcataaatgtcaagtaagatttattgaactcaaggcattttttttttaaaatctgtcttttattctgaactcagaaagaacaccttggaagtattgtaaacttcctaaggagttgttaggaagctttttagaattttttggagttttccaaggtgacttttggagaaacaggttcacttgggagcttggtagatgatatactaaacttgatttcaagattcttttatgcaaatccaagtcacatagctagccaccaaaagaattgataatctgatgtaatgagtctctttttgttttcgttagctaaaaatgtattttactaattaaatgtagcctttttgtaaactcctcgttttttaatctttatttccttatcagctagacccaagtgcatcatttttctgcctattcactgtttttattttttagtgggaagatatgtttttactctttttaatcagtagggtttggattttggagatggctgtcatattcaggtcagaggcagttgacttggtgctgatgcttgtttcagcttgtttctttccattttcctccagagtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttggtaagattttcacctgcagtgggaaagggagggctccccagtgtgcgctgcccaggtccacagcttactagcggggactgggggcacagtgaggtgtgggaagtggggaggcagaaggagataaatagaatgaaacactgttatgactggattacgtagatttggacggtgatctccaaaagaaattatcacgaacattggtgaagattaagtatactcttatagtaagattttctagatggtatgacactttaaaaagctgatttttgctagccacccgctctcaaaagtaaaactttaacaagaaaatgtagtaaccatctgtagtgtgttaagcagagacaccatggtcgactcctaaacctaaaaaaaaaagcctctgttacaaaggcttcaaaaagcaaaactcaacaggaacagggcgtggtggctcacgcttgtaatcccaccactttgggaggccgaggtaggcggatcgcttgaagccaggagttcgagaccagcctggccaacatggtaaaaccctgtctctactaaaaatacaaaaaatttgctgggtgtggtggtacacgtctgtaatctcagctactcgggaggcagaggcaggagaatcgcttgaaccagggaggcgaggttacagtgagccgagatcaggcctctgcactccagcctgggcaacagagcatgactttgtctcaaaaaaaaagaaaaaagagaaaaactcaagtttcccagcaaaatttccagttcgttaaagtttactttgccaagtgcaatgaaaaaatgggcatccaaagaatatttactgttttagtttatttagcatatttctttttcgtcatctcacccgtgatctgaatcattcattcctacactgcttggtgtagaaattttcaaaagggttgcaaattttcaagtagacctgcccatatcacctgtggtggggtttctctttccctaaatgcttttgtatccaccaaatatagaagtccatgttcacatcttttcatgcattccttaagctaaggcttaagccacttctgaaatactaccttgagcagggaagtggaggaaagggcattttgtgattgctgctgctattttggagttactggtacataatcaccagtcagaactcctgggttatttctggttcgtcaataacaaacctcactttaccacatcctgatcttcctgccacagctttctttaatgccgtctatgtagacccaagtaacttattgataagagttatgtatagagcttagagggcacacaagctaggtaattcaggatagggcatgctgaggcctcaatcatctctaggtcaaggataacctgacaacagagactgattcttaaggagcaaccagaagatgcaaagatgtcatgtattatactgaggcagaatggcaagtttaggtgggtagaggtagcaagaaattctaattcaacatcatggtaagaattaaggataagaagatactcaaagacgggttggaactgctctagttctaagcaatttgattatttacaagagaacccatgagtttttgcaatataaaagcaacaagatctccacccaaatcccaaaaggggataagaaacaactgggcaaactatcagggtcccagcccaagtctgagtgtgatttggggttctaattcccattgggcagatcacccaaggcagaaactcagtcttgctgcctggtccacataatgagagcagaggaatgctgggattcagagtgtacacaggctgaccccagcatgtttgggtcacaatcacaaatgccttcaggggcatttgagtacatgcctctcccagtggaatgcaaatatagaaataaaagaaaagcaaacactgtgctgactaaataaagcttatcaggagaccctgttctggctatagctctggactcttgccgggtggcatttgggctaccctaatttccatgtgggaggggcccatggctgctcctggcctctctcctctggtcggaggaggattaaggacaccaacaggaggactaagaaaggtaggggccaatggaaggacattttcattcaaaacaaggatggccatattcagtgttcctgatcagtgactttaatcatacatattgtgaagttaataactgctgtgtgtttgaacagaaaggcatactttggagtgacaattgtttttcttaaagggagaagctcagtgggtgaacggaggacattggcccaatctagaaggctttctgaaagagccctctccttggaggaaaatggggttggatccaacttcaaaacctccactctgagcgttagcagctttttcaagcaggtatctcttcacattacagtgtgtctggatttttccccatactggcatgggcactggaacccacaggaggaggatacgtagtgattaagagagcaaattagttaagctcactctcttagttcattttctgctgcttataatagagtatctgaaactgggtaatttaaaaagaaaagggatttgtttctttcagttttgaaggctgaaaaatccaaagttgagggcccacccttggtgagggctttcttgctggcggggcctctctgtagagtcctgaggtggagcacggtgagcagctgagcatgctagctcaggtctctcttcctgttcttataaagccaccagttcccctcccatgatgcagattaatccattaatctgtgaatggattaatccagtcatgagggcagagtcctcatgattcaatcacgtcttaaaggctccacttcccaacactgccaccatggggaccaagcttcaccatgagttttgaaggggacattcaaaccacagcattcacaaagcctcaatttcattagccagaaaacgggaacaatagtacttaacttcatgtggctagcaggaaggtcaggtgacatgagacctgtcaagctcttcttagagtgcctggaatacagtaagtgctcaatgaatgttagctattttaactgagagaagggttaggttttgttccttgtgataccaactatcctatttgaactatcttggccaatccattcattatgctatgacaacagtctggctgggccatctccttcccggtggatctcagggtttcttggcctggctattcatgtgcaagtttccactttcactactgcttgatgtgcaagtttccagggctccctgcttgctcagagagggtgaccattccagatggtactctttgttagctcagtaaacatcaagactatttaaaaaaataaaaaacttcctagacttgtcaacggtatagagacagaaagtagaatgacggttgccagggtctagggatagaggggtggggagtcactggttaaagggtacagagtttcagattttttttgcaagacaaaagcattctggaggttggttgcacaacaaagagaatgtgcttaacactactgaattgtgcacttagaaacaggtaagatgggccgggcgcagtggctcatgcctgtaatcccagcactgggaggccgaggcaggtggattatgtgaggtcaggagttcaagaccagcctggccaacatggtgaacccccgtctctactaaaaatacaaaagttagccgggtgtggtggtgcacacctgtaatcccagctacttgggaggctgaggctggagaattgtttgaacctgggaggtggaggttgcagtgagccgagattgccccactgcactccagcctgggtgacagagtgaggctccatctcagaaaagaaaaaaaaaaagaggtaatatggtaattttatgttagttatattttgccacacttaaaataaactcgcttggtctgactctgttttggaaagttttccatagctacgcagtcttcgtggagcatttaaaggggttacattaacaaactgaaatgcaaaagggatgctgagggcgcctgtgcaccgtgccacatcatagaaatagtaaaggtctgaaaaggtttctattcagcatacatgtacccttcccaatcttatgaccttggaggacaaggtacttaactaagtctggatggtctcactgggaataagacatatctacccacttaccttactgggttgttgtaaggattggagatcatgcatgtgtgctcctgacccatcttgggcatatgtgggggtggacagcatttatacttaaccttgttcgagacaaatgtgaagaaaatgagatggaaagatgctttctccaccttcgaacatttgaagaagaaagtaaacttattctgtattgttccggggggtaatactggcatcagagggtgagagttatcggggggaagcttttggcctggttttctaatggtcagacgggcttccttagaatgcagcagatgccccatccccagaaggactgataagaggccgaggcacagtgagtcacagtgattgagaaggatttaacaagaagtggagctcagtgatttcagagctgtctataatcctaatttctatgaaagacttgtgagaataaaacttaaaggtaaaaatcttcccagaaatcgtttgtccccaacccaagagtcaaaggtgcatctacattaactctgacttttctcttggcaggaaggagatcgccttagcgatgaagacttattcaagtttttagctgactacaaaagatcatcatccttacagagacgagtcaagtcaattccaggtgtgaatgacttatctttatcctctttagctgtgccaaaactgcttatcgttagacacagtctttgtctaatgccagaatttataaaatcatgtttgccaagtgaaatgtgagattttgtgttaggggttaagaatctgaattgttctatgtctttggcaaacctattaatgtttttttaattttcttaaaggattgatttagtaaacaaaccttgtgctttagatctggtttctcagataatgagataattgtttaaacagaggagcccctttaatcaaataaaatattatacttagtattaaaaaagtaaatgtgagatgctttggtagaaggcaaaggcatcttccttatcctcactcggcagccctggaggtacttctgtagcatcctcaggtccagggaagccagtttgtgtttgtttttgtttttttgagatggagtcttgctctgtcaccaggctggagtgcagtggcacaatctcagctcactgcaacctctgccttccaggttcaagtgattctcctgcctcaacctcccgagtagctgggactacaggtgcctgccaccacgcccagcttattttttgtatttttagtagagacagggtttcaccatgttggccaggattgtctcgatctcttgacctcgtgatccacctgcctcggcctcccagagtgctgagatgacaggcgtgagccaccacatccggctggaagccaattttaaaactcccaatttttactgctagcaatgcagggaagttacttaacaatgtaaaattatactgtggtaattcaggaaagaactttaaaaatcctctaatccattccttctcattttacaatttcttgctttatattttattttatagaggctaaatctcgaaagttatcatgacacacttttctcaagctgtaggaaattagctccaaaacttttttacagtactatagtttgttcttattttcatgaaagaaacacagtgcaacaatctttcttgattccctcataacatgacagtttctttactagaacattcctattttctctctttaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtaagaaacacaggctcgggctgggcgtggtggcttacaccataatcccataactttgggaggccgaggcaggaggattgcttgagctcaggagtttgagaccagccttggcaacatggcaaaaccgtgtctctacaacatatacaaaatttagctgggcatggtggtgcatgcttgtaatcccagcaacttggcaggctgaggcaggagaatcgcttgaacccaggaggcagaggttgcagtgagccaagattgcactactgcactccagcctgggagacagaaccagactctgtctcaaaaaaaaaagaaaaaaagaaaagcaggttcttggaaaaccgttgagctcacattctgagttttatttgaataacgttttctcatccttcaacctgtcttcctacttcctaagtttcagggaaatgaaatgtgatatttatgtaaccgtaggtgattgccaaatctctttctaaacatagtttacctaattctctttaacaagaaagggttacttcagatgtaattgtagtttaggattatagtggacatatgttttccagagattaaaaaaaaaatctgctagccattacctttgttctcctctgtgcagagggacatattagaaaaagagcaatgtgaccaaaatgtgctagttgtcaaaaggacaggttttcagctaaagattagctctttccaacagaatttacagcaataacataataatagcacacattccaatagcatttacagcaataacagaaagttctgtatgtgtgccagcagtacaatagccactaatcacatgtagctgttcagcatttgaaatgtggccagtgcaatggaggaactgaaaaattgattttaattaattttaatttaaagtcaagtaactgtatgtgtctactatattggagagtatggagctagacactgaaggcctaacaggttgggctgccttggtttctgaatcgcttatggtggcacctgacctattccatggggtctggaaggagtgcttgtcaacacatatctgccaaaggcattaatgctcatgcacttctttattttgagactatttcctttaatgcagaaaaggatgccttctataaaaatcatctcttccccaccatccagaaatgacattgttgttttctgtgtttttatataaaagaaatacagtggtactgattcagttgaagtcttcttttatccccagtctccagtcacagacttttacctcacctcctagacttttatcatcatgaaattatgtatttcctattttttctccttttacacacacttacacacacatctgtgaacgctcaatggcattatcttcatattcatttaaaatgtacgcaaatgacttcacactctaggtcaggggtccccaacccccgggccatagaccattactggtccttggcctgttaggaaccaggctgcatggcaggaggtgagcatcgggtgagtgaagcttcatttacagccactccccattgctggcattaccacctgagctcctcctcctgtcagatcagcagtgacattagattctcatgggagcatgaatcctattgtgaactgcatatatgaggcatctaggttgtgcgctccttatgagaatctaatgcctgatattctgtcgctgtctgccatcactttcagatgggaccctctaattgcaggaaaacaagctcagggctcctactgattctatattattgtgagttatataattatttcattatatattgcaatgtaataataatagaaataaagtgcacgataaatggaatgtgcttgagtcatcccaaaaccatcccctgccccccgctgccaccccagtccatggaaaaattgtcttccatgaaaccagtccctggtgccaaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcatttttggaaatatcagtattgattcatgtaaaggtttgtgggtttttttggggtttttttcgtttttttgtttttttttgagatggagtctcactctgtcacccaggctggagtgcagtgacatgatctcggttcactgcaacctccgcctcacaggttcaaacgattctcctgactcagctgcccgagtagctgggactacaggtgcctgccaccacacccagttaatttttgtatttttggtagagacagggtttcaccatcttggccaggctggtcttgaactcctgacctcgtgatccacctgcctcggcctcccaaagtgctgggattacaggtgtgagccaccatgcccatcctgttattccttttaactgctgtttagtattcctttgtgaagaggccatattttattcatttccttgttgatacgcatttaagtctttttcaagttttcagctcttacaaacactatgaagtaagattttttgtctttgcccctctgtacacgtttgtgaaagtttctttaatatatctaaaagtgaaattaccagatcacaagtaatacacatttcagtcttaagttttctaaaattttacatttgcagtcctaacagcagtgtgagagaattcccattttccagttcctcacccatactttccagtatgacgtatgtgggactaaaatgcaaagaacttcagagctcacctgatccaagcattcccacccccacatttccagatgcacaaaattaagacccggaaaggataagtgaatggttccttgaggtcaaaaattacagcgaggtggccagacacagtggctcacactgtaaccccgctgctttgggaggctggaggactgcttgagtctaggagtttaagatcagcccgggcaacatagtgagacccccatctctacaaaacattttaaaaattgcccaggtgtggtattgtgcatccctgtagttctagctacccagaaggctgaggcagaggattcttgagcccagaaattcgaggttagccttgtgccactgctctccaaatcaagcaacagagtgagaccctatctctaaaaaaaaaaaaataatttagaaaataaaattatactgagaaatacaaacagctattcacacaggaatggagagttcttctttacagtattcaggaggtatacacttatttccccatttaatccttcctggagcagctcttcattttcaatcctcattccttacatctaaacttagtccccacgtctccctcctagaggagataagcattctcaggatgcagtagtttcgattctctattccttagaggaagatgaaggcatgaaaatgtttgcttatggatgctttgtatctttttagaaactttatcctataatcgggaaacaatgcttgtggcattggaagagacttgcatccaatgaattctgtagttattcaacttcccctcagcatttaatcacccacaggtggcatttacaatgttctctactcgttcctgcaaacattatcccttaattacatcacagtgggacttagagtgcattagtgcactgaatgatccagaaatgtaggagggcaaaggaggacaagtctggacggattacaatggacccaacttgtcatcatgagaaacagacccacaaatacagagttaatcttcttgagctgtactggccactgtagaagtgccaaggacaccccgttagaaatgccaaggccaccctgttagaaaccaggtcttggggaatgacagaagagatttctctccagtttggttgtggccccttctcttggctcacagttcttctctgtggctctcaggccaccatattttatagtctatttaaggaaagagagagataatgaacttggtttggaatcttacttcatgaaaatttcacagaatttaggaagcatcttgtctaaatatcttgttctaaatttttagtgttcttctccagtccttgtgtgctttagggtggttttgattagattgggcttgacagttacccagtcccagatgagtgtcccctttcctgcacctccccccattcacgacatggaaatggaaagaatcgagtgaggtctgaaccccaggtaaaattggcaagctgactaagttcgccttgggtgacctcaccttttcatttctgtccattttcctctctttttgttccttgccatctccccatatctcaaaaaacctggaccttgtagcttttctatactggcccccaaaataaaagtctcttttcaagcaacgatctctaaactcatttgctatggtattgataacaggtatggattagtcttatcactcccaagagtattatcattttgggccaggtgtggtggctcacacctataatcctagcgctttcggaggccaaggcaggtgaatcacctgagtgaggtcaagagttcgagaccagcctggccaacacggtgaccccttgtctctactaaaaatacaaaaagtaactgggcgtggtggtgggtgcctgtaatcccagctactcaggaggctgaggcgggagaatcgcttgaacccaggaggcagaggttgcagtgagctgagatcctgccattgcactccagcctgggcaacagagcaaaaaaactctgtctcaaaaaaaaggtattatcttggcagggacagcagttcctatttcttaattgaagaaatccagatttcttctcattccaagagtctgtcaggtaactttcactgttgatgttgctatttccatgccaatcaataatcctgatcatacctgtatcccttaaggaaatcaaataactgaaaatgaagatctgtggggcagataaattcaggaatatttcttcgtttatagaggattcacctcatgaatttgaaatatggcttggcttataaaaagttgatctgcctggagcttgtagctaacacctctgtcgggccaaacaataaatgcttacactgagaaagccaggtttgggatttcaaattaatgtgcccttaacataaactgcagagcccccctgggtggagggaactattacctggttctaatagcagatgttttctggccttgagtgccagtggtaaccagagtcacacattttaggattttggtattgatgagggtttcagctgaatattacttgagttgaactccagttatctttacctgtcttaaaggagcagctgccatagtgcctcaggtaaagttggcttgggataggctggcattgccttccagtccccagcctcaccttcctcccacctcttcactgcctcttttctttgccctgccccttcaggtgtcctgcgtggggcaccattcgagttgcattctagtgtattaggttggtgcaaaagtaattgcggtaatgtgtgtgtgctgccccgtgtctctaccttattcaagtttctttaaggaacagctgtagatgagttctggtagaactgggtagtgctcccagaagtatccccgtgggtccgtgagggttgggcattcataaaataaatccttgctctaacgatagagaccaacttctagagccagaagtgctcatcccaggaatgaccaggggctcccaaaccagcggctcgggccctctgcagtgccatgtgcagcctctgtgggttagaggcatggagctagagcagggtcctctgaaccagagccaggcaggacactctgagaaatcacaagcagaaggacagcaattctgaaagcagagcagaacagctggaaaaactgagctgatgaaaaggattatccgaatccaagcttggcgttccttgctctgtgtccagattaagaaaatgctagtggtttgcctaggaacacatttgcaccaactcctggcttattttccatgtgacccaacagctggtactagagacaccagctgctttctggtgggggcagaatgaaaacagcatgggctgaggccaaggcccagcaaggtcttcaagggcatcctatcctgcggccgccagaggggtatgtgcggagatcacaggcaatgaggttgtaatgagctgttaagctccctgccgtccctttaatgggtgattacagtaaaaagagccacataaagtacgttttcatctctcacttcagcccccgagagcctctgaggtcttgtttatccaattatcagacttgctgtggaggacggtgcttgctgagaacaagcatatcagttggaacatgatttctctgatggataattagctgttttcaggactcctcctattcagctgaatgttctcagaccagaagtctgatctggcctaacggggatgtgctcccatatcgcagtggagtcttaaggagtactacccaccttctcttctgcgggggaaaaggaatggcgtagcatgcatgcaggacctgaccggaaggaatgtctgcgagttatgatttagtgactagaacttctaaggaaagaaatgaaccagaaataactgcaaacgaagtggttaggaagaggggcaggacatggggagtatccttgaaagggacttaatttcatccaaggaaataggttcccagtttaagcccagttagctctgtattcagagtggatcttctcagtgctaggtgaaggaagggtggttgtgcatcagagtaagtgtccagccccaccctgaagactcccattcaggtggtctgggatggggcactggtggtctgacactctcttttgttcaaaatcaaagcgtccccctccttctcatggaagggaagcttccaccaacccttaatgagttcctgtaccatatggagttgtcaaatgctccataccgggcacagcggctcacacctgcaatcccagcactttgggaggccgaggcgggaggatccattgagcccaggagttcaagaccagcctaggcaacatagcaagaccctgtctctacaacaacaacaaaaaaattagccaggggtgggggtccacacctgcagtcccagttacttgtgaggctgaggtgggaggatcgcttgagccaggaaggtcgaggctacagtgagccgtgatcatgccactgccctccagcctgggcaacagagtgagactctttcaaaaaacaaaaacaaaaaactctgtcctaagtatcagatgatgcggaagcccagtacttggttttactaggcttagcaagcagtcgcttatggaacagaagcttttataaacaaaccatgtagttaggaagggcagtggcagcccaggcaaaatctagtcatttgaattagccaaggaacggagacaaagacaaagtgaatttctggtgctagttgcaacttggtctcgataataaatcaggaacacaatccccacattcctaatgccttgctccaaaactcagcaatcctcctatttgtaagaatgaaaaaattcaggagggaaccaattgcctaaggttatgacagcaaagctaccgttccagtataatattcagccactagaggacacaattcactcactttctagattcagacacacgactacctttttcgttacaaaacatatgaagtcgtgatttatgaaagtaggacacatattgtattttttgcccttgaagtgcaagaccaggaaaaactgaaaagtattgcagcatcctccgagatcactgttgtcattttttcgcaaaggattttattctagcctgtcagtttctgcctcctttcattagtaagtcctgaccttagacatctggcatttttttggaaggtgtagtggggagggggaccaagagatgcatcccttaatgtagctaaagatcgaaatcttctcattttggggagagttgcttactatacatatttacacattcaccaattttgtctcatatgtaaaccacagaatgtgccgaattttcctagaatcatggttgaggcaggtaggagtaaggaggtgctgtgtacattagtgtcactgattccaccgttcacaactccataccactctccttattttatactcttgagtccacagtgctttggtgttacagcccatatagaacggtcctacctaaaagtcctgcggtcggtttaacagtgacgagtgtcatttttccactgtcctttacatagaattcagcaggaagcttcatgaggcaccctgtttctacatgagttgccctggttggtggaggcagaagcaatggagaagtggtgatgaaattaagtcaaagttaggcttgcatttgactctgatcttgaatagtttgtctagattagagggagcacctaaaatccaaaaagccttttgtctttgatttctatacttttgttagttttacaaattattatttaaaatcagtcctttgaagtggcttcttctcttctgacgggacagctttgggaaactgtttagtcttatttcttttgctattgggaagttgtgggggacgctattttgcagctttttcatcctcagttctgacctcctcatgtgctttacagatgcccccaaaggtcagcattcatccacctttcactgagagtgtttggccatctctaaagcagaggtattttaacagctctccttaatggatgtcctgtggtttcaggcctcagacaggctgcccttgggccctcagcagaagtcgggaatcgtcttatacttccagatcgtcttttactcaggcaaaatatgagatgctgtgtcagggtttcccaagggaagaaactgagtgggaggtgcaggtaaaccccacagtacaaaataaaacagagctgtgagtagttgaaaggactgtgttttgacagcgtaataaggtaattgtttaaaaccatggctaattcatcagatgtcatgtgtcttttatagttaaaagatgaaatttctttacccactggtgtcaacaacagaaagattctaaaactttcaaaaaatgtgccagtcctggctgctttgtttcatgttctttgacaactttcaaaatgtaaattgagattcatgcaactattaatggaaatataaatatcatggcttcataaggataaaattagaggagctcaacataacggctcattttaatgatttctaaggggtttccatgcccaggctaataactgtacatttagcaataagcaaatctcaaagcctatttcttatctttccctagaattacagcttttaagcccaagctggtcgttccttttataccactccactcacttgataggggtgacatgggctgagctttctctcctatcagggctcaaagacaagtttagcagcgtttctaaacttctgtcaatcagctcacaggacacagaccagtttcgttatcccattaacagatttacatttctgttctctggaagtgtcagttaatgtccttaaaggtaatatacacaaatgtacacaatagtctctgaatttttctcagaagacacactcagaaaccttagaattctgattcattctctttggctcagacttggatgaatttgcttctcagagtagggacatgaaaattattcttaatttatacttcatgtaatctgtttcttctttctccctccgccgccctccaatagctcttctgagcttgtttgttcttcccctaactcccattgttgaaaacatggcctcccctcattctcacctttccaggaatctccttgtgctcctcaagttcggctcatcgcaaacttggagttctgttttctcatgcccttctttcattttcttcttttaagagacaggatcttgctctgtctccaagattggagtgcagtggtacgattctagctcactgcagcctcaaactgctgggcttaagtgatcctcccaactcagcctcccaagaagctaggaccactgctgtgtgtcaccacaccagctaattattttatcttttctagagacaaggtctcactctgttgcccaggctggtcttgaactcctagcctcaagcaatcttcctacctcagcttcccaaagcactgggaggtgccactcttcttgtgttttttacctttgcatttatttcctggttacaatacttttaacttaatggctgctgaactagattctgccaatgtacgtgccgtccaggacacgttcatgccactttaattttcttagaacatcaatgagatagtcttactagggagagataaagggcaggggtttggttttctggcaggttttctttcattttaataacgagccaacccacggaggaaggaattgattgatggctgcttcctcttttgtaaagaacaaacatcaaattagtggtttgtcctcactttgcggataagcagaataataacacctgtgcctctccctgcattattttgaaactaatataattttgtttggacagaacgtagatagcaaccttaatggggaggaatgtggaagaggaattactgaagggggaccagtcagcctgtcaggcagcaactctggtgccaaagaatggacataggatcagagctgtggacccccgtcctgtttgtaaacttcctgagggtggcagagattcataccctttctcccatcaggacaaaaatcagtgtgttggagctcactcaggaaatgctctttgggattggcatgggaaggggatgaggccgattgacaattagcctagttcactgggattttgttgtaggagctgggtggtggcaccatatggccaacaggggatgccagcgacatccctaatttctctggcttcctgataggtcctggtagggtcggggttccaccgggatttgcctagtatggtctacctctgactgaaattaaactctaagtaggtaactggggaacgcctttctccagagagaaggttttgatgtgatctcatcatcggggactggattggacctggagaaatcagtttttctatagtcttgtttctagagtggcaccctggtcttgggcaggtcagaaggacagatagttggtcaccatcttcaacacaaatcatggctggaaaagggccccagtagggagtgcctttctcactcaccaatcaccaaggctagaagatagtctgcagattctttcagatgccacaaagctgtgattacagctgcccattggcaaatcaggtactagtttttgttaatcacattgcagtcttccttcactgtttcttcccctggtcccggaattaaggctgggctccatttgacaagttatcttctgtgcaggtagagcagcaggctgtgttagctcacagcatctactcagtaggcatggaaatatccactgaatgggactgagaaagtggaatgggaggggaacgtgtgaagaacaggaagtttgcctctttatgtccaaagtctgtctacttagagcaacaggatggtgatgatgctttctggttaaagatgtcatggcaacagtcttccctagacagctctctagcaatagccagtggcatgtaaaccctgcatttttgcactgtatccagtgtttgcaactcccttgtagaactttccctgaagtcagcaagaaccctgtgagaatcaggatttgtctagaaatttagcatttacctaatcaatgattctctagacatgtcagtacctccaagtgattcatatgcatgtttggtgggcgtcgagcatgtggcagtttggagaaggaagtggagaatgcagcagcagcaggagaaatgtttgatgttgctaaacatcaaccccacagcaagcctagaactcggggaatgggaggcatggtgcgggtagctgctgacacacagctctagagatagctgcctgcaaagctggatgggactccaggcaataggcttcagggcctaactgctctttcaaggtcactgattgttacaggagccatggtctgcagcattgagcatggaattattattactattaagcatgatcctcaccgtgatgctcttggggtggaacaaaagagcccagagagaatatgcttattttatgcaacctctaacgtttcctcccagagttgtgatgaaactgaaccaaactctagcatgagaatcggcatcccaggccagcagccaaaacaagtggtgacacttggccaggcacggtggctcatgcctgtaatccctgcactttgggaggccgaggcgggtggatcacaaggtcaggagtttgaaaccagcctggccaacatagtgaaaccccatctctactaaaaatacaaaaaattagctgggcgtggtggcgggcacctgtaatcccagctacttgggaggctggggcaggagaatcgcttgaacttggaggtggaggttgcagtgagccaagatcgcgccactgcactccagtccagtgacagtgtgagactctgtctcaaaaaaaaagtgccgatactttatatatcttctgaaagaaatgaagtctgtaagaaggactgttaaccctcagaatggtctggggatgctacatccccttgtggacttgtcacactggtatgagtgtagggagtgggaacacttcttctcagctccttcctcaccatgtgtcattcagggacaaagggagcaggatatcttccctttgaaaaatctcatatgcctggcaatactcgtcaccctgtgaataatgttgatgcattcacctaaccagtattataagcccctgctgtgtgtcagacactatgcttggtgctgaaatagacaaggaggggactgcctgtcttggaaggcaaatcccagtctcctaagagacactagaaccacaggcaaccatgctgatctatgcaatgacatgtaatgcaactttgtcctgcaaccaccttgagatctttgaaagttctcctacctccaaaactcagacaagtcctctctcttgccaagtgcctaaagcaaggatatgtttatagaggcagctgggggcatctggccaatttatttcccagcagacctgctgcttcccctgattccaatactttcttccccaacccaaaccaaggcgtctggcaatgttaaaaacatcaagaatgataaaacaagcattttaatgaagattattgatgtattcattggctgtttctttaaatgggtagagaactaataaaggatctaccccaaataaccaaaaatatcagcctcagcaccagcagaaattggaagcgttctggtatttatatgtgtttttctcagctggcagatttgttttaggaaactatttgcaaagcctgggaaaaatgtgctttctctgtctgttaaaggaacatgcaggttggttggtgctggttctccatctgacagttctgtctggtggcctcaaaaaaaaagaaaaatacagcatagtccagatttggactatgcaaatggtgtcttgaaacttaacttttaggtcttgagcaaagccaagtattattgaaatgtttattttgtttttatctgcaggaggttttcattcaaaatgtggtgctttgggggaaaaggaagggtgtttgtactaggtactttttagcattcttcttattatctgacctatcacagcctcttcaggagacattaattaatttagttcatataatcaacactggaaccaaggaaaaattatttatacttttagaaattctcatgttcttatacttctttggagattgaattgactccaaagagactattttgtgattaagaatatttttgtggccgggcacggtggctcacgcctgtaatcccagcactttgggaggccaaggcaggtggatcacctgaggccaggagttcaagactagtctggacaacttggcaaaaccctgtctttactaaaaatactaaacttagccagccgtggtgacgggcgcctgtagtcccagctactcgggaggctgaggcaggagaatcacttgaacccgagaggtggaggttgcagtgggccgagatcacagcattccactccagcctgggaagaatatttttgtgtggggagtcgttatattatgtccttagaccaggaggtccaattgaggcagaaatttttgaagtaaaaccattttttttgaaggaaacacatatttaaatatcaaagaacactggacgtatacttttaaaaatttacatacttgtgttagttatctattgctgtataacaaaacctttgcagctcaaaacaacagtcattatctcacaagtttatgtaggttacgcaggtgcagctgacctgcttggtctgagctttcgaaaagtgcagtgaggatgtcagcctaggctgccgtcacctcaagggtcccctgggggtggatccacttccaagctcactcatgtggctgttggcaggatgcagttgctcacgggttgttaggctgagggcgtcggttcctcactaagccagaggcttccttaagttccttaacatgttttctcatggggggcagctcacagtgtagcaattggcttcgtcaaaacaagcaagcgggagggtaagagacagaaagcaagacagaggccagggtctttcacagcctaatctcaagagcagtacctcatcacttttgtcctattttgacaaacgtcgtattgacttttgtcactacatcagaagcgagtcactaggtctagcccacactcaaagggagaggatttcacagagcaagaatatcaggaagcagaatcattggttatttcattagaagctgctggcacagttcttaatgaagctacaaaacattgaactgggaggaatatgggggtaggagggtgacagggagggcaggttaattttgtggatgctgaggacaacgtgcctcatgaaaagtgttcccatcagactggtgtatttctgtttcttttcttttttttttttttttttttttttttttttgagacagagtctcgctctgtcaccaggctggagtgcagtggcacaatctcagctcactgcaacctccgccttcctggtacaagcgattcccctgccttagcctcctgaatagctgggattacaggcatgtgccaccacgcccagcttattttttgtattttagtagagactgggtttcaccttgttggccaggatggtctcagtctcctgaccctgtgatctacccaccttggcctcccaaagtgctgggattacaggcatgagccaccgtgcccagcccagaatggtgtatttctaggacatctgcaatgcatcactctctaataaaagaaaaaaaaatagccactccttgacagatactcaaaggtgtggagtcccttactaaaccacactccaaagaaataagcctgcaaaatagggaaaagttgttttttacctagaaagcagattctctgcattttcttattttcaaatagtggggagaaaccctaagctgtacatatgaaggaatggattcatttctcctcttgcacagcaccccagcaccttgtacaccctattcctccctaactcccaaccgcacactcacctcccaagcatctgcagatctacatacatattatcaaatgtacagagtactgagtgaaatggtcactgtagctatggaaaggtgagatttgcaggctgtctgaaatgtttcttgctaaagtagttccaatccttcccccatttagaaaaaaatacattcttagtaaatgactttcaggcagaaaaagaaaaccacactggaaataggattctaataaaccaacatggggctctagctggtgaacatatttctgagccatccctatacagaaaccacaagacaaataagaaaaagtaaatccagatcacttagacccttcaaaccacatcctgggttccaaggacagtggctgcgagttaggaaagatacatttatccagtggaccttttgactgtcttgtcaatcttaagaaaaaaatgtagagtaaaaaattttggctgggcgtggtggctcacgcctgtaatcccagcactttgggagaccgaggcgggcggatcacgaggtcaggagattgagaccatcctggctaacacagtgaaaccccgtctctactaaaaatacaaaaaaaactagccaggcgtggtagcaggcgcctgtaatcccagctactccggaggctgaggcaggagaatagcgtgaacccaggaggcagagcttgcagcgaggcgagattgcaccactgcactccagcctgggctacagagcgagactctgtctcaaaaaaaaaaaaaaaagaaaaaatttggtttgggtcccttcccaccttcccttgcttcatcactttccttaagcctctaagcatccagatcttccccaaagcagtgcttcctagtcagtgattaccctatcctctttttattccttttcttcatgcacaccttcagtccataaatccaagctttttgtaaggagggagggtgagtaaaccaattcatactaaggtgagagtgaattatatataaacctcttaatatattaaatctaccaagcagtgtttcagaaggaaatctgctaacatgggcatcttacttgaaaaaaatttcagttggttcaacaaagtatggtttagaaatcattttcaatcaggatcggggagagaatttttttttttcttaaagcagttaggtttccccagcagatttcgaatgcttggatatttgtgattcttttctatgggaatctgatctggataagacctaagaccataaacactctagctttccctttgggtctttgctattgaaaactagttggacttaaacaagtgaagtgggttttaaggatggctcctttcacccatttctaaaagatagcattcttgagggtctgctttatttagcagaaggaatgctggttttccaatctctcactcaaaaggaacttttacttatctcatagaaaagaatgggatggagattaatgtaatagaaaaggtattctacaaatatcatagcagctatatttaatcaattcatgttcaaagatcaattagtagtaataagagttgtgctgtataaaatcaccatatctcatattcaaattgcagatcatcagttgaaaaagcatggattgttttctcactgaaagaaatctttaaaagtggtaccataagagacattaagactggctattgttttatttctctctctctctctttctctttctctctttctgtcatttgatttctgactttcagtggatttttttaacattacaaaatcatagagaaagaatattggaccatttattgtagagtttttaaacaatttgataccattttttttttctggcgtcttaactgcatttgctgtttgtgaggggtgtagaggtccctgatgttcagagtacagtaccagcgtttatgtgaaatattgcagcctggcctgtggaggacaggggttactaaggggcaagctgctgcttgcgataacacccccagtgcctccttctaatcttgcgccatttcccagggcagacagccttgtggggctctgactggtgccctggaacatgttttaccttccatttttcttgctctgatttctgaagacagaatgttctcttcaacctacacatcaggagttttccttctgttttcctttttcactggttcctttgtgaatttgcacttttatctaacctaaaacattggaaacaggaataaacacaaataatggcatgaggccgtggccacagaatgacaagacaggacacagcaaatgttttgggtttttttcacatttatgaaccttctcattctatttatttatttatttacttacttatttcttgagacagggtctcattctgtcacccaggctggagtgcagtggcatgatcatagctcactgcagccttgaactcctggactcaagtgatcttccagcctcagccttctgagtagctgggattacaggcatacaccaccatgcctggctaataaaaaaaaaattctgttgtacagatggggtctcactatgttccccaggctaggctagtctcgaactcctggcctcaaacagtcctcctgccttgacctcccaaagtgctgggattataggcctgagccactgtgctcaactgcttcccattctaaaaagtgtctaaggcagttatagaggttatataacaaggtataaaatttctgagtgaaaggaaaataaggagagagaaataaatctaagtgtgtgtaaggttaatatgtacacagaatgtttattaaggcctttgacagttcctttaaaaattacctgcaggccaggtgcggtggctcatgcctgtaatcccaacagtttgggaggccgaggtgggcggatcacttgaggtcaggagttcaagacaaacctggccaacatggtgaaaccctgtctctactaaaaatacaaaaattagccaggtgtggtggcatgtgcctgtagtcccagctacttgggaggctgaggcaggagaatcgcttgagcccagaaagtggaggttgcagtgaactgagatcacgccattgcactccagcctgggtgacagagggagactccatctcaaagagaaacaaacaacaacaacaacaaaacctgcaaatttgagctgcctagcagccaagcaataaagggaatcacaatgaacgataagattcatatatctgccaatttaaaaacaaaccagttctcttgggtcagtgcttctcaaacttgaatgtacatttgagacacctggtgcattgttaaaatgtaggttctcatctagcaggtccatggtgcatttctaactggctcccaggcaatgctatgctgatgctgatgctgacgctgacgttgatgctgctactcattggactgccctttgagtagtaaaattttagctcactcagaaaaacctcatagtttatttggagtaacatccctttagcccttgtagatattataagactacattacaataaagttctggtgagtctaattgttgaccagagagattgtttacttcagagcacctggatttgaattgcagtgtgccacctgctgctgtgttacctggtacaagttaatgcattctcttcacacctcagttttatcatcttctgaatgaggctaatagtagtacctgtcatagatgcttgtaacagtgcctgcatagagtaagaatgaaataatgttagctattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaaccttttcctgtagtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagctttttatgtataaacctgtttcattggtgttgtatcagaattgcatgttgctagtagtttactatcaaaacaacacttgtgtttcaagctgttaaaaaatgaataaaataggccaagtatggtggctcacacctgtaatcccaacattttgggaggccgaggcgggcggatcacttgaggtcaggagttcgacaccagcctggccaacatggtgaaaccccatctctactaaaaatacaaaaattagccgggcctggtagcatgctcctgtagtcccagctactcaggaggccgaggcaggagaattgcttgatcttgggcagtggaggttgcagttagctgagatcatgccactgcactccagcctgggcaacagagcaagactccatctcaaaatttaaaaaaaaaaaaaaagaataaaatagaaacactgatttttctggtattttatacccttccccgaatatccatacccaaggcatttttaagatttccctaagctggaagcaccagaccacatgttatttaaaacatattaagatgtacctactgtattatgtatactttgtatatcattttataacagtctgcaaagtagcaggaaaaaatttttgccttcaggttaaactcagaagagttgccattggctaactgaaaaattttgcatttggtaagcatttaattaaaaatttattgatttcggttttgaggttttacttttcatatttttagagccaataacttctggaatctcagacatttttgtggaatcttaagttgttcatagatcctaggtgctgtgtttgtcatcctgagagcttaaatggccctgtccaaacctcagcctcagctcagagtaggaaattgtcaagcacttggtaactggtaagcaaatggattttagtcactaaatggagcgggaggaatggagtgctccctcaaaaagagcatttcagctggtcacagtggcttgggcttgtaatcctagcactttaggaggcccaggcatgaggaccacttgagcccaggagttcgagaccagcctgggtaacacaggaagatttcacctctacaaaaagtaaaactaaaaaattagccaggcattgtggtgccttgaatctgtagtcctagaaacttaggaggctgaagcagaggatcgcttgagcccagaaagttgaggctgcagtaagctgtgatcacgccacagcactccagcccaagcaacagagcatagactccatctccaaaaaaagaggctgtgacagaggaaggcagggggatgttaatcagagagacatagagactgggagagtctgaaagagaggcagagagacttacacaaattaaagacacagactgagagaaatggaaaaatgaagagaggatcccagacagattgattgacttcccaggtaacatataatatcttacaatcctgcagaatgtttaaagttgcattttaaaaggcactccgtttgttcacacaatcctggtaagaagatcatcttaattagtatcatactttgcagctttcaagcagttcttaggcatcattgcgtttaagacctggctccagccgttttattacagatgaggagattgacttgttcaccttacatttgtagagcattttgcaatttttttgaaggacatttccacccattatctaatcacaagtctccataaatcccatctcccctggtataaaagcagcttaaattacaggtgctactaagatgcaaaatgcagcccacaaaatcagcaaatattttttctttgtttcctccttttttaaaaaaggcgtagatttcatattactactttgtttcaggccgtatattgaagtaacaaaaataaaaccaaaattgacaccaattttatttcgaaataaaatctacttttttcactttcccacatcattttctagctgctaaccttcatgcatattcaatttttgcatatttacagccctgtcaaagataaaattttattttctgcattttcactcaacattatacactgagtattggccatttcactcatctcagtgccactttcaaagagatacccaggaaaagcagcagcaagggttgttcgaccttgaacaactacagataatactttggctctctttgagatttttaaggccctgtaagtaaaatattttcagattacagaaggcttgggattctgtctttatcacatgactgattggtcctccatgttctccttggcagatgtgggtatcagtgacacaatgttttttactcaaaacatggtttagcttaccagtaccaggaatggccgatgcatacgcattctcattgtgaaggtttatttgcacctccactcttcttaaccaggctattttcacagaagaaataaccccaacttcatgaaccctattcccatgacctatttgccaatctgttaaaataatggccaactcaaatgatcagtaatgattgactcaccatgacatcatccatcacctttgtcactggaagcccacttgccttaaagggtgcagcatcttccaactttgctccagcaacttcagctcctcattaaatccctccctgtaggtcatccctgcaaccagttgacactggagctcagcagccagctgataggggccttcactcctcttgtcgagctgctcctctctcctctcaaagccctctttccttctctcctgctggctgacctagaagctcagctaaagaggtgttcaaagggtccagtcgcttaaacaggtggccagtgtgctttctgctataactccttgctccttgagctcagctccaagctgtagaaggccatggaagagcacattgatgtcatcttgggaataattaacagggtccggtttttctgttcgtttccttgcaccagatgaagagtaggataaacttgggagaagccaaagtgatgtttttgtattgtggctttgaatgatttcaaggtcccttggttaacctattctcagcaaaagaaatagaagatggtcccaagatggtaagagcagagtgtttggttgataatttgatctaaaagtgaccagactccacaagttaacccccagagctgctcaattacagcagtttaaaaataagttgaggattcgttgctaaatcagtggaaagaatttggagtttccaaaatagtttgtaatcaagaaaagccatctgaggaggccctggagggaaaatcgctgatgattatcaaatgtccagttctcaatgcggtggtatatgtgactgaaaaaaaccacttttgtccacatttggggaaagataagattatactaaatgcctggcacatacactggaccttcagttacctagaaaactttcaaaataactttgccataacaagtggcaaattattaaggtcatgggctgtcttctcaaaattacttagataacatgattctctggccagtatgagacccttaatttatcacgtatgaagcatatgagcctgtttatccgttcgttaatcattatttttatctggcttgggctctgggttactggccatgcaggcagatcttcccttccaaaaggaaacgttattattctcttgtattcgtttctttaaaaacatgcagatttaacaaaacatattacttagcactcttactgatttagaaatatgatgacccttaggaaatgcatctccttaaaagaaattccaggcaaactcatttaacctttctggatgttagtttcctgaccttcaaaaaatgggatgttggaccaaattatcttgaagtttccttccagctgtgtgctcggtggggagtgctggcagtgtggggcaggacactgaatatctgtggtggtgatgtttggatacaggggtgagcaacccctttggaagcaacatgcaaaattgctgagcagtggtgggggtgcatgggaatgggtggcggtgcccctgtattggagtgtaagagacaagtgtggtgagagcagtctggcagggctactactgttatgatttacacagtccctttcatccagctacttcaaagcaccttcacaaactctggctcattattccttcaaacacagcattcaagaaagattgataggcgccttttaattaattcaaagatgatgaagctgagcattacagaatataaggggattcttccaaaagtatctgcactgcagaggggcatgatatataaagtgttcatcacaggtttctaactgaaacaaggaaatgacctgaacgcttatttttagaggagaccagtatatattatggcatattcagaatatgcaataccatgcacccattaaaatcatgtttattaagaatagtcacattagggaaatggtcataactgaacaacgtttagtggcataaaaaaagataaagctttgtacatacagtatgatgaaaatgtttaatgtggctgggcatagtgacttgtgcctgtaattccagcactgtgggaggccaaggcaggagtatcactgaaggccaggagttcaagaccagcctgggcaccatggtgagaccctgtctctacaaaaaatttaaaaattagccaggtggtcatgatgcatgcctactattctagctactagggaggctgaggctggaggatcactggagcccaggaggtcaaggctgcagtatgccatgatcataccactgtactccagcctgggcaacagagtgagatcctgtctcaaaaattgaaaaaaaaaaaaaaaaaaggtttaatgtgtagaagggaaaaggctaaatggaaatgtgttaaagtcttaacggtgatcttccttggagcaatgatatagtgggtggttgctattcttttctttatacttttatgtacttttatgttatgcaaggttgaaaaaatgggcacatattgctttcatagtcatttctgttaagataatcatatgattatgaaagagggagtgtgtgtgtgaaagtggaatggaccaatcaaatagaacagtaggaagacctcagaagatatgacacatgagctcaaccccaaagatgagaagaaccagccatttagtgaatggggaagccctctggggaacagaaggcacgaaggaaggaataagtttggaatgttctaggttttgaaaaaaggccagcatgggagaatgatgaaagataaggtcagagccattgccaagggcaaggtcatgtaggacccatgacgaaaagtttgggaaacccttgtaggggactgacataatttattttacatttttgaaaaatccttctgaccaatatatgaggaacattgtaagaggcaagtgtagaagtcaagatctattgagaaggcgttgcaggggtccaggtgagaatgaggatggttcagagtggagagacagggacaaggtaagttggagtgtgggtctgacttgttagccatgtggaggaaataattatcataataactatcatgtatgtttttagggggctctataacttcagtatgttttcagtgttcacatttgtaggtttacagagtttgtacttgataaggtacagaagtaagtcacttctcaaaaatcatgcctttagaagcatatatcatgcttctattatagtaatgataataatagaagtctactgctagtcataaaacttatctgttcagagaaggctttttttttttttcagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactaggtaagtttatctcaatgtgtccccaaataatttctcagaatgttaaattcataaaagctaccatgaaaggataaataaatgaaaggagttctgaggtcaaaacatttggggaaagaagagtctttctccttctgaggcattctcagtgcacagtaacctgtttatctcgctttgccttgctctttcccaagcacatttttgctcaacgccccctaccttccccatacacttgttaacactttgcagagcactagggctctgtgggacaggctgggaaatgcaggttgacatgccactgttaatacctagaaaattaaggcaaacttgtccctgagagatgtcaggatagcacagtatggaaaggccatgcttatcagggctcttatctgagagaatacagtggttatgagcatgactctggaactagacagtctgggttgaattccccgctctgccatttagttatatgatatggggtgtattacctaacatctctgtatctcatttgttcctcacttgtgacatggggatgatgacaatgataatagtaccaacctataggatagctatgagaattaaacaaattagtaaatatgaagtatttggaacattggcctgactcaggataagtcctgtttaaatgttagtatcattattattgtttcttcaagccaggaatatacttcatcaattatgtgtacactcattccttcattcaacaaacacttacttaatactcctgtgtcctaggcactgttctagtgctggagatacatcagtgaatcaaaaacatgagagaaaaatccctgtccttgtggaacttacactgtagtggaatctactactaataatgcaaatagaaagaaaaatatatgcaagttacccaggcactgggtagcctagtacctgtcctatagttgtcaaatggatggatatattattcttattgttgttgtcgtttacagtaattgagcttggaggtttgagctgccatcttagataagaacagaaagctaagccaatacgagtgccatgccagtaagaaaaggaaactattacataaagattaggaagaaaaaagagaagaatgacaagtaggccattatctatggccatgagttttatttaaaatgagctggaccttttttgccttctttatctgtgtatcagatagacaattacctctaggcagatttccacattccaagacatgaagactttctaagctgcagcagacacatctttacttgtagcaaaacagagagcgatgggggttattttcagatgactgtagctgaagaggaagaatcaagtaattcactccccccaataataattcacttctgagaggaaaaacttctttggaaaaagcaccccatgaatggaagtctcagcatttgctgaagaacttagttaaaataaactctagacctttttcattgattctttatctcttcttttccagaaaccttctctatgtctacccacagaggctgaactttgtaaacaaactagcatcagcccggaacattacaataaagatccagtttatgtgtggagaagatgctagcaatgcgatgccggtaaggagggaaacgaacatttgcctcaaatcagggtgggctgctcacccctgtcacttcacacaagtccgggactcatcagtgtacaaagtccgtctattccaggccaatactgctcagcatgtgcaagggcttctgtgcccaggatatcagtggggaaacagggtcagtcttacttgacgatctctttctcggcttattctgtagtgagcttggaacatacagatcattttagaggattaaaaaaagtcataaagtctttccatactgcccataggaccaccccactctaaaggcatacaaagtaaagagatggctcaacacgtgcgccatgtttgctgagtgtcttccatgcacaaactgtacacactgtgttatacacacacagtgttacacacttactcaagcctcggaccacagtgctgatgaatacaaagtaccgcctagtaattataaacacacaccacctccacaccttctaggagtggatctttgttctgaggcaaaatataaatcaaattattcatatatatatatatatataaaatgcagtgtgctccaaggaactcaaaatgccagaatttatactttttaaaccatctcctactaaatgagatggtggttagctattactatttcccataagtcatagaattcagttaatataactttctttctttttttcttttttttttttttttttgagacagagtttcactctttttgcccaggctggagtacaatggccgcaacctccacctcccaagttcaagtgattctcctgcctcagccttccaagtagctgggattacaggcgcgtgccaccacgcccagctaattttgtatttttagtagagatggggtttcaccatgttggccagggtggtctcaaactcctgacctcagctgatccacccgccttggcctcctaaagtgctgggactaaaggcgtgagccactgcacgcagttaatatacctttctaaaaagaaaaagaaaaaaatcctttctcttaatgtcccacccaaagaaaaaaagaaaaaaaaaaacctttctcctaacgtcccacctgtcttcccaatgcaaggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtgagtgcacttgttcataatgcatcctaaatgctgcttcaggcccaaggaggtatctttttctaaatggcacaaatgtggataaggcagtggagattcaaatcacctaagtgagtaggtctgtatgtttgagagagaagaacctggaactggggatttctcactcaagacaaaagtatgtaactttggcctgttggatagacctctaggcagtgaggcagagtggagagagtactggttttctaatctcacaaacatgtggcctttggtcactaatatagccccttggaacctcatttcacccttcatagccagttcctttgcactggtgtgcttgggccagttgtagtcccagcacttttttttttctttttgagacaggatctcactcttgcccaggctggggtgcaatggtgcaatctcgactcactgcaacctctgcttcctaggctcaagcgatcctcttgcctccgccccctgagtagcagggactatacgcatgtgccaccacgcctggctaatttttgtatttttttgtagagatgaggtttcgccatgttgcccaggctggtctccaactcctgggctcaagccattctcccacgccgacctcccagagtgctgagattacaggtgtgagccactgctcctggccaacccagcactcttaattgtacaaaatgcagctctatgagaccagaacatcctgttggcctgatgatagtcaatttgatgtacccaaatgttactgataatttgatcctttctctactggtgaacaggtcatctttggaaaatccagcgggcctgaatttctgcaggaagtgtacacagctgttacataccataataagtaagtctatttcagcattctaaatatatgccaagatggtttcatcatctcctggtttttccaagtcccgtgggtggttcctcctaactatttttataattcagggactgaggggcaaaggaaatccatgccagttccgtgactctgtgttgaagatgtataactttgccattaaccaagactgagagaagaacgtgtcttcaagaatccaatatagttttgacttttccagaagcttctattctagtatgatgcaaagaggttgtattacgttaattaaggaaacacatttcctaacttgctttgagaccctggaggggaccagaagcacagtccggctccccttgccctgtgtgtccctgtccgctccacttgacacctgccccactgtctgcctaggctgaccaaaggagaaatggaacactcattattccaccggcaaatggagtcatgggataatgcccaccctattattcatgttccacagggaagggagagacacctgcacagtgttggacggaattgggtttgatccgggcctgataacctgggcctaattaagtccttcatttaagcacattctgggattgggatgaggattaagtgaggtaatgtacattacatacctacattactttacaatgtacgtaatgtacttcgtaattaatgaagaacctagggcttcataatgcagttaaattggttcctttttcctcctgcctcattcatttgcttctactctttgatgagtgcagctaggtgctaggcttggttccttgggtagaaatggaaaaaggaggtcacagcaggagtccaaacctcatcctttcttcaaattaagttgttggagttttccattgtgtgggggagttgttttttgttttttgttttttgttttttgtttttcctgacaaagcctttagttcatgaacagttttatgtaagggaagtgcatctaataacataagcttggtctcagggacttccagcttcagagcagagtaatgtaaaatgaaaagcaaaacaccaggcaaattctgaggagcaaaggggctgtggcgttttacaatcagagaagtcatcattcttgctaaaagttatttgtgtataatgtgcttttgaaacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagtgagttgtttccagcctgctgactcacactgcagttgttggtgcatctgaggtccctgcagagataaacaaccaaattctattcacttgattttttccagtcagaagtagcaaaacatgctaagccacattatagcaagaggcagaaatgatttgccttagcaaatgtcaaatttcaggaatggaaagctagcgggtgatagatgttggaagaatactcatctgttttttaaaaagcattgcagtgttcactatttccaaatttaatatccatgcttcacgtatagaactagctttgtcccccaagaagaaaccattttttctttaaaagatataaaaggtgaaataaacattgatgttgttcagacacacacaaacattggctacagagaaaaatgctactgctttagctccaaaagcaataaatcatcaatattaccatttcaggaggtctcggagatttaaaatgcaaagaactggacagaaattactgccaaaaagagtactggtcaatatctactcactgtttagttgcatttgattattgcgagctagataaattatcagaattatatgctgtaataaataccactttattatttacatcatctgtttcagtggctgccaattctcttaaatgaacgtcttcaaactggatcctactgtctcccagttgccttggaaaaattgccacccaactactccatgcattctgctgaggtaattggcaagctggccatcagctgtttcttgtccagctgtagtcttggaccaccttcccagactcactttccattcccatgtggccatggatgttcatcatgttctcagagagcacattgttctgataggatgggaggaataactgactgtgaaacctcattcttttaaatgccaccaaatcagaatgttcagtagacgcaacctacacccaaggcagcataaccttgcattatctaccacagagggattcccagaataatgtattatagaagaggaggcaaactaaggccattcatagtaaacaactgttcccatcaaggatccttataaaagattcccaggccagattcatccgtttctttcttgggtcagttgtcacagccctccggtagataccaaggtatttattctcctaccaatcccaatgccaatagcctttcccacttcctgtttctggcactttctcttgctcatccactctgctgcagtgcacccatttaaagagaagcccaggtggatcaactgaggtcaggatttcaagaccagcctggccaaggtggcaaaaccccatctctactaaaaatacaaaaattagctgggcctgctgttgggtgcctgtaatcccagcactttgggaggccgaggcaggcagatcacttgaggtgagaagttcaagaccagcctggccaacatggtgaaactccatctctactaaaaatacaaaaaaattagccgggcgtggtggcgggtgcctgtaatcccagctactcgggaggctgaggcaggagaatcgctttaacctgggaagtggaggttgcagtgagctgagatcacaccactgcactgcagcctgggtgacagagtgagactccatctcaaaataaataaataaaaaataaataaagggagcccaggggactgtccaccctgactgcaccagctgtcacactgctagcccacttctcagttccttgcataggtttacatcaataagtattattttgaagtaaatctcggacatcatatttcattttagtctgcatcttaaaagataagggatttgtttttaaccatcacaataccattgtcatactttaaaattttaactgtaatttcttagtatcatcaaatattcagtcactgatcaaatttttaattatcccactaatgctatatttttgacgcttgctttttaaaattggtattcagataaggtccacacactgatattgattgttacatctctggagacgcttttaatctacagatcctccatctcttttgctttccttgcaattttaagttgaagaatttctcagaaatttgaatttaatttcaaccgttccagtcaactttcttctctgttctttcgccatctaccgtctcacttccggctgttttcctcttattttcttttttccttaaagagagaaccaacttttgccctggaccacaggcatgtgtctggtaaaccaaaacttctctcatcaaagccatctaaggggcaatccgagtatgtccacagacatttccctgattggtctttatgatttggacatcaacacctttcagtatccctcaaaaccaccttcttatcatcaagttgcacactctaatttcttagaaccccctattatctttttaagctataggaaagacctgagtgttggagagagacaaatctgtgtccaaagtctagattctgccactccctagctgtgtgaatgttggtgagttgcttaccctctctgagtctcgaagatgaaactgagcccatatctgcatatctgcctataaggttgctgtaagcattaaatgagataatgcttgccaaacaacaaactcaattcctaagtaaacattaattcctttttcttacttgcgctatgctgtgtttatagatatacccttagcctctcttagtatcctttaaacctgcactgtctgataagatagccactagctgtatgtggctattgaggaaaatatggctagttcaaactgagatatgtgctataagtaaaatatgcaacagatttcaaaaacttcatggggaaaaatgtgaaatattgtattaataattttttacattgattacatattgaaacagtctttaggctgtattgagttaaatgaaatattactttcacatggtccttttgtgtttttttttttttttttttttttttagagacagggtcttgctctgtcactcaggctggagtgcagtggcgtgatcacagctcactgtaatcttgaactcataggctcaagcagtcgtctcacctcggcctccttagtagctgggactataggcatgcaccaccacgcccagctaattttttttttttttttcattagaaacagtgtcttgctatgctgctcaggctggtctcaaactcctggcctcatgtgatcctcccactttggactcccaaagtcctgggattataggtgtgagccaccatgcccggcccctttttacttttttaatgtggccactagatgattttaaattacatatatagctcacgttatatttccactggacagtgctattttagatcacagatggcaaactcaagtgcccacaggatccagatgagtaacataaatgaatgccttgttctggtggcatctgttcactctggagattgtctcttccccatctgaaggtcacagctgttctcttcactctgcagattggtgacatgctgggatataaggccaattttttcatttcttccagtactcaaatgaagttagaaaagcagtcttttataggaaattttcaggctttcaaatattggtaattaattttttaaagttcctaatacttcaaacagaacgtgtgtgtaggctagagcccactttgggccccagcttttgactgcttcagatagctttaaaggtctccatcccctgtacacatctacctttcattatgatgaaagacatacaaacctaggcgaggccctcactcaacactgcaggacatctctaaaggaatgcaatttcaatgggaatttaaggcaagaaactgtctgtaagacctacgaaggtaatgatatataaacgtataaaagagtcactttgagtaattaaagcaggagccgacctggcctagaaacatgtgggaaacacttggaaaaactgtggtgaaagggaaagtaatatcgggtactcaaaagtattaaaatttcatgtcttgtaaagatattctatactttgtcctgacaattctgattaatggggaaattgctgggatcttaatttattttaattcctagaatccagaatcatcaatgctggtttggaacttagagacagattacaccgttcagccctcttctcacagcatgagaacagaacactaaggcccagaaagtttagttgagtcgtctaagtaaaaataactagtttgaagcggggcacagtggctcacacctgtaatcccaacattttgggaggctgaagtgggcagatcacttgagcccagaagtttgagaccagcttgggcaacatggtgaaaccacatttctacaaaaaatagaaaaattagttgggtgtggtggtgtgtgcctgtagtccccgctactccagagactgagacgggaggatcatttgagcccaggaggtcgaggctgcagtgaaccgtgattgcaccactgcacttcagcctggcgacagagtgggaccctgtctcaaaaggaatgaataaatacataaatattaactagtttggtgtagaattgaagttgaatccagggctcctgactccaagaacagttagattagttttcaagagagttctgtatttgtataaccctgacatttccagtcaagttggtctgcattgcttgttagtaatcagaaaagggaattggattgctaatcttttttttttctctttaacacagaaagtcccattacagaatcctcccattaagtgggctgaaggacataagggagtatttaatattgaagtgcaagctgtttcttctgtacacacccaggtaaggaatgtcaaggttaatcatgaaggtaaaggtgcagcggaggagcctttgaaggacaggccaataaaagatcagtgaaaatccttgtctacagataaataaaaaataaccctttagttctttgtggggacatgcaaacctctttaggtttcatttgtcattggaatagaaagaccttacaaaaccgccgagcacctaaaggaaagaacctagtatctgcactgttggtggagaaactttgcagggggacttgatttgaaactctcatctgctgttacttcttttccctctgtaactctgccactttgccagcttttaaaaagaaattccgtactctctcctttacctgccactgtctgagttctgcatctgctgagacctctctcttggcagtatgcttacctggtacgctgacctctgcttacagaacatgtcagagccaaaattatttcttctttagctaataattattgaaacgttcaacttcatgcaccacattctacaaagaagttcatagcctcggtctgaaacatcatgtcttagaccttctggtctgaaacgctggataagaggttctacccataaagagctattcgattgtgtttgtgaatccactggtgaacattgatggtataaaaccccatgaggcctgccttctcccttcgcaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacaggtatgaacctgcagggctgggctgggaggaggcaggagcaagcaagcattgccttctttaatgaaaaatgactttccagaaatccagagacaatgtgatcttcctttccactgatgatgtgtgctcaagggaggccaagtcttatgctattttttttttgagactctctgcatgttggaaagaaaaagaaacattaaaatagggttcttaatattatagctttttgtaaactttattaaatgattataggcagtctttaaaattccatttctggtaattgatgaatttattttaccttgaagatatttttgttttcttgactaacaggaaatggaacattttaaggtaagacaacctgtgttaaatggagggaaggaactctctacattgaaatgcaatgcaatcaatttttaaagttaaaacataaactcactattttaaagtgtatagttcattggtttttagtatagtcacaaggttgtgcaatgatcgctacaatctagttttataacattttcatcacctccaaataaaaccccatcactccctattcatccctccccctagaactcatccgttctctcttacagtctattttaaatgcttacttttaacaagttaacactaaatacaatgtgtacattttcccttagaaataatctcaaaagcttatcctggaggcatgaccagagtccagtggttctcctaactcttccagggtagactggctggtatagggcatctttatttgccaccattttcagctgtgcctatatagctctttgctttccagtccagcagacgtcttttgggtaccatccatatgcccagtactgtactaaaagttgtaggctttgtgacaataaccaagagcatctcagacctcagaggacttataatatggcaaagagtcagcagcacaggacaagactcctcaaagggacacagctaaattttgcagtggttgtggggagggtggtatcaaaggagagagtgagaaaacatccatctgggaggatgcaggaggtccacataaagagatggccttgaagaagggatagagtgaaaaccgacagaataggggcaatgagatgagtgcagcactgcagagaaccagaaaagtgtgggagtgtcaggaagaaagtcagtagcacagttggtggtggaacagaagcacgtgtggaagtgggctgggacaatgaagtgagacggcttttagagccagggaggggcatgtccccttaatctctcactctgctttgcaccctgatatgcatcttctgtggttccacagatcaaacgtcctgtgttggaggctaacttttcatccatgtagcagttgcctctccagctagattcttgcagagctctgccctccttcgattactttctgtgcccccgcatatgtggcacactgctttgtatgttccagctagttaatacagacttgttcaccagacaaaaatatttatatgttttgagcagcttctccatagcaagttgccaccttgtggtgtgaggaccacagggtgttggcataggcagaataagtggaggtggctagtctacaagcatttattcagaacctattctgtgtctctgcaatggaaagcacagtgggggcacaaaagatgtgagaaatgcacttcgcatgggaaggattccagctttcacagacagacagtttaccaccagacatggctggagaatcatgtaactcagtttcacttgagccctgtactgtgtggagtcagacggcttcatggaggaggtgggacttgtgctgagattcacagggtcggtatgattttgtggatgggagtgaggagggcttcctaggcgaggacaacagcatgagcaaagtctcagaggtaagagagcaggcatgatgggacaatacaatgactgcctcattttaagggatgtcgaactgagccaaaaagggtacaaggttagataagtatattggagccaaactatagaggcttagggcaccagaacaagaggttctatgcagtaaatcaaatgtgtatgggcccactgtgggaatgacttgatatgcagacatttttaggttaatctgtacaagaatcagggttgtgcagcacatctcaaatcatagtgtccacaacagtcacgtgagcatcttgtaaagatgcagaacctgattaatacactctctggggtggggcctgagattctgcatttcttagtagcaagcaggtgatagtggtcgtgtgtgtccgcagcccccactgagtagcatcagtttacaacctggcttagagaaggaggacgtctggacagtcttatgtctttgtcattaaaaaccatcaatgctattcagtggcaggaggaggaagttcaaaagagggaatgtggaggcatctgtggtactcagagccagcatgccagagctcaccaaaaccatctacccttcccaggcctagttaaattggtcagcggtcaggactcattgtcactgtcctggagaaacttccacctcaggctccttaaggaccagctgtgggactacccatttttctcttggttcctcagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggtagagttgccctgagtgtgggactctggtgggcggggcaacaccacctccaccccactgcagtgtaatccaaaataaaacatcctatgctgggtgcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcacttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatatatccaatggcagtggttcttaaactttttgttattaaaaaaaatcccttttcacatttccctcaaactgaactattgaaataatagtaatgcatttccccaactcttcttaattatttacataagtaataatcaagtagaacttcttgtcagcatgatataaaaattagtgtcagtgagttcacaaaattgcaggcccaaataaacatgacacttttgttggtctgtgcagcctcatttctagtaaatctgaaaatttgattgagtttttaaaaatactagtgatgtggctgggtgcggtggttcatgcctgtaatcaatcctagcactttgggaggccaaggtgagcagatcacttgagctcaggagttcaagaccagcctaggcaacgtgacaaaagcccatttctataaaaattacaaaaattagccagtcgtggtggcgggtgcctgtagtcccagctactcgggaagctgaggcaagaggattgcttgaacctgggaggcggaggttgcagtgagctgagatcatgccactgcactccagcctggaggacaaagtgagaccctgtcttaaaaaaaaaaaaaattaaatagtaatatctcatagatttccataaccgcttgtgaaaacatgtcaacatttaaagatgaaaaacagtgctgtatacatcatataccgtaatcctcacaaggttcagatgactctatggatttttgaatctgagaaaacctcactgcatgaattgtaaagttgtcatttaaatattgacaaattaaaaatatccacatttttagcttctcatgagaaatcagaagctctagcaaccctggggtccatttcccgatggcagtaatagactggagccagtagtaccccctgcctttgtaagaggcatgtgttggctgtttaccatgatctccaccactccctggtgccttatgccccatctacttctctccaaaagattgcctcctaccccaaccaggatttgttaagaagtctctaattccaaggcctaatccggtggcttttcatccaccctatccctcttcaattccttcttaaactcagtaagtaactctgttcccctgtctgttgacatgtctctgcctggtggggtgcaggcgctcccactgccctcctagaccctcggagctaccacacgtatggccgcacatcagctgctgctgtgagttcaaagctgctgcaggcccgggtgatgagcagcagtaacccagacctcgcggggacacactccgcagcagacgaggaagtgaagaacatcatgtcttcaaaggtaggaaagatgtcaaaccgtggaaggggacacaggcttttttattttttaactaaaacttggagaagtaacacagaagcaaccactactgctgcccaccatgctggtcggatgctttaatgctcagctttggagtgattaacgttctttagaacagattaagaccattctgacagatgcagcagcaagaccagcatctgaggatttgctgagaactacttagcttgggtagcaaagttttaaagcatcaggggtttagccacatggagtcatgtggctaaaccatgcattttattttcaaggaaaaaaaatagctttaacttttgatacctggaaaggttgcctttaatttagttttgtttctttaatacctacctcttacgttcattaacatccacagattgattatctcacaaaaaagtccaaaggaacagccgggcatggtggctcatgcctgtaatcctagcactttgggaggccgaggcgggcggattacttgaggccaagagttcaagaccagcctggccaacatggtgaaaccctgtctctactaaaaataaaaacattggccaagcacggtggctcacacctgtaatctcagcactttgggaggccgaggtgggtggatcacaaggtcaggagttcgagaccagcctggctgacatggtgaaaccccgtctctactaaaaatacaaaattagccaggcgtggtggcacatgcctgtaatcccagctattcaggaagctgaggcaggagaatcgcttcaacccaggaggcagaggttgcagtgagccaagattgtgccatttcactctagcctgggcaacaagagcaaaactctgtctcaaaaaaagatacaaaacattagttgggcatggtggcgggtccctgtaattctagctactcaggaggctgaggcaggagaatcacgtgaacacgggaggtggaggttgcagtgagccgagattgcaccactgcactccagcttgagctacaagagtgagactccgtctcaaaaaaaaaaaaaaaaaaaaaaaaatcccaaggagcaatgccaaattttacaagcatataaaaactgacatcctgagagggttgatggcttgccctatgttgtttttccctctatgaattctttatttttttcatggtaaagctttactttcagaacagttttagagttacggaattatatactctatacccagtctctcctttattaacattttacattcaaatggtacttttggcacaattagtgaaccaatattcatggaatattattcattaagttcatctttattcacaccttctcagtttttctctaatgtcctttttctgtcccaggatcccattctgaatgccatattacattttgcagtcttgcctccataggctcctcttgctggaaacaatttcttagactttctttgttcttcatgaccttgacagttttgaggagtaatggtcaagtattttgtagattgtctctcattaggaattttttaaagattatgatattattcacataccataaaattcacccttttttaaaagatggagtatacgatccaacagtctttaatctactcacaaagctaccacgatgaattcttagcctgaattttttctccaatgatctgtggcctcagggtggccgagctattagagtaatatcatttcccctgataaagagaaatcaaaatctctaggtttagacacagacacagtttcacccttacaaattccagccacttgacactgtgtggtgtgaggaaggaaatctgcaggccagggtttggggctgggcgccaatactgccccgctgtgtggccatgggaaagtcatgtaactgtgctgggcctcatgtcctcatctctgcagaggtcctggtccctgaatgaacttaagaaccatctaccctgggtcttttaaaaacactggatttggccgggcaccgtggctcatgccagtaatcccagcactttcggaggctgaggcgggcagatcacgaggtcaggagatcgagaccatcctggctaacacggtgaaaccccgtctctactaaaaatacaaaaaattagccgggcgtggtggcgggcgcctgtaatcccagctactcaggaggctgaggcaggagaatggcgtgaacccgggaggcggagcttgcagtaagccaagatcgtgccaccgcactccagcctgggcagcagagcgagactacgtctaaaaaaataaaaataaataaaaaataaatgaaaaaaccactggattcaccccctgagatgctgatgatctgtagtttgagccatcaggaattattcgtattctatcctttttgacttacaaaaatcagttcagggatgtgctggagtgagctcatacctgttcccaaaagctgattgcttagttttccagaattttttgagccagttttgaaacagacattgttaaaattaaatcgtataaacttaaaattaaataagttatattaaaaacaaaggtaatctgaatgcaatgtggtatgctagattgtatcctggaacagaaataggacatgagtgcaaaaactggtgaaatccgagtcgttcgtgtttagttaatagtaacatatcaatgttagtttcttagttttgacaaatgtaccttactataaaagatattaagagaaatgcaatgaaagtcatataagaaatactacctttgtaacttctctgtaaatctaataataactatacaacttatacttcaaaattaaaagttcactttaaaaaggtaaacctagtcccttcctaataatttcactatatgctacaatatctaagttcttccttctttacgtttactgtgtctgtgtgatggaaatattatataatggtttgctaccacactgcatttctatgacatcgtgttggtagattgaaatcagttatgatgaaagtatttgtggcacaaaaattggcaaatgctacaaattacccctacccccctgacaactggttgttaaacatttgccagcacaacacaactcagcctcatattgaaagcccctttcagtaataccactttctgatcacccaggaaagaagtggtctgcagctattactgacagccttgatctttctatttttctttaataaaatgaaaatattaaatttttatgtggacagggttagcaattttcgaattattttgttgcatggggagaaaatgtctgatagagcatgagcactccacttcccttcagaggtagtttttgacaatgtattggtgtttaggagacagcgtggtgcagtaccgtactaaaccacagagagacactgttcccacacattttttcctggcgtcccctgaagtcacagactcctagaagggactactcagcagcccagattcttaaatagtttttaactgtaggttgctacacacaaactattaacgggtgttgtctcaagagcaagtaaaattaggtataacttcactgtctttgctttgttttatatttacttatggcaattgttttacctttgtaaccaggaaaaaaaatatgtataaaaaaatgaattctgaggttgtgatttccagatgtctggcttacctttccatggttggttgactgttaagccatggtttgtgtattttagatcgccgatcgcaactgcagccgaatgtcttactattgctctggcagtagtgatgctccaagttcacctgcagccccaaggccagccagcaaaaaggtactgaagagagcaatgtgaggttcatcccaggataagaacagaaggatttcctcatgccctcacactgtgcttgggaatagtcaaagtgctcccctgcctgtccctgatgtgctaacacacacacaccccacacacacttttgcagccctgtcctttacgccacatttgaccacctaattgcccattaactcagtgtttctcccactttctcatgcatcagaattacctggaagccttgttaaaactcatcgctggaccctacctcctgagtttctgattcaatagatctgagctggaggctcaagaatttgcatttctaacaagttcccagctgatgctggtccagggaccacattttgagaaccactgcattggcctccttttagtagagggaaagctgggcacaagtcatccttgacaaaagtgaatggcaataattaggtatcatttgtttcaataccatataaactaatatgaaatgcttcctcataattcttcacaatcagccttacctatgagttcagaaactttaaaagctgttaaactgcttaccaggatttttaaagcaacaaaattccccaatcatagtcccagcctatgtggtctgagggatggagggaaaaaaaactgtctgccctaatttcctctcttctaggcactcaagaatctcaccattatagtagctacttaagtttttaatgtctttgaagacctgtattaaaatgtaaatatggcagggcacagtggttcatacctgtattcccagcactttcggaggccgaggtgggtggatcacctgaggtcaggagttcaagataagcctggccaacatggtgaaaccccctcctactaaagatacaaaaactagccgggcatgatggcaggcacctgtaatctcagctactcaggaggctgaggcaggagaatcacttgaacacgggaggcagaggctgcagtgagctgagatcgtgccactgcactccagcctgggcgacagaatgagactccatttcaaaaaaaaaaaaaaagaaaaaaagggtaaatatgcttattgcaaaggataacacaggaagccatttgcaagagctgacatcacagggaaatgtttattaaacaggcaaggagggaatgagcctccccaagtctccctttggactggatgagggaaagaccaagtgtgggagggccggggcctggtgctgtgcactttgcagtattccaggcaccatatgtctagtgagaggtaccaggatttaactataaaaggaaaagtgaaaaaagatatggttaggctaaaaacaaattagtccacttgctctaaaatttaatattaggctatcacaggccctatgcagtgactggttataggtattataccattttcctttcttaaaaaccattatttgcctacagcctgacttctttaacccatgtcctgtttggtttcgcagttgccatgttttgacttgaaatgaccagaatagagacattttatttcaaagggaagtttggccaatatgtttccttaataccttagcagacagagttttgctgcttggctattttatataacctccagagcaaggtgttcttgtaataatgctgcccagaaagcagcatgaattactttaagaagcagcttatccttgtctaatctcttcttgccataagaccctggcagacaaactgacctattttctagaggcgacctttgaagctgggggagcatgtctttcctacaatgagaagatcaaggtgtagtccagttataatatgtgcacagttagaccacctgctagactaaaactcaaccccacgcctctctcaagtgagacagcttcacttcagactcacaacagcaaacaaatgtgttaacgcatattaaaattattaaggtttgactaacctcacaaaacgaagtgaaaccagtcgataagctgaaacacctaagcattctccattcctcaccactaacccgcctgggatctaattggttaaaatacccaagcatgtatacagagattttccttttgtcatcttttagtttagctaagtagctctcaaattttaatgtacgcaagaattagtacattgggttgcatgcgtactggactctgtgggtaatttttttttttttttgaaacagagtctcacttactctgtcacccaggctggagtgccgtggtgcaatcttggctcactgcaacctctgcctcccaggtttaagtgattctcctgcctcagcctccagagtagctgggattacaaccgtgaaccaccacatctggctaatttttgtatttttagtatagatggggtttcaccatgttgaccaggctcgtctcaaactcctgacctcaagtaatctgcctcctcggcctcccaaagtgctaggattacaggcatgagtcaacacacctagccctctgtggataatttaaacgactgtcaagagcaatgtttgctgtaatcagtttttgctttaggtgttgactttaaaacttaatttgcaaataaggatatgatattagggtgttcaaatagctttagctttcttacctactttcttaccagaaaaaaaaaatgagtttatctacgtttattccaggttttgtgggcataagatgaaagaaaaccacagaaaattcccagacatcatttttggcattaattagggtgaccaactgttctcatttgcccaggactgagggagtccccaagatgtaaggttttctattttaggaccaggacattatcaggcacactgtaatggattgattgccctacctttagtcttgaacttcttcctcatcaaaatgattgtcaggaatatgaacacatagccagatatgctgtagaatggaaaaggtataagtcaccctgtgcactatttgctactgagcagtaggtgacttgaagggaagtgaagacgcaaagtggagctgggggactttccaagcatctggccctgggacatagacatttagatgttgtaagttaaggctgatactactatgcctttcagagcccaagatcctctcataaaccccaccgatcctgcttcccacaatgccatatgggcattataaaaacaaaaattgtccagtctcctagagagtttagacaccatctagacagtggtccctaaagtgtaaccctggaccagcagcagcagcagcagcagcagcagcacccaggaacttgttagaaatgcaaattcccaggctattgaatcagaatatctgggggtggggccccccagtctgtgtttcatcaggccctgcaggagattctgatacacagaggccgggcgtagtggctcacacccgtaatcccagcactttgggaggccaaggcgggtggattgcttgagctcaggagtttgagactaagtgggcagcatggcgaaaccccatctctaccaaaaaaaaagaaaaaagaaaaaactagctgggcttggtggtgcacgcctttagtcccagctacttgggactaaagtaggtgggaggattgcttgagccagggaagttgcagtgagcgagattacgccaccgcattccagcctgggcgacagagtgcagccctatctcaaaaaaaaaaaaagtttgagaactgctgccaccaaccaactgattttatggatgagaaaactgagggtgaagagaggaatggcttgcacatggtcacacagagagttttcagcaggacccaagaggaaagtaagacagtaccagttttaatggctacccagaatgtttcccccgtagaatagagtttcactcccaggctgagtccactccctcagatgtgtctgtcctgtgcagcactgaccccagccttctatgcaccgaaatgtcctccagtctcaggtgatctcagcactgactttgccatccaccacttactgcctagaacatctaagacacatgcttcaggaacgaacaagctattaaattggggggaataaaagaaaagaaaaaaagtgttggtgaataataatagcctttgtttcacagcctaatttttgtggttcttatttagcatttccatgaggagcttgcccttcagatggtggtcagcaccggaatggtgagagaaacagtcttcaagtatgcctggttcttctttgagcttctggtgagattcttgcgcgtttgtatctgtgctcaataggccaagagaagcacacagcagaaaggaattgacattttgttcactgagttgcccctgctgaaaacctggggtggtttcttgaaatctaataatctctcacccctcccatccttcttccactaaattgtgttgcttctaccatgaaaatctatcgccgtcctgtgagttctcatcaccttcaccactctccacctggccacacaccatcatctctcatgtgcctctcgcagtgacatcctctttttcctgcctgtatccatttttgctcttggcccacccattctgcacatggcagccaatactaaacagagaatgtcacgctccttttaaaaaccgatcgatgattttcactgcactgagaagaaagcacaaatttttatcatgacctaaaaagcccttgtatgattctgttgttttcctccctctctaacctcatctcacgccacattcccccatcattcagccacatggtcctcttttggtgctttgaagatgccaaggccattttggcctcacagccttttccagattctcttcctgctccctaactttcacctccgcacccccaacacacacagtttctattcttctctgtagatttcagcttcagtggaaccatccccaagaggccttttctgaccacctaatactgtaatatatcttcctctattatcctccttctgagcaccctatttatttctttcctagtggttatcacaatttctaattgttttttctgtctcagcggttagattttcaggatttgggtctctcttgtgtattatcccatctctagcctcagcacactgcttggtaccatgcaaggcccaattaatatctgttggaaaacagaatgaaatttgtatatctgtttatcctaaaacttctaccattactcgagcagaaaagcaaaaggtatagccataataccttaattttaaaataaggggaataatagtgataactatttttttgtttaattattaatggaagcaaaaggattttcccatagaggcactaaaaataaacattttctcaatgttgataaacagagatgcataatgagatgatgttgaatgaaagaggtctaaagacatagacaccaactatataaaaatatatatgcaaacagttcagaggatttggagtaggttgagatttagtgataatgttagctttatattcattgggttctttcccctgtcccattaagtgaatctttttttttttttttttttttttaaagagagtctaggctgggtgtggtggctcacacttgtaatcctagcactttgggaggctgaggcaggcaggtcacttgaagtcaagagttcgagaccagcctggccaacgtgacaaaacccatccctactaaaaatacaaaaattagccgggtgtggtggcgggtgcctgtaatcccatctactcaggaggctgaggcaggagaattgcttgaacctgggaggcagaggcagcagtgagctgagattgcgccattgcactgcagcctgggcaaaaagagcaaaactccatctaaaaaaaaaaaaaaaagagagagggactaaagagatgggaggggttccacctaagctctagtttttgtatgtaagttgaagcccaagaaaaagggagaaatgctgaacaataggacacagagaacaaagggcaaaggaaacaaatgaaccatccactggggaggaaataggaagcaatgtggaatagagttcagaagaagtcaggttcatgccacagaaacacacccaggattcaaatcccatgaagttttgcaaagtcccaacctctgttttgagaagggtcccaaagcatggtcccaaatccttgccacagaaccacctggaggtgcttagtaaaaataaagcagagattctttctcaaagcactaaaattaggaggctggaggccagcattgtgcatttacctgtcttctcaggtgacttctaagcctgttaatgatccactggtctacaccacctctgttctgtgaatcctatacagagctacaggtcttttggaatttgtactcagacaacaccagaatttttttttcattccaaaagccgagctaattaaggtggtggctgcagctcacaagtcttggggcaagagcattaacaatgagacatgagctccatgctctggcaggaaagggactgggccataagacccattcccctcttgtttcttgaggcatgagaagtatcaaaaccgtcaccccatgccctttatatcctgcttctatttacacatcccacccaccatcatgtctctccataaagaagattcactcagcctagctctgcaaaaatgaaaaaattacctgggtgtggtaacatgtgcttgtagtctcagttactcagcaggctgaggcaggagcgtcactggagcctaggagttcaaggctgcagtgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatcttagagctctctttccaaaggaagtttgcattctctgcaggtgtaatgatgtctctgttcttcacagaatcccaataatagttggcataccaatagttggcataccaatgggagaaagaataatcacatcaaaactactgagcatcttactatatatgtgccaggcagtgttttaagcattttaaagcatcatctaatgtaatcattatgcaatcttgaggcaggaggaacttttattatcccaaatttacagatggggttggaggaagggtggtggccataaagagagtctccaagtcagccaaatgcttcagcagtaccacttcactgcccctaactgcttttggccttgcacatttatttactagggcttcgttggcccaggagagaaagcataagctaaagcacatggcccatcttacctctaggaagtcccttatggtaaacagatgaagttttttgggaagaaagcccctgctgatctaagcatattgcaggggtttgtcaacatgcagatcacccaagacaccagttctaccagcagcctaaaacctaagtctgtcaggttctggcaggacagagtttccgttgcccaaaagggttaactgaaaagcattgatcaaaaggactctgctcagcatgtatgggaggttcaggggccaatgaggattggtgagagcccccagggtacagcagctggcagaagcctttctctatgctagctctaaagaatcaagagtatagcagagtaactggggcctagaaaaatctggaggcagatgagacaatcttagaaaaggagcctggggccttagaaaaatgttgccactaccaggacctcactgcagcagggatgagggcagtggaagtgagtaactacctgggcctctctgttctcccacgtaatgatccccttgtttgtgctcctgttggccaactccaactggaagccaaaggttaagggggcctgagtgatgtggtccctcgagacccccttcccagcattcagagacagacagagaaggacaagaaatccatcagggagctggggtaggggcaaatggaaactatcatcccccagccagaactttgcaaggaaattgatctcagactcagacaaggtgcccaattcttcatacattgtttatgcatttgcctgaccaatgcccaggaagttatttgaaaaccaaaacagttttgttttgtttttttccaagaagcttgagaaagacaacagcttccttggccttagccaacaacctgggcaatttaacaccctctagttgtgtcagtgcccaagcgctaatgaacaaccactttggcattagagctgttaaacacaatgcttgggcgactttcacacttgctaatgaataaaatccctgtgcttctagaaactgctgagccagaccttggagaaatagagataaatgggtgacctagtttactcactcaggacatgaagttccacattaaggggttctttagaggtacccttactttaaatgggccacaaaggcccatatagggggaaagatttctgtgcctcgccccactcaacagggccaggcctccactagtgtttctactggatgttcttctctggagatctggaggacacagtagctggcaagctgctgacagtctggaaagaggccattggttggaagtatggtattgtgagaattatgtatttggttgtaggatggccaaactcagcagacaggagccaaatacagcagtgagttctgaaagccttagtgctgggatggttagcctgcccagaatcaggattggcattgcccaaaacaaagaggccttatcttcttaagtcctttgttaggagcatagtgagagagaggcttttttcggacaaaaatgggtccagttcccacccttcattcgggtcttctcaccaggtgcatgcggccttgtgggatatgaagccatctctgtgtcccaaaccaaagaggatgccgccatgaggagaaaccatggtttctctactgagctttagggtttgatgtccttaggtcttccctgagctggccatggcgttgtctgaaaacatgaaacacataaagcctgtgtctctggttttttcttattttgccttccctttgttttttctgtttgtttccatgctaacaaaaattgccagtgctgcatgcatccttagaaactgaattctgctgttagtgtattaacgttctctcatgtagctcctgggagtggaagtcccctcttcttccagtctcaacacagagggcaaatgtgggtggttcaacttccagtgccattagtagtagtagtagtagtagtagtagtagtagtattgcagtggctgtctgactaatctagacgcatacatgaaaacgttttcagagtgtagggacccaaccacaagaccttctagtcttccccatgttcctaatagtgtaagcaacttccaacaaggataagactcaccctcagatggtgacaagggggcccatattgacctgtgaatctcctggccccaagaagatgtccaaaaaataagcatgatcttgatttaaaattgtggtaggcattgagatagtattattctagtcataatgcagacagtcaccaattgacacaaggatatctatatatagatacgatatgtatatgtatgtatatccatatagatatatctgtatataaatatctttctgtcagttgacgaattgtttgcattatatatgtaaccacagtatacaccagtttgtgtcaattggtgacttgtattgacacaaagatatctatatagagatactagatatagatagataatctgtatatagatatttttgtgtcatttggtgactgtctgcattatgtaactaaaaattagacttatggaactcaaaatttcccctagaggtaatgttttccctggaggcaatgttctaaatagtggttctgtttccagctggccaacatttcctgctcaatatataatatagctaaaatttataggagcagaagataactgctggaaactatagaactgtttctggaaaaactgtgctccctcgagaaacactgaaactcaagataggaggaacatttctcccacgttctccttactgtagtttcaggaacagaaaagactttagttcgcatcaagaaccttgtgataaactgttcctttctgagtcatgtgttctgtcctatgatagaggacacctagctggttacaggagcccagctcaggtctgccttccaggatgtaggcagttgagaacactgtagctaaagaattaagctcctggctttgtcagcagcaagaagggagcctctgacttggggtcaaaaagaggacacccttcccacctcccgccaccatggtaaccattggtgtgtctgcagcattttagtccagagcttgctcgggcaccaccagcacagataaagtgtcagaaaatccattgttagagagcatttctgtgagtctttcccccttttctgcattgtacaagcaggtcaccaatctccatgttgacatttcctccatccccctccgcaggtgaaaagcatggcccagcacgtacataacatggacaaacgggacagttttcggaggactcgtttttctgaccgtttcatggatgacataactactattgttaatgtggtcacctcggaaattgcagcccttttagtaaaaccacagaaggtaactgtattttactctttattttctaaattgtttacctggaacatatattactttcataatcagagaaaaataagcatcattttaaaacaataattaaaatataactgtaatgacagttaaacgcagtatgttatactggactggaccctgatgtggggctggaaaattgttataaacaaattacacacatgaggccaggggttcgagacctgcctggccaacatggtgacatggtgagaccctgtctctactaaaaatataaaaattagctgagcatggttgtgcatatctgtaatcccagcaactgggaggcagaagcaagagaactgcttgaacctgggagacagaggttgcagtgagccgagatggtgccacagcactccagcctgggtgacagagtgagactctgtctcaaaaaaaaaaaaaaaaagaaattgcaatatggactgtggtttaaatgatcatatcaggctgggtgcagtggctcacacctgtaatcccagcactttgggaggcaagggtggtcagatcacttgaggtcaggcattcgagaccagcctggccaacatgttgaaaccccgtctctactaaaaatatggaaaattagccgggtgtagtggcacgtacctgtaatcccagcttctcgggaggctgaggtggaagaatcgcttgagcccaggaggcggaggttgcagtgagccgagatggtaccacagcactccagcctgggtgacagagtgagactccatctaaaagaaaaatgtagatatgaaagataatatttttgctcttaggaaatacaccttgaagtgttatggggtaaatgggcatgatatttgcaacccattctcaaatggttcagaaaaaaatgtttttatgttcatagaatgataaaacaaatgtagcaaaatgtcaagtattgataagcttcgttaaagggtatacagtagttctttgtactattcttgcaccttttctgtaagtttaaaattgtttcagaataaaagctaaaacatatataaaatggaataaatcaaatgtttaaaaggcagctacaaaaatcttaggaagcaatgtttattattaatcgctttgtcgttattgagaatgtgcatagtaccaagtgctcaggagattttcattcggttattcctcatggcaaactttgttggaacagcatggtatctccacattggcaggtgtgagaataaggcacagtgaggttgataaattttccaaaagtcacacacagccagcagtaaagccaagactggagattttagacccagatactgagtcacgtaaggcacccaggaggagtggccatgtggagaatgcggagagagttcgaggacctctcagcggcacggtagcaacctctttatcaggtccccatccatcccagtgacttgactggtcagcatggcctgaatttgcaaattgcatgttaacaaaagcaaaatagtttcaaaccatatttttaatagtgtcaaaggaaattgatttgtcattctgagaataaaggacataaacatgaaaaactgaatcccagattgctctgaagcactgtaaaatccctcataaacaggagcactgagaaataatacaaattaaaaattttaaaaataggcgtagcttattaattgggattcatggaggaatttaccctacggagtgaatacaccctgcggagtatgactctgacctctcttaggctggaaatgctgcctaattgaggaataaatttcttaggtaaaaactaattcttttatcctgattggattttctgtaataatccttaaaaattaagaaactgtctcattgaaaacagtaagtatttttcaagtcagtttgccaaaaaaaaagaaaatagttacaaaaaaaaaagttaccaggatataaaaaaaagtaggatccaacatagtatatagagaatgaggttaattatacacatataaatatgcatgtagaaaaaaaagtgactggaaggaaatgcacctaaatattaacagtgcacgaataattacttgattcaacctcacagtcatggctttagttaaaggagactcaactacttcgcccagtgccacccagaaggacagtggctgaaataataggacctgtctctcccaatgttcccaccagtgacctggaagttcaaatccagagtgtcccacaaaatgatttgggtgtttgtttgtttttaaggaaaatgaacaggcggaaaagatgaacatcagcctggctttcttcttgtatgaccttctctccctcatggatcggggctttgtgtttaacctcatcagacattattgcagccaggtgagtgtcccccccacccccacccccgagcgagccacttggttccttctcatataatgtgatgttcgttgccatggcacgctgtcttcttcattactgagttggcatgaatcctacacatcctgtgttttgcagcacgtccctcatgtctgtgccatggacattcctcagacatgctggtttaccttgattcctggagcatttaccgacagtgtagaagggtcaacagattcatctgtgggaattaaaatttgtgatatgatctgaatcttcaatttgacattcaacagaaaattaacatggctatacagtgctttcagtctttgacaagtccttgcgctcccagtctgaggtctcttttcacatattagggtaattaattaaattgctgttgtgatgctccgacttgaaagaacctttttaaagtgttcttaaataaaatcattcaaagagatttaatttcactgagcacatagcaaatatttcataaaccaagtgcatctatcagtgccatccccccagatttttaaatggaattattcatgtgctgtctccctcaaactaccttaacaatagtaatataaatagcagttattgttgctgctcctctccttccatatccctaatctagccactagtaccatcattactgctactactaccaccagccaccaccattctcattagtcccatgcccactatcaccaccttctccaccatcaccacctcccaccacctccaccacctccaccatcaccaccacctccaccatcaccaccaccacctccaccatcaccacctccttcaccatcaccatcaccaccacctccaccatcaccaccaccacctccaccaccaccagcatcttcaccatcaccaccacctccaccatcaccaccaccaccacctccaccatcaccacctccttcaccatcaccatcaccaccacctccactatcaccaccacctccaccatcaccaccacctccaccatcaccaccacctccaccatcaccaccacttccttcaccaccaccaccatcttcaccgtcaccaccacctccaccaccaccacctcctccaccaccaccacctcctccaccatcaccacctccttcaccatcaccatcaccaccacctccaccatcaccaccaccacctccaccatcaccaccacctccaccaccaccagcatcttcaccatcaccaccacccacctccttcaccatcaccaccacctccaccatcaccaccaccacctccaccatcaccaccacctccaccaccaccagcatcttcaccatcaccaccaccacctccaccatcaccaccacctccaccatcaccaccaccacctccaccaccatcaccaccacctccaccatcaccaccacctccaccaccaccagcatcttcaccatcaccaccacctccaccaccaccaccacctccaccatcaccaccaccacctccaccaccaccagcatcttcaccatcaccaccacctccaccaccaccaccacctccaccatcaccaccacctccaccatcaccaccacctccaccatcaccatcaccaccacctccaccatcaccacctcctccaccatcaccaccacctccaccaccaccacctcccccactaccaacagctccttcaccatcaccacaacatccaccaccaccatcaccaccaccaccaccacctcctccaccatcaccacctcctccaccaccaccaccattagctccaccatgaccacctccttcacctccaccatcacttcttccaccatcatcattgtcaccatcatcaccaccaccacctccaccaccatcaccacctctcccatcaccaccacgttctctgtggttagtcacttagtgactttagataagtttttccaattttatgggtcttaatttcctcagttttaaaataagaagggggggttgagagatttgagggctgatcaacgaaaaggataggaccataaaaagcagtgacatacaagcttcattgagcagcacttggacagggttacataagagcggaagcccctcccagcatgagaacagccataggcctgcagtgaggaggggaccatccagaggagcaggggaactcccaggggagaggaggattagggcagaagcttatagatctgggtgaggctgctccacagcacagtagggagtctctgggtcagagagctccaagggctgtagcagcttagggccctgtatctgcaaggctctatcttatcattaggaaacagctgtccatcgagattttatggggtctgcaaaggaggcaggcactaaatggatgaaaatctgcttatatgagctatttttgttaatgactgggcatggtaaaatttgagttaggtatgagccaagggatcagcaccagtcgacagtgaagaaataaacaaccgaggggccaatacacagaaacaatctttgacttgtttacataacacctctcctccaaaaaaagaaaaagacatgacttttctaaaggaagtcctgtctacagccataccaccctgaacgcacgcagtctcatctaagggaagtcctgataaggaagcagaataataaaaaagaatcctaaggaaacatcagaagtccccaagcatccccatcccatgcaccctgacccctgccctgcagcggatcttctgtcccaggacccaccagaatagaatggcagagggacacttcactcctccttgccctccctcttcagtatttaggattccaggttagtctgttttcaaaactttaagttgagtgtatgaaagataccctagatcaccactgcagacccaggcttagctactcacatgcaggctatcttcattcccgacagggaaataaggcaacccaaggtagatatctgccttccctgcaaaactcatgtttttattttctctttctctttcctttcttttctcttgctcactatctttctccttaaattcttcccttttcttttagttaccatttctttttttgtttctctccttgactcaaatgccaaagatccctagaccaggagtcaagaagcctgcatgctgattcctgggacaccattaattacttctgtgattgggagcatcagcctttgaggcattcatttcctcatctgcaaaaaaactaggctggattagatttatccactgattctgtggtctgtgtctgccagtgacatccacggatgttacttagcaccattagtggcactcaggcctcagaaggtcactgacccccattcgtggtgatttaattcattgatcccagctctctagatacaggatgaacttcataccttaagcaagttgtattcttacaaagtcgtctgactttatcattttgcataacctattatgttttctgccatctaaagattttgtggcaatggatataaccttagtcttttttaatagtcactaaaaatagacaaatccatttcctcaattactgtctgtcacttacaatgtgccactaagcaaacacccatcccttgggtaggggcattgtgggtcttgacctttgggaaggaagtttttggaatgcaccttactcctcttttcaaaacatcactcaaattgtttttgaaatgtctattttttttcttttgagatggagtcttactctgttgcccaggccagagtgcagtggcacaattttggctcactgcaaactccgcctcacaggttcaagcgattctccttcctcaccctcccgagtagctgggattacaggtgtgtggcaccactccccgctaatttttgcatttttagtagagacagggtttcaccatgttggccagactggtcttgaactctggcctcaagtgatctgcctgcctctgcctcccgaagtgctgggattacaggtgtgagccaccacacccagcctgaaatgtctgtcttgaatgatgtctcaagggacctatgaaagatacccatagtggggccttcttttaagtgccaatgtgttgtgggttcaagttccgatagccggcttgacccgacacctgttaatgagtaacctaagtgacaggcacatgaccaagttctaatcccttcaatgtgctggtggctccactggtccaaagtcagccaggagtgcacatcgaaaggttatgggatctggtaactgtgcttacatagaagtcatatgttttggttttaaaataatatataatggcatttacttattttaagtggatgtctaactatgaattaattctgtaggcaatatgtcccacaacacattggcttcttgtaaaatggctgaaaatatgtgttcatttaaattatattgtttagtctgtaatcccagcactttgggaggccaaggcgggaggatcacctgaggccaggagttcgagaccagcttggccaatatggttaaaccccatctctactaaaaatacaaaaaattagctgggcatgttgatgtgcacctgtaatcccagctactcgggaggctgaggcaagagaatcgcttgaacctgggagatgaaggttgcagtgagccgagatcatgccactgcactccagttcaacagagcaagactctgtatctctctctctctctctctctctctctctctctctatatatatatatatatatatatacatatatatatatgtgtatatatatatgtgtatatatatatatgtatatatatatatatgtgtatatatatatatgtgtatatatatatatatatagtttaaaaaacaaactactcttgaagtgagtgaagaggaggcatgtctatcacaaggatgatgcttcatatttctgtgctggggtggggggtgataatgatgaaatattgaggagctcaaggtgcatcagcgccccttccttcccctattttgcctttagaggagctgcctctgagtctgggtctttcagttgttcagcttgcctgggggaagcaaggggtctcttccagacagtcacctttttctgcttttcattgcttgcttcatggtttattttttaaaggaagatttttcctaaaaactcttctagctttctttctctttcttctccatttcctcctctctcagtctgggacaagctccttgagttttttgcaggtactatgtactttgctaaacagtttgatgcctttctctagggaactggttctacaactttccaatggggcctttaattagaaactacgagagaacacttgtagtataaaagtcatctagtcatattctattagtttcatacaggctcatatgaggtcaactcctttcatttagtttctcgaacatagtagagtttttgtaaaattaattatgttacggtgaagatgtacctcaagattttcagcacaggcttcccatggtattaaagatttgataaagtggaaatcgggataagaatcctcattctggacagctactaggctagaatcactaaggggaacagtaatgaatgaaaatttattagacctctctgtaatgcagaatttaccatctgttgcactatcccattagtttttattaaattgattgccttaacctggagagaaaggatatttttgtgtctgccaacctcaactccacttaccttgtaataaatgtttcattcctcttttcatttttcttcccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccaggtaataaaagaattatttaactaaaagaattattcaagctatttcatttaactagctcagtttaatcatgtatttcctataaaggttagtcttattaatttgacaaaaaatcaaacaattcaaaccagatcaagtatgctaccctgaagttacaccactagctaagaattaacaatctaagtaattggtttctccccaggctcaaggctccctgatcaggttaagtaaagccaagaatccaataagccctatgaaatttagaaactcatagaaaagtctcaaatcttcctttgtctgacattagccaattgttatattatgcaaatagaggattccaaagtaaataagttttggaaaccatgtattcaccaggtttctttgcagcaggccctctaagaggttttaacttgttcatgtcaattgcaaatgcacgagaagcagaagaggaaatgggaggaggtgtgcatgataagcagtgattccccaaatgatttaacatggaaaccccaccccacctcatacattttttgaaatgttactctggaataactttaagaacatgctgtttgatagtcacattccatttatagggaacacatcagtagctcagagcatcaggcaaaatttctcattattaggttatatttctgttgcatattccttgatactagtacaaaagtgaaggcttgtcttactaattgaaaaaaaaatcttagccatatatgccatatggcatgatccagatattagctacatgaccatcttactgtgaacagggaaagatctgactcacaagcagcaattcaaaatgtataaactttttgctccatcctgcccagcagcttaagtcctaaaacttccctggactaagcttaccctaggttctttcccaccttccccttctgactgccccagggagtggccaaacccaggggccaggctcacaaaaccatgaaggatttctaaagacactttagatgctcttaatgaaatataaagtgtgctcccaggatacaaatacaggacaggaattactgaggaccggtaaatctaatacttccctccctgacatcacttgtagttccaggccagcaaaagtctgacaatgtgcttaagccaaattcagaagtgtagctgaggccgggcacggtggctcacatttgtaatcccagcatcttcggaggccaaagggagtggaatacttgaggcaggagttaccagcctgaccaacatgatgaaaactcatatctactaaaaatacaaaaatgcatcaggtgtggtagtgtgactgtaatcccagctacttgggacgctgaggcatgagaattgcttgaacccgggagagggaggttgcagtgagctgagaccatgccactgcaatccagcctgggtaacagagtgacactctgtctttcaaaaaaaaaaaaaaaaaaaaaagaaggtacctgagtaagcagggccttaaacaaagggggcatttggttacagaggaattgcctgttcccagccccaggactgggtgaggttcttatttctctgtccaacttttatgctaggatttttatcttcagcttttgatttcaggtgggaaagggagcgtcattcatttttcaacagacccggggtgctttattttcatctttcccgctgggcagtcttctctctgtgggtatgggaaagtgcagtaaccactctgtgcctcagtttccttgtccgccttatctggcaccagagtacctacctcactggggagggctcacgaagcctggctggggcgaggactcagtaaacactggccatcgctattttcattccagttcttgtggctcataaaatggctccttacgtttctgtagaactcaagctcctgctccagcttccaggaccagaagatcgccagcatgttcgatctgacttccgagtaccgccagcagcacttcctcaccgggctcctcttcacagaactggctgctgccctggatgccgaaggggaagggtatgtttctggcatttaaaatggaagatgaagccaaaaaaacagatgttctttaataaaatttgcagtctagcttctcacacttggtaaaaaactctactgtagttgaccagttctgaggagtagaaacatctgtcttgagaatatggtacccataagcacaaggcacaagaaaggcctttcttgtgtagaaaggcaccagggatgggtaagaactacaaaatgacttttcttggtcaactatttcagtggaatttaccagttctgctatagcaggtttcccaaggatgctttgattagtgaactccctaggagcaaagccatttttaacaaaggggatagcatgcagaggcaaccacaagatgtcacttggttcaaagctgatgaaggaaataatggctgctgagaaggcagctgtcccatgcccagattaggtttcttgcagacagtgcttctcaggccaagagacaccacacatccagggcttctgaatccttttacctcttatctatctgattactcagggacatgtggcagtatctagcctagaagtcaacagacagagaggtagaccacccccttctttccttctctccctatgctccgtgagctcatggagtcagaaacccacagcctatctgattggactgaaaaagataatgccttctaaaatattattcattccgttcaacaattattgaatgccttccatgggacagacacagttaggtgttagagtacatcagagatatatcagtgcacaaaacagacaaaattcgctgcccctcaagagctcaccatccagggactcagattcaaagatgattaggattgcaaagtagttgagattcaacacttctggtgtttagattaggcatacagaattgcaggaacttgcccactattccataacagagaacgaaatctaaagccatggtcttcccagtcccttcccaggacccactctcctataccaaaccatctccctgcacagggaacctgttcccatgactcctatgctaaagaggtttccagaataatgtttgctaattaatggtagcattgctgtatgttatggatggatttttatctaaatggaatttctcaagttctctcaaagtgcttacaatttagtgaaggaaacaggaggttcctgcatgaaacaaatacaggagcacatcgagttcgtgcaactgcaacagtcacatgtgtcccaagctatgtacccaggctgacaccgctgaagtgactctatgtctgcgtctcctggcaggatagtgtggggaatctcatgcttttagctctcaattctgcctccttccagataaactggcctgagtatatcctttgagaacttcactttccatggcttcaattctatcttctcttctcaactctaactaaatttctcccaattatctcagtagaatgttctaccctacaactaacataaatttccacagcaacaaaaagtgcaccgaacacttatgctaataagtaagatactgagaagaaagtttgaacacaaagaaaattgccttcatgcacaaacatgtacatacattttcttagttgtcctttaatagcagtactttaagtgatttctagaaacatctttagtatttacaatagcgtagtttctattttctattttcattctagctggaaacagccatgacattctgttctggattccttgtaaaattgttgctgttatattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgctgggttgtcagttactctcctggaaagtcattagatacactgtcacaacttcatcatgtaagctaaaacctcagaaaaatgtcatgcttcaacaatacttcctattgatcagcacttcctttttttttttcttttgcttccaagacagttggtagacttgccaacacctgtacatccatggggcaagggccagaaggacgcatctcagtacctgaacccctagggagctacagctccagtttccactgggtttcccttggatctctgacacctgggtatatccacaagtgtctatgcatcgttaaatccacagtgtttttcaagcatttagaaattgtctatcatctttgtgttaagccagcaaattgcaatgcctaattcaaaacacaacccattgccgggaccacagactaagaacaagaaaaacttttgaaatgcaatttacaattatcttactttagccacagtgcaagagtctgagtcatttaaaattttggttaatattttctatataacgttgaattctgatgtagccttattttgtttgaaagaaaaaaatgtatatatatgtatatattttttaaatctggattctttttttattattatcatactttaagttctagggtacatgtatacaacatgcaggtttgttacatatgtatatatgcgccatgttggtgtgctgcacccattaactcgtcatttacattaggtatatctcctaatgctgtccctccccactccccccaccccatgacagtccccggtgtgtgatgttcccacctatgagtgagaacatgcggtgtttggttttctgtccttgcgatagtttgctgagaatgacggttttcagcttcatccatgtccctacaaaggacatgaactcatccttttttatggctgcatagtattccatggtgtatatgtgccacattttcttaatccagtctaccattgatggacatttgggttggttccaagtctttgctattgtgaatagtgccgcaataaaaggattataaatcatgctgctataaagacatatgcacacatatgtttattgcggcaagatgtatatttttaaaattgaacatctatgactaggttccagatactccactatatattttatttactttttattatagtataatttatataaagaacctgaatcctaagtgtaaagtgcgattaatatttcctgtgaatatatttgagtaaccaccagtcagataaaaaatataatattccattatcctctctcagttacaggcccccctcaagtaaccactattctgactcttattattagaaattaatactgcctgttgttgaatttcatagtcttttgctgaatgttgtgactgtgacatcctttagtgtggtcgcatgtgtcagtattcattttttttcaactgtatgtcatattcctttgtctactataatttctcttctgtaaattgacatttgggctgctttctatttgtgggtattgggtattatgaaaacagctgccgtgaacatgcctgtgcatggttttgggtggacgttagaactcatttctttggggctataaatacagcctattttttattttaatatactgctcttgaatagtttaataaatatgtgtacatggtcttaacaaaatgtcaaaagaatatactctgagctaggaaaagaagagcaaacaagtcaaagcaggaagatggcagggaataacaaaggtgatagccaaaataaatgaaataaagaatagaaaaacaatcacggaaatccgcaagatgaaaagcttgttatttgaaaagagcaacaaaattcaccaatctttagctgagctgaccaagaaaaaaggaagaagactcaattactaaaatcataattgaaagattcaacacaatcatatcacaagagaccttacagaaataaaaaggattataaaagaatacgatgaacaattgaaagccatcaaattgataacctagattaaatggataaattccttaaaaggtacaaagtactaaaattgactccaagaagatatagaaaatccaaatagacctacagaagtaaaaagattgagttagtaatcaaacttcccacatacacctactatgtacccacacaaattaaaaatttaggctgggcgcagtggctcatacctgtaatcccagcactttgggtggccaaggcgagtggatcacctgaggtcaagagttcaagaccagcctggccaaggtgatgaaaccccgtctctactaaaaatacaaaaattagctgggtgtggtggcgggaacctgtaatcccatctactcgggaggctgaggcagaagaatcatttgagactggaaggcagaggttgcagtgagccaagatcatgccaatgcactccagcctgggcaacaagagcaaaactccatcacaaataataataataataataatatattttaaaatttaaaacttcctacaataaaagctcaaacctggggggctttactgatgaattctaccaaatatttttaaaagaattaattctaattttttaccaacttccagtcttctcttccaacgaatggaagaggtggaatacttccccacttgttctatgaagctagcattaccctatactaaaccagacaaagacatcatgagaaaactacaggccagtatctgatgaatatagatgtaagaccctcaacaaacactagcaaactgaatccaacagcatataaaaaggattatacaccatggctaagtaggatttatctcaggaatgcaagataggctgcatacctgaaaatcaattgttgtaccatattaataaaataaaggacaaaacccatacaatcatcttagtagatgcaaagaaaagcatttaataaaatctaataacgcttcctgataaaaacactcaacaaaccttttaggaaataagagaacttcctcaacttgacttaagggcctctatgaaaaatccacagctaatgtgacacttattagtgaaaaacagtgctttatccctaagattaggaacaagacaaaaatgtctacccttgccacttctattcaacatattaggagttctatctagggcaattaggcaaaaaaataaaacaaaagacatctaggccaggcgtggtggctcacgcctgtaatcccagcactttgggaggccaaagtggacagatcgctttgagcccaggagactgagaacaccctgagcaacatggcaaaacgccatctctacaagaaatacaaaaattagctgggcattggtggcttgtgtttgtagtcccagctacttgggaggttgaggctggagaattgcttgatcccagaaagcggaggttgtagtgagctgagatcacgctactgcactccagcctgggccacagagtaagaccctgtctcaaaaaaaaaaaaaaaaagaaaaagaagaaaagaaaagaaagcatttaaattggaaaagaagtaaaactatctctattcataggtggcataatcttgtttatagaaaaccataaggaatccacaaaaaactccattacaactaataaatgaattcagcagtgttgcatggtataagatcaacatacaagaatcaattgtgtttctatacacttacgatgagcaatctgaaaatgaaattaagaaaacaatttcatataaaatagcatcacaaagaaaaaatatttaggaataaatgtaacaaaagaaacacaagagttatacactaaaaatgacaaaacactgttgaaagaaagatataaataaatggaggatatcatatgttcatgaatcagaagacttattattaaaatagcaatactccccaaattgatccatagattaaatgcagttcttctcagaattctagcttgcttttttttttttttggcagaaattagcaaactgatcctaaaattcgtgtggaaattcaagggacccagtatagccaaaacaaccttgaaaaacaagaacaaaattggaggactcacacttcccaatttcaaaacttactacaaagcaaaagtagtcaagactatggggttctgacatatgatagacatatagatcaatgaaattgggttaagagtccaaaaataaatcttcatatttatagtcaattgatttttgacaagagtgccaaaacaattcaatgggggaaaatagaattttcaataaatggtgttgggacaactgggtatccacactcaaaagaatgaagttggaccctatattacactgtatacaaaaactaactcaaatagatcaaagacctaaatgtaagagctaaaactataaaattgttacataaaattatagaggtaatcatcatagacttagaaaaggcagtggtttcttagatatgacacactcgaaagtatgagtaacaagaaaaaaatagataactggacttcagtaaaattaaaacttttgtgatttataggacaccatcaaaaaaatgaaaaggcaacacacaaaatgggagaaaatatttgcaaatcaaaaacctaataggggacttgtatctggaatatatattttaaaatcttacaactcagtaataaaaagacaaataactcagttttttaaaaggcaaaagatcagaatagacatttctccaaagaagatacagccataagaccatgaagatgttcagcatcattagccgtcagggagatgcatattaaaatcacaattaaataccacttgatacccacgaagatggatataataaaaaagacaggtaataaagtgttggcaagaataaaatggagtcttcagacactgctggtgggaatgtaaaattgtgcagccaccgttgaaaacaacttgctgattcctctaaaagttaaacagaggctgggcgctcggcggctcacgcctataatctcagcactttgggaggctgaggtgggcagatcatttgaggccaggagttcgagaccagcctggccaagatggtgaaaccctgtctctactaaaaatacaaaaattagccaggtgtggtggcaggtgcctgtagtccccgctacttgggaggctgagtcagaagaattgcttgaacccaggaggtggaggttgcagtgagccgagatcgtgtcattgcactccagcctgaacaactccatgtcaaaaaaaaaaaaaagttaaacagacagttaccatacaagccagcaaatgtactctgaggtatgtacccaagaaaagtaaaacttaaaacttgtatacacatactcatagcagcgttggtaagtcacaatagctcaaaagcagaaacaatccaaatgtttatcagttgatgaatggataaaattcaccaatggaatattatttagcaataaaaaggaatgaagtactgatgctacaatatgataaacttaaaaacatcatgctaaacagcagacccagggttagaacacaggcagtctgtttctggattctatgtagttctatcctatattgcttggttttccagggttagaacacaggcagtctgtttctggattctatatagttctatcctgtattgcttggttttccagggttagaacacaggcagtctgtttctggattctatgtagttctatcctgtattgcttggttttccagggttagaacacaggcagtctgtttctggattctatgtagttctatcctatattgcttggttttcacagtcacctcattgcttaggagcgttttcatcactcttgactgtttaagagctctttagtcaatttcctttcaccataacctcttgattcctgtgttgtgccaacagaatcagcaaagtacaaaggaaagctgtcagtgcaattcacagcctgctaagttctcacgacctggacccacgctgtgtcaaaccagaggtgaaggtcaaaatcgccgccctttacctacctttagttggcatcattttggatgctttgccacagctctgtgactttacaggtaatggcccttctgttttctttcttggattgttgggggcccctgccaaatgccccatccgaatgagatctctgtcattcgttccagtgctgatatgttcatatgagcaattcttcacaaaaatggtctccaaacctctttaacactggccccaatcagttaaaaaaacaaaaaaagtcacatagccccatatgtgttttttgtttagaaattatttacttgtttcttcattcattcatttattcattcattgatctgctagtatggaatgaactttataaaccatacaccacaaaggatgaaataataacaagattactgcctttggagatcgtgctctaacaccttgaaataaaggtgttccttcccttttcttttatgaatatgtaagcaaaaaagcggtctcaaatgaacccaactaattgctccatgcaaaaaaaaaatcatggcatatgtcaatattagaaaattctatcatagcagagaaatattgcccttggcactaagtgactaattttgaggttaatatgtctagattagcaacaagatgaaaggataagttgtcttaaaggggttttgtgaaaccccagaatctatttacaaattacattgtggattaaggaatgtagagggaaaaaaatcctcccaaatagaagaacttcttatgttgacctgagaaaggcagtccattggcctaccctctccacagcgtacgtgtgtgtgcacgtgtgtgcgcgcgtgcacacacacacacacacaattcctatcccatcagagtagttcttgcttttcctccagctcaagggaagttttggaaatgtccatgctgctctcttggcagctgaagggtgctgggatctgggcaatgcttccctgagccagcctctttatagtcagtcatccttgaaatcttggaaccatccaggttttcccacctcctccaaatggaaagtgtcatgtgtgactaaattgtttataatactattacggtgacaagtatttagttcatgaaaatgggaccaaacgcctatagtctttaattcatacaaatcataaaatgaaaagcaagtattcctgtggaagtaattctctcctttcttgaaaaaaatcctctagcaaactgctaatggagtaactcagaagagaaaggttgagacaggggttagggtttgtagagttctgttggggccagagtgcaaggaaatgatagaaacaagctcagcacacagggctgagcaagctgcaccatgaggtcagcagcttcctctagcagcgcctgattgcgcggaattgaaaatggagttgtttttaacatttacagacataatgcagagcatggcatgtgacttgtagcccattttgagaatccttgatggcaagtttctaaaaagttccatttcaagagcttgcttgttcccaaagccaggaaccactttagcacacattatccgaagttttcttgtcaattagaatattccgtatcagtgactcggaatcagaacttttcaacatttggtctccaagccttttaaacctcaaagacttctttgtatatgcgttgaactttatgatcatgatgtagctgatgagagaaaaaaacagtgaaaagtattttattgttataggttacacagtacatctattaaatatggaatctttaggttgataaactcataagaatacagtctttcaaaaagatgcatctgaattcagattccagccccatttattaatataagtgacctttgaaaggctcaacctttccgtgccttcctttcctctgtaaactataaaaatgtgataacgatgtctaccttttaggtttacgataaaggtgaaactagagaacttctataaaagcattttgcacagcacatgtttgtatctttcccgatttttcttgtaactataaccctatggcaattaaggggaaataagaatgtgtctctatgttagttgtgataatgttatcaggtcttgcataatttccatgtgctgtttatttaaccatttgtttaaaatcccaatggccttaataagtatttctaaaaattgggttttggctcggtgtggtggctcacccctgtaatcccagcactttgggaggccaaggtggacagatcacttgaggccaggggttcaagaccagcctggccaacatggcgaaaccctgtctccactaaaaatacaaaagttagccaggcgtggtggcgcacctgtaatcccagctactcgggaggctgaggtaggaggatggaggggcagagattgcagtgagcggagatggcgccactgcactccagcctggatgatagtgtgagactttgtctaaaaataaataaataaataaataataagaactgggttttgttttcacaactttagtagaagaaatgttatttacactcaaatttttctaaataattgaaggcccagatggctgtaatgtcaacaggtctagaaaaacatgaatttttaggaaaacatgagtgaatcaatcagttgtgaatgttttaccacacttttcccagaactgcttgaaatattaatagtttttgattgtatactggtagcattcttaaaaaccagacttttaaacggtttatcgtttttttgcttgcatacatctagacctatctataaatatgggtatgtctatattacatagatacaataaattgacattcattttaaacatttgaaatatgacaaattattgctgaacttgtgataatagcttattattctatataaggtagttgcttaattctgtaattgtaggtgtcttctatttggtcattatttaaaataatgccaattattagaatagagaatgaagtttaaaaaattatgttacaggaaacaattatggaaggtttgaaaactttttgttcacacaatttgaaaaattaatttctagcctaatcttgtgctagacattgtctcttagcctgctgtgttttcctataggtgatagcagatacataatgctaaacatcaggtttgaaattactgtgctgactttagtgactgagaagtatcagtctcttattgggtaggggacatggggaaatgtcatgtttgacttgacatcacaaacgatgttttcattgcagttgcagatactcgcagataccgcaccagtggctcggatgaagaacaagaaggagccggtgccattaaccagaatgtggctctggccatagcagggaataatttcaatttgaaaacaagtggaatagtgctgtcttccttggtatgttggtgcacatgtgtctggttgatttttcatttcatgtcttctgtcttctgttttgttttgtttgtttgtttgttttgagacagagtctcactctgttgcacaggctggagtgcagtggcgcaatctcagttcactgcaacctccgcctcccgggttcttcatgcctcagcctcctgattagctgggattacaggcgtgcaccaccacacctggctaattttttttgtatcttttagtagagacggggtttcgccatgttggccaggctggtctcaaactcccaacctcagatggtacacccacctcagcctcccaaagtgctgggattacaggcgtgagccactgtgcccagcctcttctgtcatcttctgatgggagaactcagcttagagcaggcattgattatttccgcctcattttgctggaaagaatcattgtgaggctggcagctgaggtgcacacaagtcagaaagggttctggcaacagcaagagatgtgcagatcaaattcaggcagtcccagtggtgctgagttcaagttcaagaaaccggaaaagaggaaaacttgggaaatctgaaatccttgcaaaggagatcaaaccaaggctctctgagggtggaggcttaggctgtgttcagtctatgtgtgtgtaattcatacagtgtaatgcctccaaaaaaaaagactgaaggaggctggtagcttagcgtaagggcttcttaaacaagactgcagcttttctaggaccccagggagcctaaggagggttgtttggctctgtccttttgcatggactctgtgggctcaaagaggggctcctctgggaatgtatcctctgattcagttgaggtgggattcatctctgttcattgatgagctctgactatcccttgtgaagacagcactgcatcctccaatgtcatttactttcacatttcaatgtagggtatagatgtgcagagaatttaactttcttctcccgtgagaaagcagcatcctgacctaactcttcttgctggatgactttcttgtcttccttcctgcacttagcaagctccatcaccatgaggattggggggacagtgaggcaggaagatgagacagagaaaagacatttgagatttgacatcaccgatcttactgttggagaaatattgtgtgacctcctccacctttctaatatccgtcttaccaaagttagctgcttgaggtggtatatgccttttacattatttgcctctaagggaaaaactcaaaagcccaaagttcacctgttagaacatagtccttgtgaggttgtatctcaagatttcctttattcttgtcaacaaactcagaataactaaagttaaagttgctttataacctctattatttccatccaaaactaacatttccctcccatacccacaaattcctcattgcaatttcaccagtacattccactggatattagctacgctgcatgaaccaagggtgcagcctcattgttgttgtttgtgttgatgagatgagtaacagagagtgcgctcagcactttaaaatgaatacttgtggccaaaatattaaagcaaatagcctgaacccccacaccccagccccaggcaaacataaattatggttaaacttccattacagagaactccacaaacatggatttgattaatttgctgagcagttcatgacccttatgttatactttgcactatgtaacaaagaagctaaatcttgaacagcaagcttattcatggcacccagccagtttccttctcccctgtaagtctaaccctctgctgcccagcacgaaggagaaatacttggagatcttagcagcatgaaagcctctttgtatcactgggattgcagcacgcatgatcaaggcccaggggtgatcaccaggccacactgctcctaagacagaggtactcagatacgtggctgaaagcctagctcaaatactgccccaggtgagcctctttgctgagtagcgctactcaaagaacacagcttcccctgcctagggaaggcagggctactggcaatagatctccagcctagcagtgatgtacagtcatggtattttaagagaacactttgaatttttctgttgcttgactgttaagcctcaaatttttctgttgcttgacttcttccctggcctccatcccccaatctgcctcccttcagccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataaggtaagtctggagtggcacaactttataccagctcttatctctcaattgcaattctgtcttcttactcatcccctttgtttgggccatggaggcatcattaatttttctcatttctgtattcaaatccataacccatttgtaggtatagatatgatcatttcacagggaaaggatctctgccttctgcagagagaaccccatttctgttgacagagttttggcccataggatgctccagagcagcatctcagtgaagcacatgtcaaacttagctggcatcactgtggagtgtactgttttggtaactctccccatcaacggagatctcaccaaaggacatgtcctcctacctctgtcttgtccagggaaaacagagttctgacaaagtcagtacccaagtcctgcagaagtcaagggatgtcaaggcccggctggaagaggctttgctccgtggggaaggggccagaggggagatgatgcgccgccgggctccaggtgtgttggactggcccttccctgctctctgtcaagcagtttttcactgtttgtggggaggaatgtcctcccaacatgattagacaccattactttcttgagatatttacggtagtgtcagagacagcggattctgggagtctgtgtgtgacatttgtgttagccctgtgcctgtgagggaaagcgctgttctacaattgtaggaaccctgaaaacagcaccaaatgacatcttttaattaaaactcgttgatggtaaaaggtcacctctaagaatgtcagtcatggatgaggtggaaggtgtttccctcaaggctgaggcctttctatgtgacctttggctagtctatccggagcatggtcaagaaactgaacagttctggccccaagatcatcttctcgatcattcagggcactattagaatggaaccagttccctgaaatggcttcagagtgtcccagtcattcaaggattccaccacaggaggaatgatctcaaaaaggctgagcttgaatagaatgaaatccccaggtaccctcagtcttattcaccatgctcaaagtaaaacagagtgacagcttattgtattcgaagggacacagtggcagggaacttggagggagctcatagttttcagtggtggtcaggcaccctcatttgacacccatactttcatacccaataattcagtaagcccccagagtttcacaggaatcctctgctcatgagaaatgtctctctgacactcagaaaggcagaggttcttcttatattctagtctatcaatcaaagagcgggccaacttggacataggtgtggcgactttgtctcctaccagcaacctgcatggactctaattagcccgagaaatggtgctgaggcttctcagttgagcttgttatgaacttctggttatcttggagggtttcatgctaatcaaattcctatcatgcatttcttaactcctagggaacgaccgatttccaggcctaaatgaaaatttgagatggaagaaagagcagacacattggcggcaagctaatgagaagctagataagtgagtcactcggcaactttctgctacttttacctaaagtccaaaactatttttcccaggctgcttgtattactgaaacaactgcatccttccaagggttagaaaatgaaacatcattatctgtgtaaatacaattcatccagggacccaggataatcaaaggtatagggagttgtggtttccagctcttaaaaatttgtcacattgataagcatgtaaagaaaactaatatttctttagcaacctcagatggcttaataaaagcagctgattttgcagggagggtagcagggaaatagagaaagcaggacacggtgcctaggaccgtatactttcaaatcgatatttcctttctggaaatatgtacaagatatacattcagatatatttatgtcagtgctacttaaagttgttttttaaaattgaaaacattctaaatgctccagaatagaaaaatatatttaaaagttggattgccatcaaaatgttttaaaatcatcttaatgacatggggaaatgcttatgacataatgttaaatgaacaaaggcagggtagacacttggttttctagtagtgtgtggctcacgcctgtaatcccagcactttgggaggctgaggccggtggaacacctgaggtcagtagttcgagactagcctggccaacatggtgaaaccccgtctctacaaaaaatagaaaaattagctgggcatgatggcagatgcctgtaatcccagctactcaggaggctgaggaggaagagtcgcttgaacccgggaggcagaggttgcagtgagccaagatcgtgccattgcactccagcctgggtgacagagcaagactccatctcaaaaaaaaaaaaaaaaaaagaacctcaaatctctgatgacatatagtcaatgtattttttaaaggctagaaggaaatttaccaaaatattaattgcggttttctttgggtgctgggaatatcggtaattgatgttttctcttttatactttgctatgtttcctacagtagatgtgtattataatatatattgttaccagaaaaaaaattataaagaaatgaaagaataaaaaaacctgtttggatcaaaatctatgctatagatgaatagatatattgacgtgtattgctatatatgcaacaatttagacatatgaaagctaaaagtatatatgtttgactagatagcacatgtttccgataccgtttagccacaggtagcctaatgagtcccagggtttgctgagcaaaatgtcgtagagctaaaatcacccctcacacacagttgacaaggtaggataccccatgggtgatgaagcacccatcaaagggggtatggggcagacttgattagcagtgctgttttgtaaataaatgtgagttaatatctttattgttaccacaagaatgaatcattctggttaacttatgggactttggggagtcacatttattttaaaacattaaagaaataagtatatttttattatagatgtgacttggaaacccagttgttggtatcatgcctatttgctttgggtatgttattcttgcactaaattccctggactgatttataaaatacttggatcggagagtccatacattctacttcgggcaatgaacaacaactacaaaatatgcatgccgtgggtgctacagaattgcttaggtggtttagctcatctactctactagattaaaagaagacccctaagtaggcctgttttgcctgggctgtgtaaactggtgttttggaaaacctttcccttttgcttgcaggagcaacacaatattggtccttaccacgcatggcctaccggtttgctctaggttagttctcagccctgcgctacctggtgggctgctggttgtcagagctaatgattcacatctacaaattctcaggggctttgtgctttttttttttttttaaaagggaaaccatagtaaaattataactgttcaacctacctacctggaaaatttataattataataatggtgtctttcaccctctttctgatcatttttcgattattttggctctgtttcttttagagcaatgatcttcaacttaggctgcacattagaatcacctggggagctttaaaacctgtcagtgcccagctgcaccctagactacttcaattggaaactccagcaggacccagaaatcagtatttggtaaaacttcccaggtgattctattgccaccaaatccattgttttaaaggaatagatggtaagcttttcttttcttttttttttcttttctttttttgagacaaggtctcactctgtcacccaggctggaatacagtggcacaatcacagctcactgcagccttaccctcctggcctcaaacaatcctcccacctcagcctcccaagtagatgggactacaggtgtgtaccaccacaactgcttactttttgtattttttgtagagacagggtttcaccatgttgcccaggctggtctaaaactcctgggctcaagtgatccacctgttttaacctcccaaagtggtgggattacaggcatgagccactgcgcctggtcagatggtaaagcttttaaaaaaccagattagtgttagtgatggttgcacaatatgaatgtacttaacactactgaactgtatacttacaaatggttaagatggtaaatttttatgttaggtgtactttatcacaatacaaaaatttgggaaaaaacagattaggacactctagatttgtgctgtccaatacagtagccattagccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcaattaattaaaaaggatgataaggggccgggcacagtggctcacacctgtaatcccagcactttgggaggccgaggtaagtggatcacgaggtcaggagatcgagaccatcctggctaacgcggcgaaaccccgtctctactaaaaatacaaaaaagtagccgggcgcggtggcgggcgcctgtagtcccagctactcgggaggctgaagcaggagaatggcgtgaacccgggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatataaaaatttgatggctcatgcctgtggtcccagatactcaggaggctaaggcagagcatcacttgagcccaggagttcgaggcttcagtgagctatgatagtgccactgcactctagcctgggtgatagagcaagaccctgtctctaaggaaaaaaaaaaaaaaaaacttttagatttcatttattttacacatatattatcacttggaaaatgagaaaaagtgtcaagtggcttgggaccagagagcctatcctaaacatgaaaacaagtaaaacacacagaagtacttattttttgagtcctcagtggtatgtaagcagctgcagtgcccccattattaggttaatgggacgcaagaacaggtaagtggtaaccctggcccaggacatatgagctgatataatgataccccaaccccatggtaacatcttggctactgaggcatcttggtaaagtcaattcttcatacctccctttccttgcaactagatttggatgatgatacaaaatatccctttacagcttcacttagatttcataagaatggatgggctagcaaaaaaaaccattctgattccttaaagtgaaacctaatagaggagcgagcaccaggcaatttcccattccctagtgggcaatgaccagtaatgtccggcaggatattagatcacctgccctacaggaatacagtcttgtttcccaatggaaaaggacgaaagaccccacgcacttggctgagcaacctcaaggtgatctttgggaagttaagaggctgactctcccctgacttggctctgaagctccaccctttcctaacccagccgcatcactgccaagttcacatcacatccagtctcactctctctcgcatgttgcaggggcttccccttactcagatctagcaatggttttcatgcgtgaaatacagccatggccctgaggctttaggcaacaatctgagaggggagcttaattgctagtagcaactaataactgcttctctacccatagtgttatttttataattgtcctcatcattattaataatagtggggatgaggatgaccaggaaaccttacctagacagttgtttcgacaagacatgaatcacagaaggcacctgcactgtagttactcagggccagttgctctgttttcatttcaaggttgactattttggagatttctttacaccttggtgtatagattgccatcatgggaacctggccaggtttgacatgcgctttaatttgacctcttgttgtttcctagaacaaaggccgagttagatcaagaagccttgatcagtggcaatctggctacagaagcacatttaatcatcctggatatgcaggaaaacattatccaggtgaggaaaacaaacacccaatctgatttgttggccatgaatatgtttactagaataaggacttctttatgcaaaattgtgaaagacataaatgtgatcccatagtaccttttttaaaaaaatgaagttgagaagtttactatttacaacagtgtctaccttataaattccagagataccaaacattcttctggcttctttgacttagggcttacttggagagggttaggtgtttggccagctgaccctcttggttaaatctgtgtgagtatgtaccaagtttataatatggatgttgggtttatcgtttagtatctagaacagtagtggtaagtagaattttttctgatgggtcaactccagttgaatgatggtcactgtctgatatgggagctatgattatgactaggctaggtaaaaagagtgctaaatttgacaaatgatgtcttctttggacttaaatttgttaaggaaagtcatttgtaccatgaatttgccatccctgctgtagaaaaatatagctttgtgaactttgtaccatactaattttatcttctatgtgattatttccacaaattcccaagctgtctaggtaataatgagtttttaattaccctgaaaaatgagttcttacatgtttccattgagaagtcattcattagagtaggtccaggattgcttttagggctagaagaaatatcgttgaaacacagtgaaatcttaattctctaacttttgaattgtctaaaatcaaagtaatcatcatacaaaaataaacacaaaaagtatgtgatatttttgttgactttaatatctttgataacttaaatgcttggtatcacatttaccttatctttatatagcacaatattaggtgccaaatatctatactagcccccaaatatatttgcagttttcaaagaaagctgaaaccttttgttattatccttggtgttgttagtccttctgtaggtgataaacaagcttctatttagaaacattgctgccaccaagcagcccctgttgtactgggaagcccacaattgtgttttgcatcccataaggaaagctatgtcttgtatacaaagaaagaactttccaaaagatgtgacccaggatgagggagatgggccttataccttcatttaggaacccagaattaggtataaatcccaaactcattggaagcattgaaataaagccatttggaaataggtcttcagttcccatggttaatggatgatacccatggtggctcaccaaactcttaagactcaccactggacatggaacatcagcattactgagctaattgtcaggaacatccagttcattggcacagtgcagggattcaatgatgctgttcttccattcccccaggcgagctcggctctggactgtaaagacagcctgctgggaggtgttctgagggtgctggtgaattctctgaactgtgatcagagtaccacctacctgactcactgctttgcaacactccgtgctctcatcgccaaggtaaacttgggatgcttgttttcttcctcttaattaagagtaagattctcatctagcttcatacttctctcttcaggtggaccaaaagtcacagagcatattaagtggcatcacagtaaaggtcttaagtcttcctaggaagaaagcagatgccctgattctgtgggaagccaccatggagaggaaaagcagtggctcccatatttgaagtgtggacctaactctagaagtttaaaatggccattcgctgaaggtctatgacatgagaacagagatcaactgagtgacttagcaatttcactctttctctgtaatacctctgctgagtgagattaaatcctctatgtgacgcccattagtcttacaaaatgtcatgccataaaatgccaggaaggtcagaaatgaatttctcacggcctgaggaatgaggattatcctggggtaacatgcagattatttttccctttatttatttatttatttatttttgagactgagtctcgctctatcgcccaggctggagtgcagtggtaccatctcagctcactgcagcctctgcgccctgggctcaagcgattctcatgcctcagcctcctgagtattgggattataggcgtgtgccaccgcacccagctaatttttgtattattagtagagacagggtttcaccatgttggccaggctggtcttgaactcctgacctcaagtgatccacctgcctcagcctcccaaagcactgggattacaggcgtgagcccccgttcctggcctatttttccctttattgaagatctcaattggtgccttctacatggggtcttttaaatttaaaaagtaaaattcttctgctcatccttctcaggaccattttctctttcttcatcaccagtaatttcccaggaacccaagaaactcaggtttccttccatcatagttgtgatttcaccagtgaatgcgacctggctcacagtgcagttgataacacagctctgacccttttagctggacagttcattattaaatctcaagtctactccattgcttaaatccatcttctgattcacatagctcattatctttatggaataatgcattaactcttctaggctttttgcttgtccaaatggacatttgcatatttcaacggtccagaaagtgtatcaaactgccaagtgatgcctaatggccctttatgtctctcctagtttggagacttactctttgaagaggaggtggaacagtgtttcgacctatgtcaccaagtcctgcaccactgcagcagcagcatggatgtcacccggagccaagcctgtgccaccctttacctcctcatgaggttcagttttggagccaccagtgtaagagttcaaaccagctgagtgacctggaatcagtagagaaaaattgatgtaaagcatcagctgcgaaaaaaaataaggaaattttgcagtattgcagtttacttctgtcctgtgagaaagaaacaattgagtatgtagatagatagcagcttccattttaatttgcatctaaaagtgaattcatcagataaatgcagtggtctctatcagtgtgtttctaaaatagacagccaggggccaggaacgatggctttcacctataatcccagcactttgggaggccgaggtgagtggatcatttgaagtcaggagttcaagactagcctggccagcatggtgaaatcctgtctctactataaatacaaaaatagccagatgtgttggcgcatgcctgtaatccaagctacttgggaggctgaggcaggagaattgcttgaacctgggaggcagatattgcagtgagccgagattgccccatttcactccagcctggacaacagagtgagacttcatttcaaaaaataataataataaaataaaataaccaggtgcagtggctcatgtctgtaatcctagcacttcgggaggccaaggcaggcagatcagatgaggccaggagtccaagactagcctggccaacatggtgaaacccccgtctctacaatacaaaaaattagccgggtgtggtggcacacacgcccgtaatcttagctactggggaggctgaggcacgagaatcgcttgaacccaggaggcagaggttgtagtgagccaagattgtgccactgtattccagcctgagaccctgtctcaaaaaaaaaaaaagaaagaaagaaatggaagagtattttagattaaaagttatcatctgtgggggaaaaaatacaatagacaggttagaattcagaagagtgtttcctgtttctaaattctgactagctagtgccagaatgacctgtggaagaggattttaaatgatcggtgtcatctaacctgagttttattttaatattttatttatttatttattgagacagtgtcttgctctgtcacccaggctggagtgtagtggcactatcagagctcactgcagccttcaactcctgggctcaaatgatcctcctacttcagcctcccatgtagtaactgggattacaggcacgagccaccttacccagctaattttttttgcatttttgttgagacagggtcttgctgcatgcccaggctggtctagaacacctgagctcaagtgatcttccctcctcagccccccaaagtactgagattataggcatgagccatcctgcctagccaagacttgagttttattcaaagctacgaagactttggagttcagctttattatagaacagtcaagtttgctttagtttgtctagattttgataccttctttggaatttccatttgtggccatgttaataagtatgctcaagtgatatataaagataaattggcccatggaaaaaagtcagcctcctccaaatgtattagggatgattatttaaaagacattcctcaggggaccttgaggtagccatgtttttccatgggcctgtaaagaaagaagaaacaaaaccttgttgcttacccggagttcaaaatctcagaaatgctggccacagaagtcccctgatttatttatttagagacagggtctcgctctgtcaccgtggctggagtgcagtggcgagatcttggcccactgcaacctctgcctaccaggtttaagcaattctcctgcctcagcctctcgagtagctggaattacaggtgtccaccaccatgcccagctaatttttgtatttttagtagaggcggggttttgctgtgttgcccaggctgatcttgaactcctgagctcaagtgatccaccctccttggcctcccaaagtgctgggaggctgagccagaagtccctttcttttaataaagtttaaataaagtcccaagaagaaactcttggcacaaaaggatatactgtattcttggacccaactttataagaatcttccagcttgcagcacaaaggcagcccagtcctcaatgaaaatttaaagggagcctgacagatttatgtgagagcaatgtccatttaaaccatttaaacaacaatatgaatgttgtgcaaagtgtagctcccatttcattgagagaagaggaaataattaagacggggcaaaggaaacactgaggagttgtttgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccaggtacaccgaagcacataccttgtctcatgcatgagtttgggatctgccaactattgtgtatgtatgtatgtacatatatacacaatttatatataaatatataacatttgcaagtatttattgtccaatatgcatgtgctctcagcactctgagaggttttaaaaagaaatacatccatcactgtccccagtctcaatatgctaacagtctatttggagtgctcagtctcaaaacaattaggaggcagtacaagacaagtgatacataagtgcaaactgtgtggtaaggagctaaatgctatggaaggttagaggaagagaggtcgtgatcaataaacaatctggtggccaggaaagcctgcagggagggatgacactaaaggctggggtaggattccgctaggcaggggaaaagtgagggggaaattgtgagtagttgaaacaatgaattgtttgtatctgtagggatggtaaagggaccagcttgtctggtgaggggtaaggaagggccgagtttgagagagcttgtaaacaaggttgtcctaaggaaatgtgtaaggacagtcatctcttccatgtccattacgatgaccgtggaactctagcctgtcccatttgtcttttaactccagctcctagcctgctctatggtagggtcttaattaagtgagaatgaatgaatgaatgttttcttttattcccttagtctgagaaccctatttccggagtctgttttgccctctcgggcaatgttgcatcctcattctcagaatctttttcctctcctctacatcaaatcgttcctctctcatttcatcttgaccatactcctttagttccatcatttatatagaggtattcaccaacaagaccaatcaaactatgggcagtttaataaaggtcttcagtgccttcacccaatgaaatgactctagtggtagaaattttaggagccctggcaagctggcagaggggaacggggataagacaacattctgtggctgagttacctgccagggtctctagatcaagccatagtctctccctgtttttgtactgcaggctcccctggacctccactgttggttttataattaagaataaatgattacaagaggttctaaaatctctgaagccctgggaagatccaggaggcttctgagacatggaactcaagctgaggtcctaagctgcttcctacttggtataaaaatccctgatattccagagtagagtttagaacttttcaggttacaaataactgaaactggttcaaactaatttaaacaaaaatgttggagatagagatagtatgaggattcaggcagatttctggatctcaagggccaacacacatccaggtctcataaactcctgggctggcgaagatgaaaactacagagtcaggtctagatgactccgccatccctagtctctgctgccctctgatccaacccttcccatggcttccccttgcatttcaatgtaatcctaactcttcacctgggactacaaagctaagattattttgaggcttacactttttgcaggtggaggaacttctctgtaatctgaatagcatcttatatgacacagtgaaaatgagggaatttcaggaagatcctgagatgcttatggatctcatgtacaggtaagctttcctgacacactcaagggacaccatttgggggtcgaggatttgtcactgtggagttcttactaatgtaatgatcacagctaacatggatatagtgatttggatgatagccaaataatatatagaaattaaacattcagagtaggttaattcatatgtaagttttcagaaggatctccctaatttaaagtgaggcataataatgttattaaatataataacattattaaatataataacactatcttctacttaccacagaatcagagaaagaataattaactgttataggaattattttccatatgcttttgttccaattatattcagacatacatatatagttttactttagaaatcattttttacgcgtagtttaaaagttggtcttccagtccttgttcaggagaaattacttacagaggcaaaattgttctgatgcaacatcatacaaagggcagtacttttgtcttctgttttattttgagagaaaggaaagaaaaggcagaaatttgcctgagagccattaaaatagacatcatgttatcaggtattttttccccataaggcttttactaagtactatttcttggaggtcagcacagcttaaacatggaataaaaatagttggactaataaatgttttcttctgtctcgttttctggaaatatagggcaaaatctcaggtggaggggtacagggaactcttggggagaaaaaaagaaaaggtcacacaaagtagaagaacagtgtcattaacccactgtcctcaaaactacttctcactcaatctgtcttcagaattgccaagagttaccaggcatctcctgatctgcggctgacctggctccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccaggtagggtgtgtgcagcttttcccttagagcagtggttctcaactggggcgattttgtcccccagccccagggacatttggcaatgtctagatacatttttggttatcacaactgggatgggtgagtaggtgctactggcatctgactggtagaagccaggatgctgtgaaacattctgcaataggagagctcccctgacaaagaattgtctggccccaaatgtctgtagtgctaaggttgaaaaattccaagttcatacattacatttgcttcttctaattgctttcccatcgtcgttgggttttttttaaattactgtttacaataatggcacctagccattattaatagcactttaggagacatttgcaaacactttcacatgcatggcttcatttgaacctccccgtaaagctgtgaggcaggtaggtagggaaggcggttattattcccacttcgcggatgagagaactgagagagcaagttttctaaggtcacttaaactctttttcaaagacttgtagttgacacagtatactgacattgtgaaagtttggaaaacattggataaatgattttcctcctggcccattcatttgattccactcttcaactttataggggcccactctccaatccaaaaatcaagaaagaatcaaattgacctgagaagggagacaaaaggctgaatcagtaccttcttaggataagctgaaaattacccacatttggcaaagggaaattgtctgccagacctaaaagctggctcggatggggatgctcagtggccacttaaagtgttcttactgaatagtttaatagtctttagagagagagaaaataaaaaagcacaatgttgggtactttttttgtaagagacatagtttgtagagatgaccatccctgaaaccatgaacaatatagctacagtaatagagtgtttttcaagccagactcacgaagtcatttacaagggtttgtattattcttgtttgaatttacatggctgattttatgaaaagctttgttcttgttattgttcttcaacacaattttgtgatgttgtatgaaccagaaagaaagaacaattcaaagtagcttccccaggcttagagaataagtcactgaaactatgctggtgcagccaagagcttctggttttccagaacacagcaaagctgggtattgcctcctatgaataactcctcctttcttatggtcctcaagaacaaaaatagtcattctgtgatttcatgcttggcaaatgaattttcttcttaattcagaaatgtttgttataaaagctgataattaaatctcatccaaaagcataaaaataacacctgatttcaaatcacatagaagtgtacaagaaagttataaaagttattttagatgtatttgcttcttttctcaaatttattttgaccatgtgatactatcaaaaataaatattatagtactactctttcaattcccaggaaattgtaaggtttagcacttcatattgtttcatttactaaattattttatacttcttttattccttttcccatgactatattttattttatatttatcacttaaatatcaattgcatttcattattgacttttatatttagtaagccttactgttctaattttacctagaattcagttgatttgctaataatgacatgccaaagtgaatcattattacacaatcaacagaaatattccacattattccgacatgggggcatacagctctatctgttcacatatatttatccattgattccttcttttagagaatatttattgaatacttattctgtcctcatgaacgttacattctaaccagagagacgtaatataactaattattccaatctttgttcagttataattatgagaaatactgttataaagaggcacaagatattgtgagcatttatggtccaggccctgtgggtcagggaagggtgaagaaggtgaaaaggaaggcagaagaaactgaagtgtgagggcttcttgatgtagaggaggcaatgagttaggtgttgtcagctacagaagagaagccaaattatattaatgtgtatgagtgaattcttacttctctcaaatgggacataccaaatcaatttggaaatgtagctggcaagtgaaaggacacccaacccagactgacagaaggtaaaaatggaatttatcagcccgtctgaggaatgtgagcctggagtagcacctgccatactggacctaggggcccaaacaatgtcagcagagctcactgtcatcaccacttcccatctctgccatctgttgtgtcagcttcattcttcacaggcttcccacaccacagtttaggtttacatctctaggttcaagtctaggagagaagagagatgcctcctttctagcagttgcagagaaagcctcagtgcatcttactgatcctgtctgaacatctgatcctgtgctcatccctgaaccagccatactggccagagaaatggagtgctctgatttactgaccccgggtcatgggtccacacctggaattatgggtgatttcttcccctaaatcaggatgccttactttatagaaggaggaaagaattctagacagcattaacaacagatgtccagtgttgattttgcaaatgctctgtgctttaattttcaaccttgttctgctccaatgaaatagagcttttggaaaagatttataaactagagataaataaatatgtgcaaggaaaataactttgaggtcactgaattccaggaaactgagatcactgaaattctgtgtcccagagtgcaatatttatttcacaactgtagatacggacacattcttagatactgctgttacttgtacctccctgatcctgaagccaagaaagtctgcagaatccttttcctctgactacagctaatgaggctacatagcttcaaatctgttcctctaatgtggaaaattgcatacattctaatagtattagtatcttgggttattaaatgctttcaactgaatttcttggatcttctgttgtcacagaaacatcataatacatagggcaggtttggaagaaagactggccacaaaggctttgagagcctcctcctatattcctaaaactacgttacagtattgcatgtgaagagatagggctatctatgacaactatgtcctgactgattgctaaggttgattcacatgatcttgctaaccaggccagaaggcagacagcttttagttcacaagccaactctgatcagttagtagtggctgactggagaactatgcttaagaatttcgagactatgtccaagctctggggaaaaagtgctacagttgattagttatgcctgccatgattacagcaataggaaggagtggcatgtgtgccacctgtttgtaatccctaaactgggaaggtttcccatttcttctgtttttcatatgcatttcttccatagctgtgagctaggaagaaaatgattcttgacctgtcacatattcactgccagggccagtgctagggtgaagaggcactcaccctcagggtcgagcgggtacaagatcagtacttccatggccctaaaagcgagtacctctctaaattttgtcttgggtttctcatttggttcaccccaaccatggtctctgcatgctctgctagaggctctaaacgcaatagtttatgtaaaggaaacaaatgcatggaaacaaaatgttcaggaagaacaaaaacacacacacagtaactgctgcaatgccatgaaaacttccttaatgaagacagcctcgcttgctgttgtcgtatgtcatggctgtttatctgagtcaactccagagtagcaacatacttcagaaaaacaccactgtaagtcagaggtccactcggtgaaacagggagcctagttaatgttaattgggtctttgccttttgaaaaccaggacaccagccctatgtcccttagggttgtttcactaaagtaactcagctgttgtgacattgaggtaagtgtcctttatacaaaatctcctaatggttaaaaagaaaaacgtgaggtttgaagaccagttgctcagtgcgcctcttctaaatgaatggcagacagatactctcggggtagaattacagacctagtttagtcacggtcttggtaaggatctgcacaccagcttcctcgtttccccattcggggttcctgtggtctcttactagtctggtcgccctgttctccaggcttatactgtggtctctttcagaatatttcttccaatgtgctggaggagtctgtggtctctgaggacaccctgtcacctgacgaggatggggtgtgcgcaggccagtacttcaccgagagtggcctggtaggcctcctggagcaggccgcggagctcttcagcacggtcagtgcccagagggcatcccggggcctggcctcccatactccagctggacttggggtgctgggaacacctggtcttaatggcccagtcagccccacttcccgaggacacgtgccagggtgtgcggggcaggggatgggcccggggaggactttgatgtatgcaaattgcatgagcttcccaagggagctgagataacctttcatcacagtgccgatctgagcttcactgtatgctcattggttgggcagcagtttcacagtattatttctatttaataggggtggaactaagccacagagaggtgaaatggcctgcccagggttacacaataaatgatgaggcatgttttcactccctcgtttttcctctcagagagaaaaaaattagggaggaaccactgggaggagagaggaggaatacacagacagtgtcttccctcctagccactgtgcagtctgaaggaccatcacagaccaggaccagcttacagaaatgtgggcacagaaaccactgagactcctctggttaacgtaatctggatctaaacactcctagtatatatactagaaaaatatatagagagatgaagtcattgagattcagggcaaagaggaaacactcttgtctattttcttttctttttttgagacagagtctagctctgtcgcccaggctggaatgcagtggtgcaatcatggctcactgcagcctctacctccagggttcaagcaactctcctgcctcagcctcatgagtagctgggattacaggtgtgcaccaccacactcggccaattttttgtatttttagaggagacaggatttcaccctgttggccaggctggtctcaaactcctggcctcaagtgatctgcccatcttggcctcccaaagtgctggaactacaggtgtgagccaccacgcccaacttgttttcattttaataatctccctcctcctttacattttaagccaagaaagtattcagtactttactatatttagctgacccaattttgttttcatctatactatactcatccttattttccagtttttatttccaagtttcctctctacaattttatttattttaattattgttttaactgtcttctctctattcttgctttccttttcaagattcagaaaatgtctaatatactctcatttttcctcaaactcaacaaaatgaattagaatcctactaactctttggaggcatacatttagcatctggctagaggaggacctctgatgaaatttaaatatactaaaactgcctttctgaattgctgttagtccctgctaccaaacttctctcctgttttttcttttcgttttgttttgtttttgtttttgtttttgaggcagcgtcttgccttgtcacccaggctggagtgcagtgatgcagccttggctcactacagccttgacctcctgggctcagcctcccacctcaaccgcccaagtagctgaggctacaggagcatgctaccacacctggctgattttttaatttttttgcagagatggggtctccctatggtgtctaggatgatctgaacttctgggttcaagtgatcctcctgcctcagcctcccaaagtgctgggattacaggcatgagccactgcactcagccagtatttttttttcccccgaaagctcttctccttacttatcgccatacaggactacttagcgaggtgtctagttcagtttgaaggctaccactgtcccaaaagtgctcagataccccttcttgccctgtgaaatactgtgatacaacaataaattcactctccagcacattgtttggacaatgacctctggttgctcttcttaagtttccagtggattaaattctctctgatgctcttctcctctttccaagggaggcttatatgagacagttaatgaggtctacaagctggtcatccccatcctagaagcgcatcgagaattccggaagctgacactcactcacagcaagctgcagagagccttcgacagcatcgttaacaaggtagccggggagcctggctggcaggtcttgttacctggtggcaggcgaccctgtcctacagatgcttagccatccttcctctccagggagtgatttatctttagcacattgcttttgctctcacctgtcaaacagaaaagggctgaaattcttctaacagaggaccaaaattccatatgtgaaaacatacagcttaaattactttataaccaggaaatgtgagaaatttttaagtgtaattaaaagaagtcccagaaatctttcatgggattccttttgttgttatttctgaagtttattccataagcattaaatttttttaaggagtaatttctgtttacatcagccataggagtaaaatgctttgttaacacaatgagagacccctgccctttgcaactcagtggctcctcaggatgacataactaaggagagctttttatattttgttcctcaggatcataagagaatgtttggaacctacttccgagttggtttctttggatccaaatttggggatttggatgaacaggagtttgtctacaaagagcctgcaattaccaagcttcctgagatctcacatagactagaggtaagaaaagtgattctgtgcgcctgacctggtacactttacaaaaacaagttagagtgggtcatcaccaaaaataaacaaataaagagttatggattcatcattgatctctacataaagttttcccctttgcatttataaaaggcaaagtagaaaggtattaggtgagatcatgaggtgatgtaatattttgatagtttttccctaatactctgtgtatgcttttcacagtttggaattttatatggtgaatatttattttgaagtctgtgcaaaattcaatcaaggtcatgtgctttcttatcaccctttccaaatattagtagtttatactagtagatagagagtagtagagtttttcaacatgaagtttagcatcttgactttgaagtaatctagccaaatgactgaatcacccctagataatggtgaggccatcctttaggtatcactggatggcacctggggtccttctgatgtggagctactcagctgtggccagcccggctccaacctgccagtgagtgacatttggtccataatacaacagaaaagtgtagcatgttgttagaagcaaagctgaaagcatggagaaaaagagaaacagcctagagaaaggtcaggacaaaagaaacacaggttataagggccaaacactaagaactcagtcaaaggtgcctccccgatgggatttggatgaacaggaatttgtttacaaagagcctgcaattaccaagcaggactggggtcctttgaactgctcacaattaaccaaagattcactccttaggctttcattgctttgaatttgtgccctcctatgagtgtaaaacttaaaacatttgtgttgcctaatggcttcgtacactctccatccatgccaaaaaagacaagagggtttatccttacttgactcaaagaagccattgcccagggtggctgggtgagttgccccaaaattgtttagcacatgagaaaaagagctagcaattgaccccagtccacttggttccctatattgtttcccctacttagaattagaggtatatattttatcttcttgtgcactgtgatttgccacaatatgggaaggctggtgacttccaagttcccagggtacagaaggcgagaagtaaagagtgtgataccccaggagatacctcagcaaatataatgatgttagctgaattagaggccaagcatacatcttatagggaagcatataccagttgacagtgctatttttatttttgtcttaggaaatgctgaactttgctcattagctcagaggaactctcaataatcagtgaacatcattctaccttgcacttgctccaaacttatttcacttccaagaagacaaagagttgcattatgttaaaataacctttataaactgttggttcttcttacctaggcattttatggtcaatgttttggtgcagaatttgtggaagtgattaaagactccactcctgtggacaaaaccaagttggatcctaacaaggtatacaaaaatttacaaaaactaaccatcaagctctaaatcccttcgttctctacccaagaatacctaatgatctcatctatctggactctccaagtcacttaaatgcagtcaaaccttttcgtctagagttcaactactaattggtcagatcttaaagaaaatatagtcaaaggcaggaatcataataggagctaccacttattaagcaccaactgtgtacctggaactgcattaggccctctacatacatcattttatttcatcctgcaacgacccctggaagtagattttgtcattcctattttagagatgagaaaactgagacatggaagagtcaagcaagtttcaaggtcatgcaagcagcagagccagtactcagacttgaggtctgttgcttctgaacccctactcttcagcactgctctttactgcctttttataaaacctttaaactctccatttcaaactcgacaacacttagtggcttccttctttaggctgcaagtattccttccatccaagtccgggatcactgtgctgttgggggaatggtaaaaacggcttgggtttgggtttcctcactttcacaagagggtatgttccatttcaccccaaaatgggtgtacagttctgatgctaacacgtggaggtggtatcagctcccacagggtaaaggctcagtcctcctcaagactgccctgacttcagatgccagcttcaagagggacccccaggccagccacgcttctgatcagccagctacaaatttgggagtttctataacctgttagcttgaaaataggagaaaacaaagcaaataataataataataataataataataatttgggagtttctatgatacctgttagattaaataattcactacaatgactcacagaattccaaaaagtactctggttactatcagagtattatgataaagggtgaacatctttttgtgcctttatttatggcttcctggctcatcagtgtgttctccaaccaggaagctccgccaagtctcagtgtccagagattttgttggggtttcattatgtaggcaaattgaatacagtctccagcccctctcctgtctccagaggtcatccagttcctaccctgtaatcacagaattggtctttttggtggccacttggcatcctgaagctatccaggggcccagcatgagtcacctcattagcatcacaaagacacccatcactgaggaaattctaagtgtttctaaagctctgtgctaggaaatggagacaaagaccagacatattctttattataccacaagctgatgctgcccactcagcccaactcacatgtccatgaatgagctttctaagttactggaaatagtgcaagtgcaaggtatcattaagggccctgggacagaggaccattcaccatctagcaaacctataaaatgaaaggtccaaactcccagttccatcttccaggatatgaagaagataatggaagaggggaagaattggccaaattgaagagtttgtttttctacatttttcagaatgctttctcacttaagacacattccctagcctcggcttgaaagcagtggctgtggtaagagtttaactaatcttcagacacacatgtctgggagatggagttggccgtgtgcccacagtgatctgtacatagcacaagctgtgtaaaatgtgacctccctcagccaaggtgcccttttcccctcttttaaaattcccagggtaggttgtgagagtttggaatgagagtctgaacccagagttacaaccagatttcattatactaagtcgtgatttacagtctgaggtcagtgaccccactcatccctttcagtgggtgagtgtcccagcatctgaactcatggtcactttttttcctaagagattgtcgtctttaatgagtacttattcgctctgtgtttgagggtggaggtgatgtgagtgtgtgtttaaatgaggcctaggcagtaaaattcagttttggtgtttagttctatgagttttgacaaacacatgtgactaccttcataaccaagatatagaacagatccaccactccaaaatacttcccgtgcccattggtagtccatgttgcaatagttccttcctttccgttgctgagtagtattctgttgtgtgactacctcaccatttgcttgttaattccccactggagtgacatttgggttgtttctagtctttgttatgaataaagttgctggagacatttgtgtacaggtttttgtatggacataagctttcatttctctcctgtacacacataggagtggggttgctgggtccaatggtagtgcagtttaactgcataagagaccgccagcttcttctgcaaagtagctgtgcattttgcattcccaccctctgtgtatgacagctctagctgatctccatccttgccagcacttgatattgttagttttctttagttcggccattcatgcttcctcataactgtgaggtagtcattgtcattctgtaaaggaaagtttgtctctttggaatagcagtttgcaaactctcataccaaggcttccactgtggatcagtttgctctgctaggaaggtgcggccggtggccctcactctccccacaggcacattcccctctccctccttgcagccccttctgtccttgggggtggagaggaggaacttctgctggccacattctcccctgcatctgtagcttttctgcactgggcagggcggtgccggcacgccgtgttcctgcatgcccctccattgcgtcagggatggccgtttgcagaatagctcatcttctccctccgtgccttttcccccttaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggaggtaatgcacccaagggattggccaccactggatgagtgggctgggtggcctcccaggaggacccacaaacctctttcacagtggattggactgaaaacaaggagggatgcacttgaaatatgattatatggttgtcctttcactctcatagtgccagaaaatcccatttaggcagctacatattttatagcactattgtatattaaatatttaatattttaaagttatatctttagtataagtgtgtttatgtatttaattataatatttaatatatatttcaattataaacttgtacaacagatatatttaccttttaaatattttatataaaatttttctatatttcaaagcttagaggtgattcaagcatagtcgtgctgttaattattggagacgggacctgcacgtgggcagccccagtgaggcggtggtgtgctgtgggaaagggccgtgtaaggtagacaagttcactgactagcttctagtcctagcttcctcctgtgattttaaacaagctacgtaccttcagtttcttcatctatgcattagcaggaaagacctctaagtacagtacaagattatactcattttattaataaaaggactggtcaagaaggtctctcaaaccacagaattgttcaaaattctacacaccataaacaacttattattctttaaaacacatatatatacacttatttgtcgtcctttttatgcagggccacagacttctctgtgactgtgggtttgctgatcacaattcagcattttcttttataaaccacacccgtagtgctttgtccatgattttcagttttgctttgtgtaagcagagtgagagcttaaagatccttgttaaacaatttgagagcagaagccttctggatgtttatgatgtttttctccccgagactttgacagcagtcttgtgcacacctaatatgacaggaatttttatagcaactcactttcataatatcttgtccaaccatttggcttggttttcatagaaagaaatctttttctttccacacccatggttcatcagtttctccattatctaattagattgggtcattaaaataacaagtataacaggcataatcaagttggtgaacaaacacagatgaattgtggtgaatatatacctcatcaggcagaagcagaaatagctgagctaactggagagtcatccagcaggtagtgttcagctgggtaaccacatcagggtgtggctttcacagaagctgaagaaagcctgaagcagtgactcagtcgggaggaggtgggtttagaagccatctgctgtacttcctatacttcttggtttggacttttgaacactgagacattctaggcataacacagatataaactcatggtgcccaaaagcatttcaaaaccttttcttttcttcattcctgccttcctttcctttccttcctttcctttcgttcttcctttttttctgtgtctctgtctctctttctctctttttcatttttgagacaggatcttcctctgttgccctagagtgcagtggcatgaacatggctcactgcagcctcgacctcctgggctcgagcaattttcctacctcagcctcctgtgtagctgggactacaggcttgtgccaccatgcccagctaattaaaaatacagagagatatatattttgtaagagacaggggtcttactttgttgcccagtctggtctcaaactgttggcctcaaacgatcctcctacctcagcctcccaaggtgctgggattacaagtgtgagccactgcaccagcctgaagttttcttggccttccttcgttccccaacaacctcaacaacagttctcagctgtttgctagggctgtagaacaaagttccatagactgggtggcttaaacaactgaaatttactgtctgcacaattctagaggctagaagtttgaaatcaaggtgccagcactgttggtgccttctgagggctgtgaggaaagggtctgttccaggcctctctccctgacctgtggacagccctcttctccctgtgtctcttcacatcatcttccctctgtgttcgtgtccagatttcctcttctcgtaaggacaccagtcatattggactagggcttaccctgctggcctcattttaacttgattgcctctgtaaagaccctatctccaaagaaggtcacattctgaggtactgaaggttaggacttcgacatatacattttgggggaacacaattcaacctataaaattcagaaaagactctaccccaaaccagcagaacttagcaaatagattgattgacccttaaaagaattccatttactggaaattcaccctcagttggagaaggcacaggtgatatcaaaagcctgtgttatgatgggggagaaaatcttgagtgctgtgcttctactacagctttctgcattgtaagttgagtaacatgaggctgtgtgcggtggctcttgcctgtaatcccagcactttgggaggccgaggcagggggattgcctaaggttgggagtttgagaccagcctggccaacatagagaaaccgcatctctactaaaaatacaaaattatctgggtgtggtggtgcatgcctgtaatcccagctacttgggaggctgaggcaggagaattgcttgaacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacctcctcccttactacctgtggcattctgtggaacttaaccttacaaatccccctttgactgtaaaatggagagtataaagaggttgttgagaggaataaatgctaaatgtatgtaaagttcctggaacataaggaatcaagaaatgttaggcccatctttctttttaacctgttaagagtattttaaattactctgaaagtctttccctagctgcctcttcaaattcaggtggcctctctgtcatagctccaggcttgtccatagcttatgagaccagacagtgacttccctatgtttacgtctcatgttcagtttgttttgacaccgattgaagttgccattgaagacatgaagaagaagaccctgcagttagcagttgccattaaccaggagccgcctgatgcaaagatgcttcagatggtgctgcaaggctctgtgggagctactgtaaatcaggtaagcaaaaccagaggtggcagctcctctggttcttattatttaggttgtcattatacgtctgcacccttcttccttggggttgatgaggactttgatccatagacaaacacagaaatgttcctacacttaacctgaacacctgtaaggtttagaagacttttaggaaacctcttccctttcatgtaacaaccccaggtaaaaaagaaatcctagagatgagtggaccaggctttaaggagtaccactttctcagaggagtctccacttcggggccagacctgacaatatgatgcaaatctggagtcatgttgaagaatgcttagtcatgaccaattcacgcagagtaattgcagggcttgagactcacctacaaatgcctataggagagaaggaaaaggatctagaacatccaactcttggctcagtcagcagatgaacccagcatgccaaggaccttgacaaccaggaatgacctgggacctgacttcttaggctacttcagacaagactagatcttcctatcagacttcttagaacgctgactcccaagttcagcatggtgctcaagcagtctcagatgaagggaggtaccagcctaatacctctgtccagtgggcctccttaattcaaatctagatctgttcttgtccacacttccacggcagttattcagtgagcatcatgagtcttttctcattcagcgtaattggatttccccacaaaagttctgagtgtacttgacatcaagggagcagaaacagagaagagaaatgcctattacattcccaagatcaggaaaaaaaaatgaggaaacgtttgcctttgtaagtgccaatcctttgataaaatggaagactttccaagcccacaaccatggtctatctgtacacgatggatatctctgactcaatccagcagttatgcaaaatgatgtttgccatgaaggcaactagataagtgaacaaaaatgaatagatcaaggcaatcctgatttttagaaaagcaactcaaagcacataccatttgatgtagttgtattacacttatatatgaatgaaaatctattattagtagtatttgattgataaaataatattcggcgccaggctcagtggctcatgcctataatcccagcactgtgggaggccgaggtgggtgaatcacttgaggtcaggagtttcagaccagcctggccaacatggtgaaaccccatctctgctaaaaatacaaaaattagccagtgtggtggcaggcgcttgtagtcccagtacttgggaggctgaggcaggagaatcccttgaacccgggaggtggaggttgtagtgagctgagattatgccactgcgctccagcctgagtgacagagtaagactctgtctcaaaaacaacaataaaaaagaaaataaatttgggctgtgtatggtgcgcacgcctgtaatcccagcaatttgggaggctgaggtgggtggatcccttgaggccaggagttcaagaccagcctgggcaatgtggcaaaatcccatcactacaaaaaaatacaaaaatagccaggtatagtggcacacacctgtagtctcagctacttgggaggctgacatgggaggatcacttgagcctgggaagtggaggctgcagtgagcagagatcatgccactgctctctagcctgggtgatagagcgagaccctgtctaaaaaacaaaaacaaaacacacacacacagggaaaatacatttatacttctgagtgttcctctaaaacttcagattcctcctaagaaatcaaaatttcctgagatgtccaagaccttccttatttttttttgtttatttcaaaccaactacaaaattaaatgttcaaactaagaagtcactccaatattttctcccaagcaatttaatttccttcatatatgtatgaatatattcatatatatgtgtgtgtatatatatatacatatatatgcatatacatatacatatgcatatacatatatatgtatgtgtatatatatatgtgtgtgtgtgtatatatatatatatatatatatttttttttttttttttttttttttcccaccagggaccactggaagtagcccaagtgtttttggctgaaattcctgctgatccaaaactctatcgacatcacaacaagttgaggttatgctttaaggaattcatcatgaggtaagaaggaaaatggctgggaatttcagtagagcagtggttctcaaagtgcaatcttagaccagcagcttcagcatcacctgagaacttgctagaaagacaaagtctcaggcaccctccagacctgctgaattggaatctctggaggtgtggctcagcaatgtgcagtttaacccgccctccaggtgatcctgatgcacactgaagtttgaggaccactgcagcagagcaacactacttgaactactaatgagtaactaacacgtcaactatgaaacgcttttgtggctagcatcccgtgtgcctcacaatcacttgttgtaaaacaagtatcatcatcttcctcattttacaaaagaggaatcagaggttcagagagaggagataattttacttaaggtcacacagacagttggcagcagagatgagctcaaaccaggtcttctgaatccaaatagtccacatgtccatcaatgtgctgatattccactgatgcactagagtcccagaggttctttgcattggcagtcattgtaatgttacaaatcttataatatcttatttttagaaacttaaaaacatacactgcctcaaattgagagaggcaagttctaaaaccaggcttttcaaaggtattatcctgtgacagttccccatgtcagacaagtctcatctctgttccttaattctgcagtggagctggcttcaagagcagtcagttaggaactgggtctttggtcaaagccttgtaatttattgcaatacagacagatatattgggtctcctatggtcctaaaaatatgagtatgaaggatgtgatggcatttcacctataagagaaaaggacttcagaaaaatgtgtagcaatatttctttctattcaaaaccttagagaagaatattaagtataagaatatcttcacttggcagatggggataaaggagactaaaagtttgctaaattcagtgaaaactcatcaaaatgctagcatttgtgaggttagagatatctcctccttcacaggcttttgcgagaggtccgcaattttgctgcatatacaggagacacactgtgccctgcagtgaatcacagccgcttggtaataggatgtttgtgtggctttgcgtgtttgtatttgtgcatgtgtgtgaacatactcacagattatcttgattaatgttttgatatttgaattgtttcctgtatttgacaacaattctgacagaaaaactagttgttgttgttgttttttcagtacataatacgtatcttttaaaaggctagaaaaatatttggggaattattttattattttattttattttgagacaaggtctcactctgttgcccaggctggagtacagtggcataatctcagctcactgcaacctccacttcccaggctcaagagattctcctccctgagcctcccaagtagctgggactacagacgtgtgccaccacatctggctaatttttgtatttttggtagaaatggggtttcaccatgttggccaggctgatcttgaactcctgacctcaaatgatccacctgccttggtctcccaaagtgctgggattacaggcatataccaccgtgcccggccctattttttattttttgtggagacagggtctcactatgccgtctaggctggtcttgaattcctgggctcagagattgggggcttaaaaaaattttttttcatatatttttatttaaaattcattatggttgaatgcttccaaagttgactatgccccaggacctctaaaaggacctatgaaatgtttgaagagcactcactatattccaggcatgatattagttatgggactacagagatctggcttgttcctctgttcttaatgacaggacatagccctgcatggctgaataatagaatgcagcatatgcacagaactttaagaatgactaactacaggactataaagatcagaaaagagaaatcagtttcaggctggagcatttgtgggaggcgttatggaaaaacaccacttaaatcttgtcttgactatatacgtggaagaaaggcgctagtggggaagagggagccaggacagtggccctgcctgatccaaggtatcactttcagctgctttagttacccatggtttgaaagtattacttacaatatgatattcagagagagagagagagaccacattcacataacttttatttcagtatattgctgtaattgttgttaatctcttactctatctaatttgtaaattaagctttatcataggtatgtatgtataggaaaaaaacataatatatgtagggttcggtaccatccgcagtttcaggcatcccctgggggtcttggaacctatccccgagaatgaggaggactgagtaccactgagtggaccagcaggaccacgagactctgtcaggaatgcctgtgatgcaccgggttcctctaagtccagctggagcagcgtgttctcatgagcatgctaggacaaggaggaaagattggaaatatgataatatcagtaaatgaggctctgaatacaatttaaatgtttaagaaaacttgtcaggagagtgattttcatttacttcagtttgcctcaattttttctactagttataaatcttgcaatccagtatctcacgggtatgatcctttccatgacaccacctaggtaaaatgtacttacaaaatccctactaaacatgcgtttctcattagctcccagccccaggaaaagttactccaaaaagaaccagtgcccagtaaaactagtcccaggcaagagatacaagaggaaatggactttcctaggggtcgctcctttaacaaagtcattagagtttcaataatgaggctatcattctccccagatggcctacagaaatgttggattttcaaaatcaaattcaccattttaaagttgttctcctacccttttaatggtgattccacatgggaaccagtcccacctttctccccactggctgggctgctgcattgttctaggaggccaggagactgtccatgcttcccagacttcactgttcttacacgtcacctgaggatttgtcaaaatgcagattttggcctgatgcagtggctccgcctctaatcccagcactttgggaggctgaggtggaaggactgcttgagcccaggagttcaggaccagcctgggcaacatggcgaaactctgtctctttaaaaaaatacaaaaaaatacaaaaatttagccaagcgtggtagtggtgtgtgcctgtagtcccagctactcgagaggctgaggtgcgaggatagcttgagcccgaggaggtcaaggctgcaatgagccatgatcgtgccactgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaataataaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctcctactttgtgccaggcactgtgctacatatgtggaaggatgaagtcccaatatcagtaggacaaggctacagacaaaacagtactgctgctcattattcatctctatgtgcaaacacaacagatggcctgccctccacttcattctacagagatcagaagtcgtgggtgagagtgtgctgatggtgcacaactgtgtaaattactaaaactcatcaaactctaaacataaaatgggtgaatgttacggtatgtaaatcataccctgaatacagatagtagatgaggttcctctgttgcttaattgcttctcaagtccaatctggaagttacagcttttaatgaatagagtaactattttttcacgttgtttgtgctgtgtattttctcctccactctgctaacagacagcagaggtgacgcagaagtggaaaatatttggggcttgaacagctctcaggtttcccctttagtaagctccagcttctcagcagacttgggctgtagatcgataagcccagatttccaaggtgaccataaatgagtctctgttgctgagagctaatagcggaaacatttgcttgccaggtccactgcgtctagtgccaccacggggcagcgacctttctgactcagctgtagtggaagcagaaacagccataaagaatcctggcagcctgatttgctgcagccagtactcatccagccagtcctgcaactcttcaaactgttaccaagctgggacctcaatcagcttctgtcttttcctgcaataataaaaaacatctcgggttcagaagccaagacaagaagatagagagatacaatcttctatcttcctcttctgctcccccaaacaccccgaccatttagatttttaaattttcttctttatacttatctggactttctcattcttataaagactaagtgatgttaaatttgtttttaatttaaataaaagatagtagtactcactggcaccagttacagcttgcctttaagagaagtagtttcagatacaccctgaaagggttctgcagcatatatgtggtcataggctcagaaaacaggctgttgagtggtggcgtttttaaactggagttggggtctatgaagaggaaggagaaggaatttgtccgagtagccaaaggacaaccaaatgtgtagagtgtaggtggaaaaagaagcagtagttttaacttgagaccaaggccatatgcctggcttatagctggaaatggggaaatggctttcctaggcagtatatgtggcgttggggttgggaatatgggcactcaagccagattgcctgagttcagatcccattctgcctcaactagatgtgtgaccctgagaagttacctaccctcggtttccccagatgtaaaatcggaataataattgtacctctcccttgcagttagtgacagaataaaatgagttaatacatggaacttagaataagacttcatacatactaagggatcagtaagtgtaacattgttcagtggggcaaataggggactgatggatttgagtgggaaatagagaattaatctgacttaaatacggagattgtctatccatgatttgtctgtctctataaagtttgaatcataagacacagtgatgctgatgagacattggcctgggagcagcaggattctgggtttatatccagctgtgctgtcccacaggtatgtgactggacagggcacttcacctctttgcatgttagtttcatcaactatgaaataaagagactagaatacagcatctctaatagtttatcattctcatattgtacaaatagttcatttacttagcctgggtctgtcaggcataataacgctaccatgtgctctggcttcagctgtgtgcagggactcttctgaacatttgatatgtttcaactaatttaatctttacattaatttatgaggtaggctcttatcacccacacatcacagatgaagaaactatgacatgaagaggttaagtagcttgtttaaggttgcaaagccagtaagcagcaaagcgggattcagagttgagcactctggctccagagtccatcctcttaattgccatgctgagctgttccctctagtgactatattcagttgctagtaacagaaggaagagtagcttaaataagaaatttatttttctctcacattaaataagattggaggtagtcgatgtagagctgtgtagtggcctcataaagtcatcagagaccctggttcttttccaatcctttgccatgccatcctggttctagtgtacccattctcgtggtcatgatatggttgctagggctccagccatcatgaccacatctaggcaagtcaggagtagaaatgaggaaacagcaaaaagatgtgcccatttcccagtgccttcacctatattatcagcgatccctacctgcatgggaggctaggaagtgtaagttttcaggtggtcacactgcctggagttctgccagtagggaagaaagaatggatattgagaaaacaactaacgaatgtttgtctgccacactgaggaacccatgtatgggctgtgctgaaaaaggggggccaaggctgggtacagtggctacgcctgtaatcccagtactttgggaggctgaggtgggcggatcacttgagctcacaagttcgagaccagcctgggcaacatggcaaaacctcgtctttacaaaaaatacaaaaaaaattaaccgggtgtagtggcgtgcctgtagttccaactgctcgggaagctgaggtgggaggatcacttgagcccaggaggcagaggttgcagtgagctgagatcatgccactgccttccaccctgcatgacagaatgagatcctctctctaaaaatagagggggtaccaagagatgcagggggggtgagggcagcatgactactctctctgtaggagaccttaactctataaatggaggccccaaaatgttactgccatcaaaagccaggaatccttttctggaggcgtaacttcctgccctttctaatccctatcaatctggtttctgtagaactgtgactgctagaaaaccccaggcatatttgttctaagaaaatacttgtgttcggtgaatttaccaacaaagggagcatcagaggatgtgagggaagtctggaatggttgtatcactaagtgagagcagcacagatgtttgtggacctattgagaatgttacagataagaccatttttgaaaagttgtttgcagtgtcattttatgatcttgtgtacattttccaagcgatgtggctattctctaggagggatagtagaaattatttcaattttaatcaaataacctagagaatataacccaaatgactgaaaggaagaaatgtagaaaaagtatataaaataattttttgcattataaaagtttaaagacataaagtaatattactacataaaatctaagttttttactccagctattaatatgtttttctttataaaacatcacatttattaattgctgtgtaacaaactacctcacaatttagtggcttaaaagaaaatttaattattatgcatgtggtacataataatttttgctttcctcatttctactcctgatacttgcctatgatgtggtcatgatggctggggccctagcgaggtgtattgtggccatgagaatggttttgctgcaacttggggttggctgggctcagctaagcagtttttgcctggagtctctcagttgcactgagacagtgactaggacttgaattacctgaatgcttcctcactcatgtctggtgtctgggctgagaatactcaaacagcaggggctcctcctctctctaactctccttctctccacatggtctctcctgcatgacagctttagggtaactagacttgtcacaggatggttcagaactcttatagtacagaacgagagagagacagaggccatattaccttttattagccagtcacacagtaccacctccaccacatcctattcagtgtggctgtcacaaagaaccatccacctcttgatgggggcatgggcaaggttctaggagagcacattcttgtggccattttcagaaatacaatctgctacactccagaagcatctgtttgccttattatcatagcttctgatttaattctcccagcaaccctaggagattatatgagcttattatccccattttccagagaaaattgaagatttttatggttaagtcatcctgctaatgagtagcagcttgtttcaaccgcagttgtctgcatataacacatttaactcagtcaagggcacatggtgagcaatcagaaggtgttagctagctgctgctacttctgcaaacaaagactaaggagagtttagctgattttaccaaagttgtccgagtagacttccccaaattagctgttagctttggcaggactcatcccacctcctgtagcctgccaatgttataaacttgggccttgaagtcatcctgaaactgatcttattttacacatggtggtaattgtaactgttagttaagaagcaataaaaaaataataaggggtgatatagatttctcaggattcaaaggccatatgccttcccttctatttcttccctaaaaccgttaattcataaccttagctatcctataatttgcttcaattaatgacaaacataaaagataggtgaaaatccagttaagggagttctttcagattctgtgtgagttaaatcaagtccttcttctatagcaggctaattccatgatgaagctgtggtgctaagtttatttttgcctaggcaggtagctcttccttgccacatgctatcctcttcctctttgactgtcatcctgaaaatgtgttcagtgttaagaggatttgataacaatgtctgggtatctccataacttagtccaaatctggtaccactgttaggaaaataatgtaagccatattgatcacccacgtcttattcatttgaaggataatatagttattactaattattgcgtgttaggtaacatacagccattattctgtccctttaaggtttattgatttgtaagttcccttgggtagaagagtacaaaacaaaaggcaaaacttcatcatgtttaaataacgtgattttcttctttggtgtgtaccgtaccgtgcaggagacagggaaaacaccaggtttaacggtccacaagccagataaccatgatgagttctaaagattttctctgtctttaatgttcttcagttttgtcatgagaagactggatatagctctgttgttgttcattagaggatttatatctctcttcaactctagaaaattaccagctgttatctctttaaatattgtctccctctcattttccattcccttggagattctattagatgtgggttggatcttccttatatctctatgtttcttaaccaattttttcatatttttttattttttaaatctcattggtgatttccttggatctgtcatacatttacttctccaattatgtctagtctattatttaacctttaacctttccattgagttttttgtcttttagcaactgcatttttttttttttttttttttttttttttggtgagacaaggtctggttctgtcacccaggctggagtgcagtggcatgatcttggctcactgcaacctccacctcccaggctcaagccatcttcccacctcagcttcccaaatagctgggactgcagtcacctgccaccatacccagctaatttttatattttttgtagagatggggttttgccatgttgcccagtctagtctttaacttgtgagctcaggcaatccacccaccttagcttcccaaagtgctgggattacaggcatgaggcaccacacccagcctagtgactgcatttttcttttttctagaagttctgtttggtccttttctgaacttttcctggtctcttttttcattttccctgtttatttgtttttatcatggattttataccttttatttattttctttttttttttctagttacatgattacttaggattttatacattttattacctctctatattaactttggttttttacattgttttattatctctaattcttattggactaattcttttgtttgatgcatctgttagttttccctcgtggtggttggtttcttcatatggtttgtaattttttattgtgagctcatctttggcgagagtggctcatatgccctgattgagaatgtgttcctccagaacaactttatgttggtttggctgaatcctagcaatttcagtaatcttggactggcttttaagttattttctcaccttgaagcacatacagtcaaggaatgtacatttgtaacttatactatgtgtggtgcaagcctagaatttccatttctcaatatgactttcttttccataaatggccctaagctgatagcaagttttcattctgcctctctggacatcttgcagcatttttctaaaccctctttcatagatgggatagcttttcaaggctctggacgatatgcaggtggcatatccagaatctccctttgccctggccaaggccacatcactaatcttgtgtgagctttgaagccccttcccctcagcccatagacctatacacagtcctaaaatcttaatgggcagtcctactgacagctgccttgtcaccagctcctgtgatcattctagctttgatttttctctttctttctggcacctggtgttcccctttctctttcaacaagtttttgctgtgctttcctagcacttccatatgtacgtagcaggaggaggctgaatgccatctgctctgtctgccatgttgctgtaaatcacagtgagttttttgtaagtgtaacagcttccattctgcagtgtgttttgagtctgactcttagatccatcacttcctcacagtgttatcttgggcaagcatcctaacatttctgagtttcagaaacaaaatagagataaatgctgactttttagggttgttgggaaaattaaacagataatgcatgtaaaacttcttgaaacttcttctggcacatagcaagtcagaggttctcaattctggctaggttggcttcagtatcccctgggcaactttttaacattagacatttctgggccagaagcaatggcccacacttgtagtcccagctacccaggaggctgaggtaggaggatcactggggcccaggaggtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgatcccgatatgccacccagtttgaaaacgttcttaaagttattcgaaaaatcgtaagtaatttcattgttctcagatttctaagcacttcaaagtcatttatttctcccacactgatattttcatctcagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagaggtaagaacagggcagaggaggcctcttcctgtgggataaagagcagcgcatggggcctagcaccttggggcatgctctgctgcacttggggagctgcagaacctcgaaagggtggaagagggtcccacagtcagagaggctaccagagtgtgattcattctgcctctgtcctccccatccctgctccttgacctctcccagacaccttggtgttggtcttgtgccagggtattcccagggctgaatgatggcctgtgttggtttttttgtttgtttggttggtttgtatgtttgttttggcacagtgtgaaggggtcgcagacctttcacttattatttgctgagttgtccatgactgatgtccatttctactgggtgatccacccccaaccctttctaaaaggctaactgatcttttcttgcttctgtacgctctctttccctctcctccctctcttttcttaatttcagggactccttccacagatctagtttcaggaaatgtgaaacccagttgtcacagggcagctaagaaaagccatcttcattcgtggagactgtggccctgcaaccctggagaaggacttgctggtacttaaaaaatgggacatttgccacccaggactgactgtacactccctgatcagccagcactctggaagctttgggatcccaggaaccatggaattattcccaaatggactctgaccagatttttgccatactggggggtggcgggatggaggatgggtactcaggcatgactgcgtatttattaaagtgtgtttttccacaatgtaccaaacaaggcataagcagcttctcctgctgactggccaatcactgcccatctgagagatgatttcctctggcccatatttgaatttattggagtaactcaaattgcctgaggaaaaatggaaaaattatccaccagtcgattcaaactgaatttcactctttataggaaggcagggcaaacttgtaggagtacgaaacattttcaataaatctacaaagggaagccttactacaattccaaaaatcatcatggttggaaatttgggaggagattatttgtgaacttgttacccttttggtaatggtggactaattgctgtatagttatttttgttttattattactgttacattaatttaacatgcatttatagaagaatacattcaaagcactgatgtaggagatacacggtacttggagcagtcagccagaaatcacagatactgctttcacttaaatggaaacaattctccgataatgctttgctttttttcttatgtcactcttgtgtactatctatttttctcctctctgggaccaagtttctttttataaagcaataatatctctgttttcatttcagaacattgtgctgtctgtcagcatatgtatatcagctacaaaatatattcaactttgacttcttttgacaaaggactttaggaaaaagaggaacaaagacattatttgagaattaaattatatatttttaatatgactgtgaccttgactgataataaagatgtaataagaattgcaagctaaatgtt

SEQ ID NO: 1689 - DNA, 192212 bp, Homo sapiens; identical to SEQ ID NO: 1688
  source 1..192212: mol_type = genomic DNA

SEQ ID NO: 1690 - DNA, 33606 bp, Homo sapiens
  source 1..33606: mol_type = genomic DNA
ttgagacggagtttcgctcttgttgcccaggctggagtgcagtggcaatctcggctcactgcaacctccgcctcctggattcaagcgattctcctgcctcagcctcctgagtagctgggattacagtcattcgccaccatgtccggctaatttcttatatttttagtagagtgggggtttctcatatacattctagtccctaattctgactgcccattttcttaaagtaactgtaaatttaggctgagtcttaagttctaatacagatggtaattcaatttctggcatattcaaggtgctagtctctgtatatcagagttgcagcctaatgcatcagggctagttgtccaaatgcttggagatggcaggtggcaaccacagataaggcaggcctatgtcaaactcaagagtgaatgtttttgctaaagtatttatatttttaaaatgttagtagtaaaccatgttgagcaaacgaaacatatttgtgagcataagtcaacccatggacctcagggctgcaattctttcatggaaatcttctcatgtaatcttcataaaatctctgcccctcaatttgctatgagcttgttctggtccttatctttccaagaaccctagaagttggagtgacctaacaacaaatccacatgggcagaggtccagggactgagctctgaaggatcctgaaagaaaacaatgctgggagcactgctctgaggagtacaaaagtgtaaaagagaaatgaacttaatcacaaaactgaagattgcactgaagaatacttaaaagtcctttttaaaccactcaggtggagagaatgcaattatctggcaccaactatgttctaagaacataattctccccaagattttgaagaacatatttaattcgtacatctacaatgcaaattcatctttcattggcctctataatacccagctttcccaaatgctcttccacagcacaaaaagtaacatcagtttgcaaataaaaggtgcaagaaggtgtacagtacagtcgtgaaaagggcaatatatacatgcatataaaagagaattaacaaacaaaaccttgatttctagagaacatggaagttataccagacaaggagaatgtaggggaatctcatatttatagtacccttacctatacatgacaaagtttacctccataaacaaaaacattagcagatgctgctaacattctgcaagtaataaattcctacttatgcatctgtggatattacactattaaaaggcacatttatttcttgatgcatgtctttgctaatgtcctaaatttgggttccaggtgatctagaaactccagtccctcttcttcctgccgatcgctgcagcaacctactgagccggccagagaacctttgccttcatagttatacgaacaaacgtagtcttcacaatgtttatgctcctcatcttgtccacacaaatacaccttctgtatcaaaaaagagcacattttattattttttaaaaaacacctaaacatattagcagaaaaatgatgtctttgatttaccttttactgtttaatttttaatcagagtgtgtcctctaatggattcctatatataaaaaatgcacaggattggtctgtattatagtcactcttaaaatatagcaaataaataaatgcttctagtgagcacatttaaaaaattaagactacgcatatatcacgcaacacatttataatttcccatttgaacacaaaacatgtatatttgaaatttacctttgtagcttcttcacgtatttgaggaaaaccaatataggctatgattcctatgtttatacactactatataactgtgatagtgtaatatattaaactggctaatatcaaacctatactgattaatctgaacataaaacaaaacaaggaactaaaactcaaaataaaagctcaacaatttatctggttgattttgatagccaggacttcataaccacacaaagaactcaagcacactgagaaatgtttataatttatgatccattcattcctgtataataaatatttcactccagctggttttcctgttaatttctagggaagaggctatgaaccttttatcctttgtaaacacatctacatatggcactcctagataaagttttgtaaactgtattttcaaaggtgaattttcaaagatcatttttatctttgggtttaaaccagacatccacatctatgataatccaacaggtaaaagatgttgaattccaggtatatgaggagtaaaacttttgggaaattctgatttataactagcatttaacttccatgtaatatgacctcaaagacagtggaacttacttcgccaagccgaggttgggtgaaactctgccagtccgtgtacgcatatctgccagtatctccctgccccactcccttgacggactccaaggtctgatgtccacctcctttgttggaatccaaagtgtagcctcctttgaccatctcaaaactttgctgtgttttgattccctggccaccaacagtaccaacagacatgcttgtgtcacaaatgttggatgtctgcatggggagtctaatatttgcttcctaaaagtaaagtgagagtgataaagtgaatttgaaaaatggaaactaacaattcattttcattttttttcaccataggcaaatcacttgcctgctgtgcctctctgttcctcatacataaaatcagaataatagtatcataggtgtgatgggttgaattgagtcccctaaaaattcatatgccctaaccctcagtaactcagaatgtgaacttatttggaaatagggtcattgtagatgtaattagctaagatgaggttatatgggattagagtgggtccctaagcgaatataatcagtatccttataaaaaggggaaatttggacacagacatgcacacatggagaatcgccatatgaagatttgatttccactgccataagccagggaattggcagaagctaggagagagtcctggaacagatccctccccagttccttcagagggagcacggacctgccaacaccttgatctctgatttctagtctccagatctgtgaaacaatacttgtctgttgtttaagtcactcagtttgttgtgacagccctagccctgtagaattgggaggtttaaatgatttaaaacactgagggcacttgaaactctgcttagcatagtaagtgctcaataaacattagtgatattatcattgacattgttgagtaataatctgtcatcatttgttcaccgtacaattcaaagggatgtgaaatctgatttaccgttacttcttctccaggtccttcagtatttgatacaattaaattttgctgggctatgtcttctggaaaacatttcttgactgttctcttagcagtgacacagaaacatgtaaacagaatacctaaaaagcaaaaaagatcaaagtaaaacacagacattaaatcatttgattacatgattttttaaagtcttcttgcatatgtctcaaaaaattcattccacaaattgagctcttcaggtcacaagatttaaaaacagaatattttaaaaatgtatttatactatttgtagcttagagagattaataatagctctcttcccaggtccagaattaacttatatgtgtcttttatttcttctacattgaaatggtaacttcatctaactgatatttaagatagcatcattagtagttaaaatcatacagaacacacttaaagggcttaaaataacaagactaagaacattaggcataaatacaaacaagaaaggcaattacataaaattggtgtctggtttcaaaaatgtacatcaactaataaagtgctaagaggaatatccaatttaatctgaaactcaaatcaatgaattaggatacagtaaagattataggaaaagtttgtaaatgcaaatgggttctttggggtcagagggagagagaaagaaaaagaaaaggaaaagaagagagaaacagaaagaaagaaagagaaaaaggcagtcttaattaagcgtgggcaatatttctattacttttgtacctccaaataacagtttgcacaatgcaaaatcttagcatcctttgcctgtattgcttttcctcagtggctcatatgaccatttttcactcacggaagtcttacgatgatgctaaatcacttcattaataatatggaacagaaatatctgagtaaattttggaatagctctgttttcacaaattctttttgtatgtatgtattccctacataaacatggctggttgaaagactatattattttacatggagggaatcttaatagttttacccagcctcttcattttacacatggaaaaatgagttcaaaaaggaggaaataatttacccaatgtctcacagataattattgaagaactaaggctaccacctctgaaactgactttaaatttaatctgctgttactgatacatttatcactcagagccccaagacataaaatagatacaatatttttaaaagaacacacttcccaaaggctattaatataaaaaacttccatgttttaaaaatactagataaaattttagctaacacattctagataatgatacttaatatacttacataataacaatacagaacccaacaccatagcaagaatagcccatcttccaagtattacatttggtctaacgtctcttgtacttttatccttcattctacactcagatggagttgaacagtcacatactctcactgttaacatatgtgttgcaactaaaccatgcctgtcttttatttgaataggcacagaataatagttataatcaagattttgccgttgacgaagaatggcagttttacctagggaaaaaaaagacagaatatatatggattggctgtttagatggcagtattattcctactcaatattctcagtggaagggaatcaatttagaataaaaactcgaatttttctttttttttttgaatttgtgatttcccagaagagccagaaaagtaattgatgttgctttatgctgatattaaactaatctgtacttaacatgttgctcaaatgttaattaaaaagggacttatatgttttcttaaaagatattcagaacaagagtctaagctcatcacaatggcactaattttttttaaagattaggtattgttgtttttagggttaataaaataatttcctaaaataaatgtgtatttattatgataaactaaggtgaaagaaccatcaccaatctgaagtccgtattgactataaaatttagcatgattacataccatccttttcttctatgttccagtttttactggcagaattatccagaaagaattgaaaaggtggtccattttcaggtccatctggatctacaggtttcagaacagcaaaatcctcattattctgacaaatggtcacttctttgtcaatttgaggtgcgtgatcgttgtaatcatccaaatgaactactaatgttccagtgcaagatcggccaactaagattaattaaaaataggttatttcttcacatgaaaatgcatttattttcaacaatttataaaatacacagttgacatctgctttctactagctgtctgagcttgagttcgcatacatgcttcccagatttcagacaccaagactacaaaatagggacatgtcacttttctttgaagactagggctggatcagataatttcttcagatgcttttcaaaactaaaaggtatgagattatgaggaaggtcactacagaatgacctgttgaaaataaaacagatgtcttacatccttctttatgaagcgcatatattcatccttagaatacaaacactttacatttggttgtcagtcactttctcagcttctccattgcatcatatacttttttcccaaaccttgaaaacttctctagaaatgcactaagtgttccccttcctgtctgctttgtagcattcggttgccactcctaggaatacttttctcctcttctttgccagatagcacactattatcttcaagaatctacttaaatgtcacgtcctcatgaaactcgtgacttccacagacaatggtagccatattccagtgctttctcagaactctttgctaatactttggctcacacactgaactgcaaaagtagcatagtaagttgtattcaccttgagagcctagtgatttgcccagtatttcccagctaactataacttaatactgacacattgaacataatgcagttcctatttttatacttgaaaacatttaattgaataagccagaaaaataagttttcatctctaccctaatgcaattcatatgttcttgacaacaggaactgtctcgtactcatctgttgattgccactattattggcctaagacttcacacatagtatttttagttaaaatagtgcccattatttgtgtttaagagataatgaagttcagaaacatgtcaaatcccaccatttgtaaaaggataataaactacaataaatgataagatatcaaaattgaaataaacagaaaggtaattgatgtaatttttcatgtttttgctttaaatactggtccacattttgaaacatgtatgttgaatttatcataaagactactataactcccatgcaaatataatttatttttctttttaatttgaaataaccctaagtcatatcatgtagtgtatttcaaaagaattttttctgttgaataactacaaaattaatttattcagtgacttttaaactaattgtttgtataaagtaactactatttatgcctattttaaaactacctgaacaaatttaaaaatatccagaaataaaagagagatatagctatttgttgaagaaatttgcaatagcatataaatactttgagactgccagaaaatagcaaataaagttgaatataagtaataactttaaaatcagcaaactaagaaatgaataatatgaaaaagaggccttataaagtaaaaaatttagttgcatacactacacatgagttgatatatatactataatttcaccttttaaaatttaagcagaaagcctttctctttatagaaaaatcgtaagaaaacacactttaaaaatccaaaaaaagtggtaattatagtaacgcaaatcaagatttatttaatcacatattcaaccaacatttatcccataacttactattttctattacagtctctgctttaagcatgttgataaaaacagatgaaagatgcttgaaatgatttaaatggaaggcaatcaaagacaaagctgagaaggtcttagaacaggggtgtccaatcttttggcttccctgggccacactgaaaacagaagaattgtcttgggccacacataaaatacactaacaccaatgatagctgatgagctaaaaaatatatgttgcaaacaaatcttataatgtttcaagaaagtttatgaatttttgttgggccacattcaaagccacgctgggctgcatgctgcctgcaggccacaggttggacaagcttgtcttagaagatatcaaaaattacaagaggttgatggtaagtttttattttacccctgggaagaggtaaacagccaaaaataagtaattactgataatagctgagcatgatgaagtcattggtgtgtttatttacttctaaaatttactttaaattaagcacataagcaaacatcaagtataaatgagtaagaaacaccaatcacagagctagaaagtacatcttgggttaactaaaaatcttcataatacttcaacagcaattctggaaagcagtcgttttttattgctactcaaatgtttcagtaactagaatcactgtattataaatcagcctactctataaattttaaaattaattgttaaaagatttaaatttttaattattaagctacaatatgcctcctaatgatttcctgtaatttgttcatgttctttttggactatacatgcaaaatgtttgccacttgtacatgacaacccttaaatatttgttctcttaagaaaatccttcttacagaagggaaaaataaagaagcacttaataaatgtttaatctcaattttctacattaaaatcagttttcccaagtgctaattatgtccctagaattgtaaagctttttgcagtgaaatgtataacgtggagattcataggactctcaaacaacaaaggaatgacaaatatcagcacctgcactgtgcatatgtataccacattttctgccagatacttggaaagggacgatttacaaagaaaaagggtctttatacaaaattgaactcataattaagcttgttaggagaacagaatatacatgagaaacaatgaaagcagccttttctacagaagccacaccatatatgataattgttatccccagttcaaaaggtatttagagaagaactgaatccagactaatggaaacaatcacaaaccttgtcattgccatttatttgaagaagttaaggggcctgaatttcagacaggaggagcaatgctactctaggtggaaggtatgtaaaacaatgctttctcgactgacagcagggacatcagccagactgacagaggattgacacaagaaagaaagttggattctaagacaggtagaatacctagatcatcatccaggaataatcatgagcatcagagcaaaatgtgtgtgtgtgtgtgtgtgtgtgtgtgtgtgtgtgtgtgtgtggattaaagttcaaagaaacaaaatccatcatatcactatatggtttttcactaaaatgtgtaacatccttatctttacttttttattaaacacacccaggttatctacggccctggaatgtagatttgttaaagtttgctttttattttctacactacattcactgtgcttacagactttgtcttttagcaccaaaaaacaaagttactttttaaatactttgttctccataattttctcctctccagatagcattttatttttaaaaaattaggcctctgcatttctgtaatctcttctctttcatccttaatctgagcaggtcttaactgatcgccacttctgataatattcatacattctttttgaggaaagttctcacatcatagaatctcttgtgaaactataataattctatagttgatatcgtgtaagaatttggccttatcttaacattcttaatttccatgtcagcttgtctaatacttagaacttaatagacaaaccaccagttggggaataaatgagtaaacataaagtcttctttgccaacatagaaaaaagtaggggtataatatctgagaacacattgtttgcattttgttattaaaaaaaaaaacaaagggacaaataaataagcatgaacattttcactactaccaacttatattaattaccatggaatttcatatgtatttattaatacagtcaaccattccttctaaagaaatgcaatagacacaggaaaaaaaaacccatagcattgtatcagctagtttgttttgaacatccagcatatgcatgtaaaaagagtggaaaccttcttggattaggcaggtagtcaaacgaataggctatgttataaaagcccaagttcatttatctttattatttatggcaatttgccaaaatttatggtaaatttgtcatcaatatgataaaatggaagagtgtagcttctacttatatttttatcatcctcttttaatatgttttgtatatttttatgatgtatacattagtataatagtacatgtatataaaaatacatatgatagcaaatatttaaaaacatatttataaatatatatttaaacatactaacaagtggtttactgatagaaatttgtatgttcaaaagaatttccagatcactactttactatatttggaggacattctttacagaattgattctaaaattgaccttggtaaaagattgcaaatcaccataaaagacttaagtcattgtttgaccattgctttataaaataggataaatgatttgttctccattaagagaagctcagaacaaacttactttgaacccaactgttttaggtgtgttgaaccctttcagcaagctcaaatcataatgtatctaaacctgtacttctgaaaaaaaacggtgatccttgagtatgccaccatttcctcagcagaaattaataatatatagatcatctttgaatccttagaccttaattttaattgtgatgtaattacatttaaatttattgtgatataattaagccttaagctttggccattcactacctcatagctttgcattatagatgcactgaagcctaaactgggtgatatccaataacatgaacaataaaaatgcaaacattgcttgaattatgttttgtctagaaataaacagatttcaccacaaggtttccttaaaaacatgtcatatatttatattttatctgtagaaaatggcactcacctgcatccactgcaacaactgaaatattgtattggttgttttttacaaatttggattctctatctagtacttttagagttctcaagtcgccagtgtgttgattaatttcaaaccagttatcttcatcccctaacttctgatacctaatttttagaaatcaaatatgaacggtcaaatcaaagaagggacatgatcttaaaatctgtcattttgaaaaatacataaaacattcataactttaaaaacaatttacatcacaattaaaattaaggagctttttgaaaagtacatcaccttaagccttcaccactggatatttccgggtccagtgctttgtatccaaggagttcttggccagctgggaagccatcttgactctgaataactttcactggagggtggcattcagggccctcatcactgtctataattttaacggtgacagttgtagtgcacattgtaggagtttgtgagctcgctgctttagagaattgtgcctcgttaatgacaccaacttgcaaaataacttggcgattgacttcatagttcaatggctgttaaataagcatactttaataagtcaatatataacattatatataagacttctaatttcaaattttcctacaaaggaatatcatttttacatttaaaatgtaacctaaagttaggtctaatacagttaaagaccaacaattagcttcctaaagtgacaaacattgccaaatgcaaaattgttgattctcagattcaacccatttttcttctcatttttcttttggaagatcttgccttcggcctttttcattataagtttaaatattaatagaaatgcaagataagtgtatgaaaaaattcaaattactttactgcttattatatgggataacagtgacaactaaattgcctccaaactaagtatatacaataattagatagaaatttggctataatacagcagttactctatgcctgactcaaaagatagaatgatatttaacagcaccttttcaaagcacattatatttcaggctgtttagttcctgatgaaagcgcttggtccttgatatggttggctatgtcccacccacatctcaacttgatttgtatctcccagaattcccacctgttgtgggagggacccagggcaaggtaattgaatcttgggggccagtctttcctgtgctattctcgtgatagtgaataagtctcgcaggagctgatagctttatcaggggtttctgcttttgcttctgcctcattcttctcttgctgccaccatgtgagaagtgccttttgcctccctccatgattctgaggcctccctagccatgtgaaactgtaagtccaattaaacctctttttgttcccagtttcggatatgtctttatcagccatgtgaaaacaaactaatacagtcctaaaatgaatagttagaaagaatcctaaaacaacatttaaatggtgaaaaaaatatcaagggggaaaaaacctaagaacaagaaaagaaaaagaaataaagaaagaaaaagtagacagtacaataattaaagaatattttctaaaaatcttatcaggagaacacaatgtctgcctgaaccttctgaggacttaaactgtctctaagaaattaatgaatgaagctatgcaagaagtcaatgagagctatggatagatggactaaaaaagaattaggtccagttaaagtaatcatcctagaaaccagtaattgcaattaaatttaaaaaatccaaagcaatggctacctggaatatagggggattaatgggaaaagttgctgaatatttagttcaatagtctcttttacagaatacatcatagagaggtaaaaataaaatgtactatgaacatgaaaggagttgaaaagttgaggcttgatttcaaatagtgattcttccattttcttcttttgtgttcttataaaaaagaaatgtggacaagtaagtgtctaagaccccttctaaagcaaatatctggttcagtattcaatatttctctgtcttggttttcttcatatagagaacaatgagttttgtacctgacatgactttcttctaagagagaaaattagggtaagagaataagaaacaacaaagtttatataaaccaatataaatcatttggccttgcactgcagtagtctagtcatatacatataagaattatctcttaaaatcagtgcgtgagttaggatattttaaagcatagcctgattattttatttgtttaccttgacaacacacagcactccttcatttgtatttggatctgtgctaattatgaagtttccattttcatttccttgtaggattttgtatacagcctttgagtgaggagtgtttggcaaatcctgatcctgtaccttcattcgtaaaatctccacgtcaattctgttttcttctacttctgtaacatactgaaagaattgccccttattattatcaatttacaactttgacaatgtagctttatattctaaaacacgtatttaaagaaaaaaataaataaagtgatgtgaaaagctgccctcactatatggggaaacattttacaaatttaatgcgtagcttagttctttcctcctgaattgccttttcatatcttttccattcttcaaaggctaccccaagtcttatcttctgaacttctctgagataattttcctaatcattctagacctcagatttatctcttctctgcacctctacaatatttacagtctatcctctcccatttttacacagtaaacacttaataaatgtcttatgttaatatattaaacactcagtacttgtaggtaattataaacgtatgttggcttcttatttctggagaattgttttcacaccagtgtttccaaatgtacttttgattcacttgcaaacctttagcagaaaagttttcctttttttttgagacattaaacaatagccctccacaaaaatattattacaaaagcataagatattaaagactaaaagaagtagtaaattgaatctgttagagatagaaggtgaattcatataggaggatgatagacactggagcgtaatagacctagatttgaatcctggttattccttgtatatggtttattagtatgagatcttgacttaacagactttctatttcctcatatgaaatatgaggtaaaatatatcctcatatattgtagggattcatgtaagaaattacatgaacatgtctatcactgtacttgcaggtttttccttctttgacttgtgctctggaataagttaatgaaaaaatgaaaggttatttatcaaaagttcaggaaaggagaaccatttcctgaaactattgtcataaaaatataaatatatatatgtgtacacaaacacacacatcacacatatatatatttatatatatctcttattgtttaccgcctaaggaaaagtttactcatggtacaggaagagcttgtttggagttgtgagccagcctgtactactgtctccgtaggctagttccttacttatcttaagaagttgaaatgtaaaggacaccagagagagagcctctcctccttcaccctacataaagatttaatgccaaggaatctggtagcagagcttaacaccaaaaaaataaaataaaataaaataaaagtttaacacatgagctacgtctagggctaagaagctcttcggtagccaagagcatggttatttccctagcatccagaaataactagtacttcaattatttgtacagaaatcatatttttctccctatgttatttgtaagtagtagttatttaaatcaaactgtcaaactttgtgatctcacagagctaccaaattctagacatgttttttgaaaaagtagataaatctagatgaatgaatagagaggtatactcacagaagtttctgtgaaagatggtggattgtcattttcatcctcaagtgaaatagtaattgttcctgtattaaataaaccgaaaggctgaccacccatgtctcgcacttccattattaactggtaagtatcacatttctgaaaaaaaggaaaaaactacattaatgaacacttttatttcctataacttgcaattctcacaaccacttgtttaggcacgattattgtacaaatattcttttttactttttcttttatatatttatttatttatttgagatggggtctcactgtcacccaggctggagtgcagtggcatgatcttggctcacagcaacctctgcctcccaggttcaagcaattctcctacctcagcttccagagtagctgggagtgcaggcgcccaccaccacacccagctaatctttgtatttttagtagagacagggttttactgtgttgcccaggctggtcacgaactcctgagcttaggcaatctgcctgcctcggcctcccaaagtgctgggattacaggtgtgagccactgtgcctggcccaaatattccttttacgtataattttgttaaaaaaaaataaagtacagaacaagatattggctgattggtacaatggaaaggtgatgtgtctaatgtaacattttaaaatttaaagctgctttatttataattgccaaaacttgaaaacaaccaagatgtccttcagtaggtaaataaactggtacatccagacaatgaaatattattcagtgctaaaaagaaaagagctatcaagacttaaaaagacatgaaagaaatttaaaagcatattactaaatgaaagaagccaatcttaaaagcctacatactatatgatttcaactatatgacattctaaaaaagggcaaaatatagagacagtaaaaatatcagtggttgccaggaattaagagagaagaaggcatcaataggagaagcactacagaagcaaaataatcctcaataggaggatttttagggcagtgaaaccactctggatgatactataatgatgaatgtgtgtctttacacattcgttcaaactcatagaatatatagcaccaagagtgaaccacaatgtgagaactatggactttaggtaataatgatgtgtaataatgatgtgtcaacataaatgtatcagttgtatcaaatataacaccgtggggcaggatgttgatagcagggaaggctatgtgtgttgggagggatagggagtatatgggaaccgtctgtattttctttttctttctttttttttttttttttgagacggagtctcgctctgtcacccaggctggggtgcagtggcgcgatctcggctcactgcaagctccgcctcccgggttcacgccattctcctgcctcagcctcctgagtagctgggactacaggcgcccgccaccaagcccggctaatttctttggatttttttggtagagacggcgtttcatggtgttagccaggatggtctccatctcctaacctcatgatccgcccgcctcaggctcccaaagtgctgggattacaggcgtgagccaccgcgcctggcccccgtctgtactttctactaaattgtgctgtgaacccaaagttgctacaacaaactttatgaatttaaaaagttaagcatattggagccagataaaagtattttttaaaacaaaaataaaataaatgtaaagcaattttatcatcaacaaatcaaatcaggttagtgatttcaagtgaggccctgtctaatatatggtactttcccaacatctctaaggaccgaggacatctccagagaagccctaaccgcagcctacagaagcatgctgagaaaggaggccagactggccatattgcaacttctctcgggagttcattctcagtttaaatgtagttcaatgactagatagttaattaatcatcattacttctctatccagaaaaggtgtagttgtggtgatgacaccggtatctgggtgtatggagaaatgctttggatgatctgggatttgttgtaagattttatatttcagacgagtatggagagtgtcaggttcgtcaaggtctgtggcggtcacttttcccactgaagttcctgtttagataaatccaaaagtgtcaaaaatttctactcatataattgaattataaacaaaataaaatcaaggcattgctgtagcaaattctcccccaaaccacaagtagattagttctactgttaagttgacgaatgtgaaactgttctaaatgtctccaagcctcccttactcgggaacttcagttaggtggcccctgtgaataacatgattcatattctacatagatgagaacagttcccacactacccttagaaacagtagttctgaaattctttctctctaagttcacgggctatttttaaatttaacttaatttaattttagatttgggggtacacatgcgggtttgttacaggggtatattgtgcgataccgaggtttgggcttctaatgatcccaccacccccgtagtgaatgtggtaccgaatacgtagttttcagccccttccctcctccttccctcccaccttttggaatccccattgtttgttgttcccatttttgtgtctatgtgtacccaatgttcagctctcacttataagtgataacatgtggtatttagctttctgtttgtgtgttaatttgcttaggataatgacctccagttgcatctatgttgctgcaaaagacatgattttattcttttttatggctgcatagtattctatggcatttgtgtactacattttctttatccaatccaccattgaagggcacgtggattcatttcatgtctttgctattgtgaatggtgtggcaacaaacatacaagtgcaagtgtcttttggtagaatgatttgttttcccttgggtatatacctagtaatggcattgctggctcaaatagtagctctgtttttagttctttgagtaatctccaaactgctttccacaggggctgaactaatttacattctcaccaatggcatataagtgttcatggaccatttttgaatgggaccttctctgcataccttgcctcttttataacccaacttgataaagttaatcagaggaataccacatcttttcatgtaataacaaatattttatgctttgtactttaataaatgtgataaattattaatgtatacaaataactattaatatatgcaagacaaaatcatagggagtagtctatgtatcatttagacaagcttcatagtccagacatgagagtattagacacattgcattagtattgtgaaacagcaatattattcacacatatgtacatggaaacagaatggaggaggccacaggaaataacaactgttcttgcaacattttaaaacaaagtagtcagtcttgttataccccttagtagtcttgggtcacagacttggctgcacatagcatcaaatcagtttaattttttttttcattttgtttggaagatatgccaaaaaaggcaatgtatatgttttatttatcagatcgatatttccatgccatgatatatttctggttccttgaaaatgtattgaaactttataaagattcaaattacgtactgtttcataaacgcacctgtgacacatatgtacatggtaaaaatataaaatatctttatatttaatatgaatggcatttgtctgttgcacattcagatctgttgtgtactaatctaaccagttagtaactttatgtatcaattagctgccttctatatgtgggtagcaagatgagcacagaaaggttttcctttgagaagtatataacctcataaaactagaacgttttatgtagtatatccttgaaagtcaagcatttaaaaatgttctacataattgtgtttaaaatattaataaggaattcaatggaagcaaaaatctagtgttttcctaaaattgccatcatcctaaacgctggttacaaagctaggctaaaatgaaagctaatacccaacagtcatttaataaagagaattcaggaaaacaacactgatattataagattttaatataaactggtactacacatacatagcctacaaaagtcaaatcctttgaatttcaaatgtctgttaaaaaaaaattccttggcaccataaaatagacattcctgtatgtttgattacatcactttttttggagtatttttcttgctttgaaggaaaagttgaatttttcctacatttaggcttctatatatccttaaatgacactttttaaaaaaccactgaatgaatgaatgaatgaatgaaaaaataacctcttactttgttggaagaaaaaatgatccctggcccacgtgtaaatcccctgtaatattctctatggatttctgggtatagtcccttttatactgaacaacaacttttcctaatggcaaaattgagcaatatttccttcactccagactttctaagcatgcattggtaaaccaaacaccaacttcagcaacaaccccaccctggagagaatttagtcaaataaatgctgccagaattataaaatcatgatataaaagggaaaaatgtataatattttatcatatgaatatgcttaaatttaagaaagtgtgctcagagtcaattaccacccttaatagcaatgtcatataacatcaattcctaatgggaaaaaaagtgtatgtaatcagaaataccagaaaatgcataaaatgcaatgataaaacgtaaacatctttaattataatacttacgaaatgtcaaatagtcttcttgtcatgctacaataaaatgtgaacttaccggatcggcaattttcaggcacagtaaagatagtcactctgtgttcaaaatatggggcgttatcattatcatcttcaattttgatgatcaaagggagtggatattctggtgcatagccatctgcagttgttgcatagccatataactgaaagaagggaaaataccatcaatgtattctcaaaccacaaattatgcacaaaagtaagcctagcagtgggggaaaatgtaacattaaaaaaaaaaatcattcccaaagacccgtaactaagaaatgatgcaatagagagataacccacagatgcagtctctgcctgccatgtgatttcaatcccctctcagcgttattgctcattattctcccactctaagcaccatgcactccagttgttctctgaattaactgtatgctgttttacttgttagaatgcatgtagattttccccaactatgtcattaacacgtgtttttaaagtttataaaaatacaattctatttatgtacagatgtatatatacatacaaataaatggacatcacaactatttcaggaactcaattatatgttttttacctatattttctcatttttctatggtaagcatgtatttctttgcaataaaaatgttaataaaagcatatacataccagaaattccatttcaaaatgaatgccttgtccccaacagccagtatgtatttaatgtcctttgcctttaaactccaaattattcctacaccttccttatgtggtttgtgcatagtaagtgttcagcaaatagttgttgaatggattttcatccctcatgggaacaactaaacctacccaaagtgaattctgcattaactcagctttttaccacaactagctcttctaattttccctactgtaaccacttctaagtgaactaggattaaaattccaggcatcaaactcctccctctctctcataagccttagtagtcagttgccaagttctagagattttggcatttttgtgtgtgtcatgcatgttctcttttctattcccactgccatcattttcaggtgactccaaatgcattctacatgttgactcactaactttgctgcagttgttctgacattccctgttctaatcgatgtggcctcagaagtcagattttattgtgctttacaattttaaccacgatactcactaatcagactcgtcagtgatttacccactaactgctaaattaaccacaaaatcctcattattgtgttaaaaggcaacatttcatgttcactgttcgtgctaacctggaaaggaaagaatgtacactccaaactctggaatggaatgtattaaaataaccattcatgttctctctgccttcctactcatttttctccaagtaacttccaggtggtatttttcagtaacaaaacttacattatggcttccatcagtctgatctctatatcttatttatcaataaattctaaattcaggagtggaatacagtagtctatcattaccacttcaccataccaccaccaccatcatcatcaccacttaccatcatcatcaccaccaccaccaccaccatcatcaccaccaccatcagcagcagctccatcatcatcatgacactgccatcaccaccatctccaccattatcaccattatcatcgcaatcaccaccaccaccatcaccaccactaccatcaccaccatcatcatcaccaccaccaccaccatcaccaccactaccaccatcatcaccaccactaccaccaccaccatcatcatcaccactaccatcaccaccaccaccactaccatcatcaccaccactactaccatcatcaccaccaccactaccatcaccaccaccaccaccatcatcaccaccaccatcatcaccaccatcaccaccattatcaccaccaccacatcatcactgctaccactattaccatcaccaccactaccaccaccaccatcatcatcaccagcatcatcatcagcaccatcatcaccacactaccatcatcaccattatcattatcatcaccgctaccactaccaccaccaacaccaccaccaccgtcatcatcatcgccaccgtcaccaccaccactatcatcagcaccactaccactgtcacatcatcattatcatcatcactaccagcacatccaggtatcaacatcagtcacccttcctaaaaatccttccctttctcttcgtatagatgatgtggatttttattccttaaaatgctgtcattttgatattttagctggataaaactataaaatggttttatatctctattagattacagttgctgtcaggcttgaagactgagacttactgatacgtgtatcctagaagtacctgacacagtaacacactgccttaccttgggtaagtcttcaataaatagctctttgcattcaattctactcatctttccttttaggaagacaaactacgccttcagttatccttctgtaaaaattgtcataaagattctattgcatctcttgtaatgaatttttctacctcattaaaatggtattaacaagtctccttatccaacctactaagtccacactgctataatttagactaatttgtcttagtttttctcttcaatggaaatgaagatcatctgcttcccaccatatgctcatttgtaatttgaaataatatttttgttatttgactacaagtaaatattatttcacattccgctgactcagagttggtgattttacttcaggtagtatcctggttttgttttattgtgctaataatgaaccaagtatctccaaaataaatcaaaattggaatcatcattaaaacagagcctaactctctaggagaattgacttatgttcatatgatagagtaactcattataaatatgttatttagtcaacaaagcaacaatttcaaaaaactcaatagaggtaatggttttattactatatccatcattctgtattaaaagcaataataatatacttaagtgttgttacaataaaaaataatttagaatattattagttgtatttttagctaggttataagtgggttatttagtgtcatgtgcgtgttattgtgatatagtttcctctgaattattctatagcttaaagaatctcatctcttttagccctttcacactatatattgctgaaattgctgtcatctttggaaaaatgcaaacagctactgacagaaatagggacttgagtttggccttacagtggcaggcattcagtagatggggcagagaaaggagagagcagtaacaccaaagctgagtgggtacagaatgtgaattaacagcacatatatgaagagaattaatcgacttgtgtgcccagaagagaaaataaacattacaagaggccgggcacagtggctcacacctgtaatcccagtactttgggaggccgaggtgggtgaatcacctgaggccaagagtttgagaccagcctggcgaacatggtggaaccctgtctctacgaaaaatacaaagattagctgggcgtggtggtgggcgcctgtaatcccagctactcgggaggttgaggcaggagaattgcttgaactcagaaggcagaggttgcagtgagccgagatcggattactgcactccagcctgggagacagagtgacaccctatatcaaaaaaacaacaaaaaaaaacaagataataaaagatagtaaggttctggttgaataggaataggtaagaaaggagcagattgaagctaacttttccaaaggtacagattatccccaacactcagagagaaaggaagtttgcagctgctttcacagcatcacttggaattgttgaagaaagttcccttcttatataactattctttgaatatgtattgaattagacctatggctactactcccaaagctacgaaatcaaattatttcaaataaaaataatctattattaatacttaacatgaatatggcttatataaaatcaaagaattaggaaattccatgaaaattcccaggtttaaggacaaaattctagaacacgtgtattgttaaatctaccattagaatatcttcaacaacttttacagtttacatagtggtatcactggtattacggcatttaatgatcagaacactactgaggttgggaacacagctactagcagcccataaacaaagaagaaagcgaactctaggaggttgtgatttgtttgaggctacaaggaaaggaacagatacttaggatctaccaattcccagaaacatacattattcaatattttaaactattattaaagtatattacgttaaaaacatattatcttattttaacctctgcattgacagggaagtcttctattctatcctgcttcaagtgattttataattgcatcaggtttacatcttgttgctatacctcacttaatgaattttactaatttgcaagtggtgtttcttaatgccaattcaaacttaactgtgttaatgggacctacagaaacatgggtaattctgaggcgaaattatttaaaagtttaactttgaggataaatttcaacctattttattcatttacatttttttaaatgttaaaaatagcaaagtaacttatttttaattataaactgttctctccttttccctctggcaatgatcacagtaagaagcaaagatagaaagcaggttggcaaacagaaccctatcaaacaattcctcagcaaaattgaaaatgaagtgaatattgcaacatacagagtatgagctttttatatctcctcaagagtgacttctagtgttagatcttttctctagtaaagaaactgtaaaagcagcagagaacttactatcaattatttatttgtttatgagtagaaagatcaaagtgattgcaatggtgcttagcttacttctcctgtaagaacttggatacactattttttaaagtaaaagtgtgttatattactagaagtaaaatatgtttattctagagaatttggaagggaacataaaattataaagaaaatatgccactacaatcccaccatgaattttgtatttaattatgaaacatctaaagtggaaaatttatacagtttcaaatttttcactaccttatagactgctttggaggatatccttacgatagaatctactccttaggataaattataaggtctttccctctctattttttacttactagcttcatatttcacactcttccttagcttcaaattacacttcagccagggtttgttgttgttgttgatttctttttaacaagtaaatatttccatttctgatgcatcttcctggaatacttgtctaccacttcccatccccacaattgttaacttctttcataactgccttgaggtggccactaactactactcattctccagatgtctgctaagatattactctctgaactgcccaagtatgagataagtttcatttttatattctcctttagcaaagaactttattatactcttatatcattcaagacaataaatgcttaatcagttttattcaccaccattccaaaaacctactatgaatatctcatttcatcagatgagacatcagtccaccaaagagttatataaaattaacagaaacaaaaggatttaattatcagaagagttagaattgtcttgtctttgggtaggataagatagaatcaaatgaattgataaacttgttctgggttactaaggaagtaaaatggtactaagggatctcattgctgaagaatagtgagagaaagggatgcaaaaaaaaaaaagctatgtaaggggctaaggcagtggatccaacacttacacatttagaatcacgttggatgactggatctcatcccagaacaattaaatcagaatacttgggcatgggtccaagcatcagtattttttttcaagttctcacatgacttataatgtacagccatggttgagaataactgagtcattttattatggataactttaaattcagtaaaactctttgttatttctccaggattacagaccaaaatatatcctttaaaattccatcgttatattttctttacctcccccgccacttcccttattatatccactgtttttccccatcaatggtgaatagaaatttaaagtttatattgcatattaatatcttgaatattaaatcaaataattgattcttataatatgtaaacaagcatagttgaaaatattagtaagccagtaataaagatataattatgaataaatatttcaataatcctaccgcaaactgttcatatttctcacggtcaatgctccttgtacaaaagatatccccagtgtctttctctatgtaaaacaaattgaagggttctttgtccacgcctggcccacttatggaataaaagatggtgtaattctgtgcagcatcagattggatctgcagtaataatttaggaatagaacaaatacgtcatgatgaatattttcaacctaacctcttgtgatggtttatttttttaccactacccctctttcctactctcctattctttctttcttctgcttaggtgcccattatctgccatgttttccgaatttttatttgcattttgcattgtgcaaagccacaaattctgtcacttatttgatctcaacttttttgtcatttgtatatctataaaacatgtagagtaatacacttttcaagttttatctatttattcttatcttcatataaataatagtaacagtttccgtgattttgaattctttggaattgaaaattatgtgataataaaactagaagtaaagcaacttttcttccacaattaattcctcaagaattagaaaattttggccgggcgcagtggctcacacctgtaatcccagcactttgggaggcctaggcaggtgaatcacctgagatcaggagttcaagaccaaactggtcaacatggcgaaaccttgcctctactaaaaatacaaaaattagctgggcttcgtggtgggtgtccgtaatcccagcaactcgggaggttgaggcaggagaatcgcttgaacccaggaggcagaggttgcggtgagctgagctgatgccactatactccaaaatttcaaaactgttctatgtttgcaatccagctatgtggcagtgaggcaatcttacttggtaagcagaaatacaggtcatttttataaaagatgagtgttagtttaagcaagaattgaactatgcaaaacatgtaggtgtgccttctgtacattagtgttaacaagtctagcatagtatttgggtgaatttagacatagacctaagagcaccagaaactccaaatataaaacttgtttctaaatttctaaatatgatatctgtaagaaagtaataagatatactgggtcacttctatgggaccctagttctggtgaatagatgatcattatttgtaccattagtttaaacctctgattcaatatgctgtgcaattcaaatgaaaagtttaagaacaaaaaaaaatttggacacatataaaatcaaataagtgaaatgcacctgctgaacgtgttgtggaaatggacccaacgagttctccatcaatgaagctggaataggagcccatcgtctcttgctgcgcttgagggctgtgtctttggtatgtctcttcttaggagactacatttgacaagaaacaaagaaatgtagcattgcttatcattttttggaactgtgattattttacacatacatcaacaagcagatgtaagggttacacattacaatatcatggctagtcagcaaagcatttctattgataaaacacacacacacacctcagactacattatgttcccccgttctacctatttctctatttactcagttaaccaccaggaaatgtatagggcatttggaaagatgccactttgagaaagtataaactccccctaaaatagataattcattaataaatatttaaggatcaactttattccactaggactggcacaaccaaaatctgttaaaaccctcactccacaatacaatcatttatacatctatgtagacacaggtcagcatttgctcaagtatacttgattttatataatgtggggattttacaatgtggatataaaataacatttttaaagtcttaagcatattaagaggagttcatacaatcaaaaagaatttagttgggaaatcctctcctaaatagaatcatttattaagaaatggttttataagacgaaattcattgtggtgaatttgctgaaaatgagatgtgaattccagcaactttttcctccctgctttctgaactgatctctaccgctcagtgcaagaaaatgagcctagagttaaacattcaaatcaattctgtggattggccacacctccactctctgaagagagggcctgccctatagaatattctagtaagatgggagtaagctttaaacagtctcttctcctctttaaagagagactcaaacccgcaatcagtgggaagagagccgcacagggtggagcccacatctccagcctgaatcacatttcgctgagttttagacccgcccctgtcttgtccttgctcctcaggttggtttgttcttattcccaaacttgaaatcactattagaaaactctgatattcttactttgctcctggtctacagagtcattcatctttataaaagtttgtaaatggctctgccactccttaaaagtctagtctttatttacactaattgtaagtggaaaagacaaatttgtcattcaatagcatagattttaacatgaaacacgttaaaacacatgaaacacgaaggactcccgtaagcatattactgtgctaggctgcttaagcccttgccttataccttgttttctcttgctgacagtacaacttttatctcttgttgttcccgtctctgaccatctgaaaggaaaatggaaaaacttttcctttcagaagacaaaatgaggtcatgtgttgtgtaaattgagccatcttctagaattctgaaggcagggtcactggaccggattaggctggccgacttgagacactcctccagattcactgcagggaagaaatatcacagcagtttgtcagatgaaacaggagtggaacaagttttacaggaatgacagccgtgagttaatgcatgagaagcagaaaaagggaggttacatttggaatgtgctcagcacctgctattctaaaacgtgggggccatgaaaattaaataattatattaatggagtcacattttccactaccttcgtcatacattaatttgagaaataaaatattttcctagtgtcactgattttattctcttttctttgaactcttaattattgtgtgtgtataaatttatatatgtgtatacaaacttgattttttatgtcataagtggtataaccgtatgatgtcagtaggttttgaactttttgcagtagtttgatacttaaaactatcttgccaaaaataagaaaactaagtggctcacacctgtaatcccagcagtttgggaggccgaggtgggaggatcacaaggtcgggagttctagatcagcctggccaatatggtgaaactccatctctactaaaaatacaaaaattagccaagcatggtggcgtgcacctgtaattccagcgactcaggaggcttagtcaggagaattgcttgaacctgggaggtgaaggttgcagtgagcagagatagcaccactgcacttcagcctgggcaacagagcaagactttgtctctaaataaataaataagaagaaaaccagtctattcttaagtaatatttcccagtaatattgcaaataatctttctgtaatatctttcaaggtttagtaaacccgatgcgctgtggttattatcaaattacctcctttacagattcatatttaacacatttagtgtatttactatgtgtctttagagtgtggactgtttattaatttcaaaccttaaagcactgggcaaaacaacatctggcttggaaaggataccatttctgtattgtttgtaattttttacatgtgaatgcaaagccagtgaaaaaccttgatgaaaaaaattttacgtttgggctcagaacaaccaacttatacttcagagatggctatggtactaagacccaccaaaactgtatttgattttcacaagctgttctgtgaaatatgtcacatttattcttggtggatacttgttcattgtaatcaacctcaagtacaaattttattgggggcatttagattttgagacatccatttcatgtctaatcaattgaagaatcttggctttgaaattttggcagcagattagtttatacaaattagaatatgctcctggttttggtgccttgctttgtttgacgtaatccaagataattgagccttctgatgtttgctaatttttttggcaagagaagtatacaactaactttggtattttaattatttctaaccactaccaaaaaacaagtagcctgtcttttattgtacatccgattttaacttcaagtagctactatgtggtttttttttttttttttgagacagagtcttgctctgtcgcccaggccggactgcggactgcagtggcgcaatctcggctcactgcaagctccgcctcttgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctactatgtggtttttatcccaaactttacaagagcagcctgcagctaaatgtgacaagttacagctatgaaactgttaatagtgtttctcacctttgcctacaagtgtttcagcctgaagatgagaaggaactcgaagataaactttctgacaagcatcgcaaagtaatgttaaaacctcaaaaaaaaaaaaagaaaaaatatcaggaattaaatttgatcacaaattttcacattgtagctttttcttattgataaaaatattgtcaattttggaaacaaattaatcatttaattctttacatttttaatactcactttaaaaggaaccagcaaagagaatagctttaggaatagcactgtcatttatttgtcaatgaaaaaaattaagtgaatagtagttcttagaacctaaatcatattgtgtcaatgcaagaaaatatttcacaaaccattgactttatatagaagttatacgtctctaagaccattcataaatgccattctgatttttagcatgaagaaaatacttacctttgaaatgcataattacatatatgccctaattctctaatcatcattttactatttgaagttatagttgatgaagtctagaaaatagttaagggcttttttaacctcacagaaaaataatgcccccaaaaaatcattgttctcaaatcaattttgtgactgacttggccaaaacgccaaaatctaaatgatctcaaatcacatgactaatctaaaaagaaatatatgtcaaaatatggagagtatccttcagatgggtgaagatttttaattaaattcaaggcccagctattgtttttaaaacctaggtagttcaaagacatagacactatctgaaaaaaacaaaagaaaagctatcatttcaaaaatgtctataggttcaaaatatattttacttctttttcttggcattttctgtttgttcctctttatcaaaataactgcttttttattatttaaatataagatagagtagagctaggttttccagaaacatgtaggtcaattttatgatcagctttcagcttttctctgaattctagagttacgggacccattacttgcgaggaggaaagagaatggattaacatccatattaaggatgtgcacttcttttccagctcatctcaagtctaccagatatactgtagcagtctaattaaatagtttgtaattttacaaaaatctatgttaggcagaaatctggaattaaaaggccacatttttatttagtcctaatttaaaaaccactttttaaaacgtgagacattcgtatttatttaactttttaaatatgttcatccctaatgccaaggaacataataaattatacttaaagaactttctaagcatagaccatactgttaatagttgtctaagtatacaatgtggaaacagcatattgtaattaggctatgcataaacacatacatatacatatgtacacatacatatgcatatacctgtacatatacctatacctatatatgtatgtgtatgtgtgtatatatatacacacagtcatatattgcttacattctaagaaatgcaacgttaggtgatttcatccttgtgcagacatcatagagtatacttacatacacttagaggatatagtctactacacacctgggttatacctacatggtatacaccatgatttatatatgtatgccccatggtatgcaccatggtacagcctaggtgtatagtatatagtatagcttattgtaagctacaaacctgtacagcatgttcctctactgaatactgtaggcaattgtaagtatttgtgtaactaaacatttttagatatagaaaaagtacattaaaatacaatataaaagataaaaaatggttcacctatacagacgagctccattataatctatgggaccactcatatatgtagtccatcattgactgaggcattgttttgcagagcatgactgtatatgtgcgtgtgtgtatatatatataaatgtacatatatatatataaatatatgagacattcttatagttatatccacacttccactcccacccccatcttctttccttcttgtcctaggattccatgttgatggtcctccctctgcaggcagagccactgaaggtttccattcattaaatactattcccgtcttcaggttaaatcactgactaagtggcttagtgacacccttttagtcagtttcagagtcagaaataaataaacaggagatgaattgtccaagagatattagacagtacagggatcagaagcaaaagaaatgtgggtagaatcctttgaaacatttttaccacattttaccaaacttgtactaacttaagatggtatctgagttatcgtctccctaagcagttacaggatgagaaggtgaccatcaaccctgcattgtatattatttacatggagaaaatgtttgtcctcatacctgccatttctaaaaatatattttgaaactcaagtattttgctaaaatgaaaaaataggaaactcacacctcagaaatgatggacggatgtgtgaaataacccccctctcttccctcacctccaaagaaaaaatagcaccttacacagttacaaagctattaaaaacccaagtggaagccaagttgaggatattttcaatgacagtcacatttttgttatttttcttaaactattctttgcttaaactgcttcgtgggtaaaattcaaaaagtcctggataatttgcatgttcacccagaatcctttctctttttttgcagcttagtagaactcagcatgttaaataacatgagtttatgtaatcactggtagcagaagtaaacctcagaaacttctgggccaaatgcctaaagaatgaattcacttctctactcttagaaaatcaccacagcaggatggaagagggattcccttgaaaacttttaacactctggcagtgggtgcttgagaagtaagctgaacactttccatcctgaatcccaagcctctcaactcttccctgaatcttcctcagatctgcttttgttttccccaatctctcttctctgcctcccatcctcactcctagtctctttcaagcccaaactgcagagaggaagcaggtagtaacatgcttgaattccctaatcctttggttgttactcaccaggagagagaaaaggagctgcttacagaagatgctccctggggcagcagaggccagagccatcagaagcagtcccaatggccagggacggtggccagataacagggcagcctgggatgcacagagcggctaagaagacgctggcacttgcacagggtattctgctgccaccttgatgcagctgagcttggtttggaagacagtccggaggcaagtgataaacagtaggaggagcaacgggagaatttctttccccctattccctggccagtctccttccttccagttcaattacgtctaaatgcaaagaggctttcctacaagt

SEQ ID NO: 1691 - DNA, 33606 bp, Homo sapiens; identical to SEQ ID NO: 1690
  source 1..33606: mol_type = genomic DNA

SEQ ID NO: 1692 - DNA, 3824 bp, Homo sapiens
  source 1..3824: mol_type = genomic DNA
gcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcaggtaagcagtggcctacgccgagggggaaccctttcgccaccatcctggcgtcctgtccttcaccgcaggagtgctcctggatcttagaatgagagccgggtttccctttcattcctcgcatccccagagtcatgtgttagagggatgccaaggaaccccacacagcccaccccctgccctcatccctagcggagcgcagaggaccgagcttttgttttggatggagagctctggagctgcgtgggtgggtggagggggagggcttgttttgatgagcggggctgcgccccccacctccagtaagacttgccttgccttgcttgccgcctgtccccaaggaaggaccgtgatccttggccgtggatgtcccggcagcccgggtttgggggcgcgcactagccgcggccatgggggtgctggcgggaatccctcgcccgcacagccgccgctgcggagcgctgcgagctgcagtggagggggattctccgtatttgcgtcagctgttgttgaaatgggctctgccactggtgcgggtccaggaacattgcaatgtgctgctatcaattattaactacctcgggagtcaatggtagccggcccggtctcttgcctggcagctcgggtcgtcctcgtcctccagtgattgctttccagtaaccaggcctcccgcttctctctctcctgccagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 1693 - DNA, 3956 bp, Homo sapiens
  source 1..3956: mol_type = genomic DNA
gcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgttcccacctctccatagagggccccaccagtgtgggtccctcatcctcacaggggaggtgccagctgggacaaggagaccagaagagactgaggttctgagcggtgaagccaccaccaggagcccagagttggggtttgaaaaccggggagggggggggggtcgcaggtcgccctctgggttcaagtccaggtctgtctgtgccttggaggggcaccgtggggaggtccctttgcctctccgtgcctcagtttcctcatctgaacaacaggggtgcgaacggccccgatcccgtgggttcccggtgggggatcccgtgggttcccggtgggggatcccgtgggttcctggtgggggatccagaggccccgtggccgggaggggacaggctccttggcaggcactcagcacccgcacccggtgtgtccccaggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtgtgagtagccgggagtgtgcgcgcccggctcggaccccgcgtcccggtctgtgaggtgggtggggggaggccggggccggggctgctggcgggggggggtccgtccagggcccgcggggcccctcgagcaccttcgccctcaggcccgtcgccggatggggacgacaaggcgcggctgagccccgacccccggggccgcccctgagccccgcctctccctccccggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtgccgccgggcggggcggggggcgcaggggcggaggccagaggcctggggagggtggaggctgcgacggaggggcgcgtcggggccgctcgtggggacctggggtggcatcgtgggctgggtggtcccctctccgcgcctcggtctgcacctctgtgaaacgggaaaatacccgccatgggccgttgaggggttaaatgagatcctgcagggaggccccgatctgctgtcaatcaacaaacttactgagaagggaggccccgatctgttgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagattctttgtgtctctccattcaccagtcctgtggcccagggcaggggccgcctctgtctttgggaaaaggggcaaaagtccccacctttccacccctgtccgcggcttgcagttctggttatttcctgggcgccgggccccgtggctcaggcctgtcatcccagcactttgggaggctgaggcgggtggatcacgaggtcaggtgttcgagaccagcctgagcaacatagtgaaaccccgtctctactaaaatacaaaaaaaaaaaattagccgagtgtggttgtgggtgcctgtaatgccaactactcaggaggctgaggaaggagaatcgcttgaaccccggaggcggagattgcagtgagctgagatcacaccactgcactccagcctgggtctcaaaaaaaaaaaaaaagattcctccctgggaagggttagagggagagtttccttgtcactaagttttctcatagctctcacccagtgcagtggcgcgatcgcagctcactacagcctccatctcctgggctcaagccaccctctcagcttggaatggggggtagctggaaccacaggtgccaccacgtgggtccaccacgtctggctaatatatatatatacacacacacatacatatattataaataataaatatatattttatttaaataaaatatataatatttataattattttataattataataatatttatataattataaatatcatttataattataatatttattattttataaaataataaatataaaatatataaaaatatttttataaaataataaaaatatatatatacacacatatatatatattttttgagacaagtctcgctctgtcgcccaggctggagcgcagtggcacaatctcagctcactgcaacctccgcctcccaggttcaagcgattctcctgcctcagcctcccaggtagctgggactacaggcgcccgccaccacgcctggctaatttttggtattgttagtagagacggggtttaaccatgttagccaggatggtcttgatctcctgaccttttgattggcccacctcagcctcccaaaatgctgggattataggcgtgagccaccgcacctggcaatttttttttattatttttgtagacatggggctttgccacattgcccaggctggtcttgaatgcctggcctcaagtgatcctcctgcctcgccctcccaaagtgctgggcttacaagcatgagccaccgcgcccggctgtagtttttttgttaactgagcacctactgcttcctgcactcaagccacatccagggacaacctccaacgccctgagccttggtgacggctcccactctacagatggggaaaccgaggcttgccttggggagcagagtgtggggtgggtatcctgccctgcaggatcccagaaccacagtggaacctgagatggggaaactgaggcccggagaggggagggtcatcatcactgccccgtgtgacgcgctgacgatctgtccccaccgccacagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcgtacgtgccctgggtgtccctctgctccccacccgctcccagcccggactgcagcaacaggcaccgtggctagaccctaggagggacttcccaaccctgacaggcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaa

SEQ ID NO: 1694 - DNA, 119732 bp, Homo sapiens
  source 1..119732: mol_type = genomic DNA
taaattaaattcgaatctagtttatttgcagaattttacttaaccagttgtcatttcttcctgtttctcaccattatataaaaacttaccctttgtacaagtatgaaaaatgtggaacaatgaataagtagtgaatattgcacatttaatgtccaaaataaagttgtggtttttaaaggtcacactagatatgtgggaagaaaacgagttgaacacacttaagtatgtgtctccacataagtgattttaaactattgaaagaaaaataaattctatcagtgctcaatgagagacagtacatctgtacattaaaaaataaaagttataatcaacaacattccttcgcaatttcattatcccaaaagaggatcagtagtataattatttttttttcaagttattttcatcaggaatcaggaacctaccagagtgaaggaaacctcaaatacagctactcctggacactgatgcccgaggcatgctgtggaaaccggaccaaaatgaagtctgcgttagtaagtctagaactttacccagcacaacccagacacaaatggaagatggtagaaggggatactttcttttaatcaacacacttatttcccaacattatattctccattttgcttaataagacaaagttaactgatcagaaaaatgatcagctactatctcaaaatgagctgtacagttggcccaaaatgaagagcaggcagtagtagaggattaagggcaaagtgccttgttgttaggcctgtcatgaagatgtggggtgagatctgtcttgggcaacaactgatattaagctgaggtctgcagtctcaacttgccactagcttaatgtgcctcccatggggcacagctactgaaagctgatgctgcccaagcatttagggagataattatgccacttggaccacactggtgcgactctaaccccagggctggggccagaatgaggtaaaggaggcaccacgggggtaaacccaaggaagcactctcttggcacctgcaagcaagcaccaacttaaatgtatgccccaggtgcctcatttgtctcaccctagccctggccctgctaatccggggcacaccccttttaggataacacggactaatttggacactttccccaaaccgtagcccagttagacatgatggtggaaaaggtctaactaaagacattgcaggggagatgggcgcggtggctcacgcctgtaatcccagcactctgggaggccggggcgggcggaccacaaggtcaggagtttgaaaccagcttgtctcaatggctgggtgaaaccctgtctctactaaaaaatacaaaaattagccgggcgtggtggcatgcacctgtagtcctggctccttgggaggctgaggcagaatagcttgaacccaggaggcggaggttgcagtgagccgagaccatgccattgcactccagcctgggtgacagatgagactcgtctcaaaaaaaaaaaaaaaaaaaagacattgggggatttagcttggatttagcctaagaggtgaggggtggggtggaagtggtgttagacatgtgatgaaaactgaaaatatctaaaggtctgcctcaaggaggggcaagtgaacagccccagcctgaactgctctggacagaaccacgaccaataggcaacgtagaaacatcttggttcaatagaaagcagaactacagagcctgcggatggcagcctaggcctgcccatcacaggctggaccaccaggcactggacaggggcagaggagaggcaggaggatccctgcagagtgagaggggcactagatgaacgtgaatgacccttctgactgtaaaagtctacgattccaggacatttgcttcctgctccagaagaaagaatttcaggaataaaaactcagtgaaaaagtatatatcaccttcatttgaaaggaacgaggacatgaacactcttggcttgtatgacatgtacacactgattttgatgatgaactgagaggaaccaggaggccgtcacttggttgaaaggaagttaggctggtctatgggttttcattttctggactaggctttccccaacctcaaagaagtgagagacgcaggcacacaaccccagtggggcagaggcatgcgatgtctgagccaacaaaggatggtgagactgagaaatgagtcacgccttggagctgaggtcccgagtgtgcaggaaggagctttggaaacatgtacaggtgggtcccgaatccactgctactgtcatgctatgtagacagttgtgtagacacatctggcaggacctccctccctctatgtctggtgtgttccagcattctgcccttcacttgttctattaataggcagtgggacaacatgattccgggatgcagcctgcctctgcaacccacctgtgcactgcagcatggggagtgatggagagggagagagatgtttttcatggcaaccagaatcctgcctcctcctgctcccaggaagctgttagacatctttatttggtcccgatgccactgttggccaccctgtggtgaagtctggagcctgcagccgttcgccctccacgctgctcagtccacagggccttggtcttgcttgattcccgtcttgatgtgcggcacccatcactgattctgaaaccacagccccgtgctctctggaggccaacaattttttcaagccaaggctcattacccctgcaagccaacaggcgggctggtctctctgccgcccttctttcccaggaggctacagcagcatggccatgtctgaactagctcagtgtctttatagcacgttcctagcccagagtttcccatagacacctaggagttgagtcaaccttccaaggttaagcaagaaagagttaaagaggaagcgctttcactgaccatctctgattattaatgaagttcaatgtcaaataaattaaatgacatcaggcataaaaacctacagcaactttaacagctgaaacactttacaagatagtgtgatatccctataatttggtttttaaacagttacaaccaaagataaatgattttattttttataatttttacagaccaaaaaacattatacagattaatcataattttctttaaaatgtgcatactgtcactcaaaaatttcacatcctaggatatcagtaattatatcctcctcaaagaaaacacaaaatatttccaaacaaaaatcgctgttgccagatcagactattaaattgtccacagcttctcaaattttcttatacagagaacaagatgattaattttgaaaacggagagaagcaaaaataagaaaagctgagacagatccctctgagacggacattttgtggcctgtaaaactcaagagactaaacagggatgttctttatcagagctgcaaagcgtgtctttaaggcagaatcgttctgtccaagtaaagaaattcaaagtaaagaaaagctcctaccaacttcccaattttgggggaagcattccaaaaggacatttgaggagagattagcactctgttaactatattcctatacccctataaacattcttggtggctgtttagacatttttaggtaaatattctcaggctacagactacccatacacaaagacatattaagccagctatgcaggcaaaatccatctagagctgatagaatgaggaacgtgggaacagaagtcaaactgctcattcccaggagaaataacatgagcaagaagatggccacagaacaaggcaaagttacacacaggctttggtaatgaatgaactgtcaacaacagaaggcacgtggctatggaaaaaaagccaaatttcagtagatctcccgacctgacccagtttccacagacaagtgtttcagcaggtccattggcttcatctgagtttgaagttaaaaaacaagcagggaacagagaatcaggtcttcagtctccctcagtctctgtctcctgacactgagcctttcagatatcgaacatggtgtctatcaaagggtgcaaacttaggtgtcgacaggggcaagtgatgtgaatgaggctagggtcagggcccgagggaatgcacagactctcccgactagagagaggcagccctgtctgcactcctcaccaagtggaccaaacaaaacatctgtgcaaaacatgctcctcccagactgccagcttgccatcctgattcagacaggcagcttctccatgaggatacacggctggatggaaattgacttgtcatcatctctactgcccactataatcacgatcaagtggtcgtattttacacatgacccactttaactaactcggcatttttatctcccttctgagaaaaacaatactttaaaactattgtatttgtccacatttgagaaatgcagaaatttttcaaaattgacttctttactttggaggaacacaaatggggtttaaaagtaagggtactgagtgacttccaaggttgtcagatctggaacatttacataaaacagagacagaagtggaaacatacaaagaactccatctggaggtcttgtgagatgactgggacattcggcaactgtgagtggctctgcacccaagtggaacttagtaagtttctcttgtggataaatataaaaacttaaagagtccccagaaggtcttaagagctaagaaaacacacacacacacacacacacaccccaaaattatctaatatctaacgcctcccaacttgcatctcagtcaactacacattggccaaactgagctctacagtgcaattgagcaaagttacttgtgcaacagcaaagttaaatgtaaacataaacagcaatgggtttttcaagagcctcagtgttaactatcgtatgtggtccaaataatgcacttctggatacagacagttaacgagaagagccaagaagcttttcccatcttgaaggcaatggccaggatgccttataaattgggtggcttgcaatatttgatcctggtattcaacatactgcttacttgatgccatggattcaagagcattcagagcctaaaagacacggaagatgagagggttaactccatagaggcacataatgtgactgccagaggtacagcacacccattatcactgtgtacttcaactgtgagccttgtgggaaggaggcctacagaactgaggccaggagtccggaaggcaggcattgattaacttaaccacaaccagaaggaggccagcagcccaagcctctgtggcctttgcagcatcccacacccagccttccctgtttctgttctgtgccatttcccaaccttgccttaccaagagccactgctgtggcaggctgctcttgttgctgggcgcctcacctgccacaccgatttctaaagcctgccttgtcctcgttctccccagtcccacctgtggggtcctccccaccagattgtccactccttccgttctagggcgcaaccggaaatcccaggcaccagcctcatcttgctaaggtgaaatctgttcaatctgctgttgggtatgttcctaggttatgagataatgttatatgaaactgtctaacggaaaggaattctagaggaaccagttgctaagtgctgccaagagtaagtgagaaggttgttaaatcagccaacaagcatgaagtacataggttcctcccgaatccatctgacaaatgacacaaaatcatggcagaaactgtttccatgcctctcttcagaggaaggaaagaaaagcattctttgactccagaattttgattattcctttcttcatagtaggagaagagaaggggaagagactgtatatggagaaaacaaaaaatcaacaatggctcttgatttttggggtgaggagttttgttttccaacttaacaagctcatccaccccaggattctgacggtgttcccctcctcactggggcacatcccccaccatggagtgccccactccctccttgtcccttttacagaaaccactgcactagaaaatatgtattaaaagatggaatgtgcttgattcaaaaaccataagagaggggatttttttgaggatgataaataaaccagaattttagaaattaactaccaggagggctgtagatggaagtctttgggctgaaaataaactgaaggtatctgggtaccaaattaagagctatgtaaacagagttcaatttaagaataggaatcaactgggacaggcattcccatgaatcacagtgtccctctgtctctctccctctcttttccttctttaaatttagtcccccaaacagtctactttgacagtttgcctaacgataatcattttctaaaaagacaactttcttcaaatctgaaaatcctgatgacaagtatgtatgggacatacagggagtcatcactttaagtccaaagaaatgaaggcaaagaggccaggcctgggcagcccagggccccagctaaagcaagaaactgatgctgcaggtactggtggccacaggagacgtagtcttctcaaatacaccctgcatctcactgacttcacaacctgccctcaggatattcatctgcccactgggatgtttcatgtaagacaataggggattcaaacagcagctgtctaggcaatgagtgacaactatcagctattttataagcccagatccctgtggagaacctgctaatctgctaattattctgtctgatccttgctcttaataaccaagatctgacattgcatgtggctggcttagacatgacaaagttgccccagcagaggagctaaggtgttcaagctctgagcacttacagagacagccctgcagagcagggaatgggagaggcctggagccagactggccagtgcgacttccagccccaacacttactaggtgtgtaatttgggacaaattacttagcctttctctctctctctctctttcctcatccaaaaaaccaggataataatagttcccagctggatgcagtggctcatgcctgtaataccaacacttgggaggctgaggctaagaggaacgcttgaagccaggagtttgagaccaacctcagcaacaaagcgagacccagtctctacaaaaaaaatttttaattagccaggagtggcaatgcatgcctgtagtcctaactacttgggaggctgaggtgggaggattgcttgagcacaggagttcaaggctgcagtgagatatgatcacaccattgcactcctgcctgggcaacagaataaaaccctgtcttaaaaaataaagtcgtttctgtgctatagcattgctatgaggattaaatgagttaaagctttaactcactaatattggtcgagttaaaacttataatagtacctggcacagagggagtactcacgaatgctgatcatcattttttactgtgcacctttgtacctggccagcatgtccataggttataggaatgtggccttccatgtttttagaagaagctataatttctagctaccattctgtccatgttaggttattctagcatcagccaacaatagtcaaccttcagactcacaaaacaggaactactttctcggttccaagctaaagctcagctaatttccatccatcccaactgtagccacatcttctgtgcgagatcccagtccccagctccagcccctgccccagcccaagcatgtggtagataagtgcatattcacacttatcagaaccaaatttaatgctagacagacttttcgtttggccttacttttctacaatgacagtagcagcgatctagacaactgcctacaaaaatttggaggttggcacatgaaaccattttcccgtaagtagggcacatgaaagggaacactgtgctaccaccacagagcatcatgtcatgacgcgcacaggctacggctgccacctccctgccttctagggaagatgtgcaggcaaacttctaacccttcattgtatatactgacctgctgagctttgggggtcagatgtaattcagagccaggcctcaaacggatctgatcttccataggaacctgaactgaaaggaaggcagccatgcttcgggcaaccactcggaaccttaggcattagggagaggtcagaagaagtaaatggctattaaagtaagcattttgaaataaacaccatattttctatgacataaaaagatgaacacatttccagatctactgtgttgttcaccttctcaggaaaatcttaaatatgatcaagaagaagttttatccattatcaccatccaaacaatatatgtataattcagattcaagaatgaaagtgttggcaaagatgtggagtaactggaacccttgcacattgctggtgggaatgtaaatggtgcaggcactagggaaaagagtttggcagttcctcaacaagtgaagcatagagttaccataggacccagcaattctgctcctaggtatacacaaaaaactaaaaacagatgttctaacaaaaactggtatacaaatgctcatagcagcattatctgcaatagccaaaaggttgaaacaatccaaatgtccatcagctaatgaatggataaacaaaatgtggaatacaaaggaatattattcagccataaaaacaaacgaagtatggatacatgctacaacataaatgaaccttgaaaactttatgttaagtgaaaaaagtccaacataaggggccacacattatatgattccatttatatgaaatgtccaaaataggattcaatacataaagtcataatgtcaattagtggttactagagacacggggattaaagggaatggaggtgactacttaatgagtgtagggcttccttttggagtgatgaaaatgttctgaagctagattgtggtgatggctacaacaacattgtcaatgttctaaatgtcactgaattgtgcatataaaaatggttaccatggaaagttttaagttatgtgtattttatcacaattaaaaagaataaaagacgcaagccaaatttaagtaaaacaaaatctcgcagtcctgctatcttccaccgcaaacaaaaaaacatgacgttaactggtttggaatgagtgagtcccaaagttacaacatcacaatgggctattccacaagaatgctgacatcatcaagtttgcaaactcttttcaacactgacaagggcttgaaaaggaaaccatgatgtaagtaagtattatgagagaaaacaggagctaatggcaaattcttccatgccttgggattttttgcaacaaaaatccagacttgcttctcattacttatccttcttaccaacaggccttttattcattttttctgtttttttgagacagagtcttgctctgttggccaggctggagtgcaatggtgtgatctcggctgactgcaacctctgcctcctgggtttaagcaattctcctgcctcagcctcctgagtagctgggactacaggtgcttgccaccacacccagctaatttttatatttgtgtttatttatttatttatttatttatttttagacagggtctgactctgtcacctaggctggagtgcagtggcataatttcagctcactgaaacctctgtctcccgggttcaagcgattctcccacctcagcctccagagtagctgggactacaggcatgtatcaccatgcccggctaatttctgtattttttggtagaaacggggtttcaccatgttggccaggctggtctcgaactcctgacctcaagtgatctgcctgccttggcctcccaaagtgctgggattacaagtgtgagccaccgcgcctggccaccaacagatcttaacccagcttgacgactttacagttcactagactgagtccctcacaggttctggatttccctgaacgcctcaagtgcccagctgacttggcttttaaactatgctcgcataccgtccatgactagctcaaaaccaaaaagaaatcagtagtgcagttaggttacaaagtccaaacacaacaggagatactattaaaaatactgtttgaattgaaaattttttttaaaggtaagaaaaaataaaaatgctttttagaatgtaaagatgtaatcaggctctgttttttttttctttttttttttccattaatctttctggagaacctagatcctaagtcgaaaaacctactgaagtatatcacaacctgtaagtaggtacagatgtctgaggcctatttagaacaacagtgttagaaaggcgcttccttacctgttagacaaaggcgacttccggccaaacccaattgcccccaggatcccagagctgagtctctcctcagccacgaggttctgcctgctctgaaccaagagcagaattcgaatgacagattctgtcaggacggagtcattctgctctgtctgaatgagggagagctgaaggacttggtgccaccacaaaaacagctttgcctcttcctccacggagctaggggaggcaccggaggaaaataaaattagaagtaaatttttcccactcccatttaactgcaagtccacatcagagtttgaaggataggagacattcagtacttcaaaagcacaggctaacggctgatgttaatagagccatgggattgtaaccaccgccatctgtggaacacctactacacgccactgtgatgaacttcgtgttcttccacttcatcctcatgacagccctatcaggtagggattactatctccacttaactggtaaggaaactgatgcttggtgtttcaaagtgccagttttaggaaacaaaaaatctgctcagaagattagcctattaattaagaatctttccaaaacaactgtcaccataccttaaaaccttattttttatgcacctcttggttctgtgtacttaaagctagacttaagctctaaattccaagttaaccaaatacagcaagtttgatgtaacagcctgagggccaacgtaccttgggtacacctgttccagccacttgcttaagatgagcagcactttcatttcattccttaaagtctgttcgctgtttaaacactgaagcaagtagacgtaaagagtcaagtaactgcccaaggtgaggcactcctgcaggaactcttccatggtgagctcgggaacctgaagggataccagaatgggtccccatcctgaattctgattgagagggcctaagaacatgaagaagagacatcaagatataggcaagaatccaattacttgacaactctagcaaatattttcactttaagcttcatgatttttttttttgacatagcaacctatgagataataagcttcatgtcaagacaacctttcttacagtgaccttggaggctacaaaagtcaaatatacctcagggctcagactggatagccctcaggccagatgcctgtccccagcgtagccaccagaaaggtttaagaaatcagaattcagggctgcatacgtataaatcacctttctatcacattatgatccttaaaaccacatgtagacactgcctgtcctggtcagttaagaattttaactttaataccctttttaagaacatatgaacacttatgctttccgacgggaaactgttatcactcaatctgtgagtagttttacttatcaaagcttagtttaactcatgtattgaaactgtttgatttttagtaacacacatgagtttggaatagcagtgttatcctaatggttctccactctttgggggagcgagggtggggtggcatggtgacatgcacaccacctccatgggtgggcatgtgctgttcatgggtggtcaggacagggcagatggcaggttgtgggcacttcctggatccttgctccgataccctccttctcactactgcttctctcccactgactgcagtgtgatgtgttatctggatatcagagttgagaagtgctgttctcagcaattcttaatcagactaagccgcttccagagtctgacagtttagaggtagaaagtaaaacagatttttaaaaaggaggggtgacaatgaatgagcccttcataatgctttaaaaggtctgataagcagcaattttaaaaacttctatgaaaactccttttaccaaaagtgacaaaaacagggaaaattaacctcatggactatgattatatagatcctggtatatagcatttgttctgaggactatgacttggcctgtgacacaacacaatttgcatatcataacaggttggtctgaccctccaaaactaacgtgaagtggattagagcttttctcccttgaaatgtgattgtaccaacagacatggccacaggttctcatgctaactgcagatctttatgaaaaatacgtatattcagaaacatccacaacatttgtagagcagaaaattagaatggcaaatccctcactgggaagagtctggaaacatatctgctgatgacaatgctttcatctttctggaaaagaccaatacaatggagcgtaagatgacctcctcttactttctttgaagtaggcagtgatgcaggcttctgtagtctcagccatgtggcggacggacgccaggctctggcaggctgctgttaaaaggggcagcaccaccagcccatgcattttttggccaatccaggtccggatactgccccgaaggaactctgctgttggaatagtcgcgttgttcatcatcatcaggacttccataaagaggctgctgagggccatgtggcgggtctggctgtccatgtctgaaaggaatatagacacactcaagaatggctgccagaaaggtactatccatgtgatcaggagaataacagtgcttcaatcttagctgttctccaggcagattttacagtgctagtagctgactgcaagggactggaaggaaggctctggatggtgttaagtttgtacaggtagtatgcggcacacggttactaagagtaaaagcaggaactactgtgagttccctgggtacagcagcatagcagagcaatacttaataaatagacaaatctgaagctggtgtgaaagagtaacttatcagaacatgcctagtcagtctttattttccaacctttgctcatggaaaaccaaatacgtagatctcaccagtcattcagtaaaccaagtagcaaaagtacccactgtcactgccaccgctgtcaatattctagggtgatttacacacattaaaggttattacttaaaactaaatataaatgtaaggaaaaacctttgtaaagtgtcctaacagcagctcttttatttctttgttttttaaataaggaaagtaaaccaactggtaatttttcaaaaaaaattggaggtaaagagagaggaattcaagaaaaagaacgaattcattttacaagagaactgcaaatcttcacattcaaaaacagaaaatatattttactgagagttaaatggaataatttttgccaactcttctagctctcctcaagctgtagctttcacaccacaaggattcagtatttatgtcaataggaagggtaaaaagttgagagatcttactcatcgcatctatcaaaacaaattcatctacttatgcagggttaaataaaccctcacttaatctttctgtacgacctacttactatcaagcaaggacttaaaaaacaagtttgagagagatagtaacagtatatctgtctatttcttcatgtatttctatgggtacaaatattcttggaaataaaggctcatctctgaatttcaacggaatagcaatttaaattttatctcttaattatgactaataggaatagattactacaacagaccctagtctctcccattcctgttcatatcaacagggctctcaaatcttttcctaaataccatatctgatcctatcactcttccgatgaagatctttccagaacacccttctctcctttccctggccagctattattcaaccttcctggttcaatcatatctgaccaactctagaacagtttctccagcattgcttgctgatagtttttttccataagatttattgaatgtggctgacttgccaggctgatgctaaaattttagatattatctcactcaatacttacaatatctacatgaaacaggtatgaccattaacaacatttagcaccgtttcatgtttattggtgatcagtatattttcttttgcagaatgtcgtttcaagggtcttgtccatttttttctactaagttgtctttttcttccttgttttatctggtatgacaatcttagtcattcacagttattataattaattactgatgtagctgggtctaaatctactgtcttcctatatgtatcctatttgtccctcctattctacatttctttttctctcttttgcttcttttagatcattattctactttttccctgttttagcttgaaaactaaatcctctcttaaaattctgacagtggttatcctataaatgaaaacatgcattcctgattttttgaagtctaatgttaattggttcccagatgatgtaatggctttggaacattctaacttcatttctccactgttgccatagcccaacaaaccatttctattattattgtcttatacagtcagatttcatttagatttacccacacatttaccagtttcattgttcttcattcttagtttcttcctatttattttctctttattatttcctcccctctactgtctttgactgtaattttgccgtctttttaaataactgtttaatgcttatctttttaattttcaccttttaaaaaagtctatgatgagcacttaaggccctgaaagtaagtgatacggtttggatctgtgtccccaccaaatctcatgttgaaccgtagtccccaatgttggagcagagtttagtgtgaggtggctgaatatgggggtaggtccttcatgaatggtttagcaccatcctcttggtgctgttctcatactagagttctcagagatgtcgtagtttaaaagtgtgcaacatctccccccttgctcattctctctcttgctccttctctggccatgtggagtgttactctcactctgcgttctgccgtgattgtaagcttccttaggcctctccagaggccgagcagatggcagcaccatgcttcctgtacagcctccagaaccataagccaattaaacctgttttccttataaatcacccagtgttgggtttttctttatagcagtgtgagaacaggctaaaataataagtcccatgttagctgcatcccacaaattttgatgcactgtattttattattcagttgtaagtattttaaatttctattatgattattcctttggccatcagttatttaaaagtttgcttcttaatttccacagtgtttttccctctagttctatttagttactgatttttttttctttgtcatgcaacttcggggcagaaatacacagagatgaacatctggcttttacaaagttttctgccttacagatctatttatctgatattaatatagctatgccagctttctattttaatatttgcctgacataatcatcttgtggaaagctttctatatccttaggcttttgatgtatttcttatcaacagcttaaagctagatgtttttggttattaacctaccttaacaatctttgtcttttaacttaagcattagtccctttaccaatacatttgaattttatcatcttattttggttatttttctcactttctccatgcttcctttcttgccttctttggactgaacatactttggacattcctttttatctccctctactgacttggaaattgtacattttaatttctattcttttggttaatttcttaaaattgttaatattcatactttaatcaaggtataaagttaatctcttgaccactaaacagcagtagaaccttagaacacttttaactcaacctccttcctagcatgctttagtattttctttagtgacacctactgggacaaacactctcagggctcaatgaaagtatggttctttacctcgtcttcatcattaaagggtggcttttcttagtttacaattctaggttatgagtcattttctcatagcacattgaagttgttatcccactgtcttacagattcttttattgatactgagaagtcagctgtcagtctaaatgttgctccttggtaggtaatctgcctttccttcctggatgtaaagggttttgttttgttttgttttttaattttgccactggtacttctgcaggttcactatagtgtatacaggtttgaatttctttccatatatcctacttgggatttgctgggtttactgaatttgaggattgctgtcttcatcagccctgaaaattttcagccttgctatctcttcagatattgcttctccccagttaagtatctcctctccttctggaattctacttggataataggatgtatattaaaccttctcagcctatcctctatgccttttaacctcactttcgtattctttttattttagagatggggtctcactattttgcccagactggagtgcagtggctattcagacacaatcattgcacactgtggcctcgaactcctggccatcagcaatcctcctgcctccgcctccatgcccagctcacttttacgttccttctctgttcctctgtgctgcaatctgagtattttcttcagttttgttttccagtttaccaattttctcttcggatgggtttaatctgttgaacttatccattaactttattataatctttatatttttcatttctaaattatataaatctctcaaatctgcatatttctacaatcccttgcttcttactgatatcttcaatcctctcttatttcagcatataataaaaataacttttttgcttactgtactaattattccactatcttcaatcttttcatttctgacgctgctgttgttttctattactttgctcatggtaccttgtttcctgtgttttgtgactttttttactgtgagtttcttggaactttgaggcatgagttaaagatgcgtttctccaaacaggagctatggttgctttttgccagatgctggtggcaccgccaacccagaactactctaaattcttagattgaggttgttgttattactgctgtttctaccaatctaggtagtctgaattcttgcttcaaaaccacatgagggtcagcttgttatcaattctcaaaacagatatctcttttcctgcataaacatttaacctaacaacgaggccaaaacaggtaactgtctttgccttcctctcacaagaggaggtttacttctagcttatctttacagtaaaaatgtcaccctgtggattatgcatcggatttccttttaggctcccatcttaggcaggccctgggctttaccacctccccctaatatccaaacatattcagcaaaactcttcagggtgacagcagcctcagaactccacctacctttatgggtttctcctttcacttaggttctggcctctgaggttcccttacctttttgccactccactaataaatttaatttccagtttcttaaaaatatttcatccagcacccagttatcttcagcaggagaggcaggcagtatgtctagtccaccaaactgctgggagcagaaggttctccagacacagtttcttgacaagtctacaggtgattctgaagtgccctcccagttaaaagccaaaatccctagaaatgccgctcactgaaaggtctctgatatctcctaatcattagatcccattgtccagcttaaaggtcagtctcgcccaccacccaacagcatctgccagtgtcaatccttccccactgctgagtccctggtgtccaaacacctctctgaccattgcttctctggaaagaggagtgccagtgtcctgaacatcctcctgatctcacagtgccttacgcacagcaggaatgcattgactgaatgaatacaggacttccgactggtcacttaccgggcgggttaaagacaatgatatcgtctaagagcttagacatttcctgttctaggactgctaaggtgatttttccattttgttccagggtgctgaggaattgaaccatctgatgagtaaaagcttggcattttggaactgcatcctgaccaaaaaaaaaaaaaaaaatcattcaaatgaatccaagcaaggagtgttaactgcatatttcctgggagcatggcactgcaatgaatgcttgggtagggagtagaggggacagaacaggaagccacatgaagacttagtcccacgtggcccaaggggcctagtgaaaggcaaatctatggtaacactttgaccagggcccatgttttcccaaattgtggcagaatactcttccttttttactacaagaataacaacattaaccaaacactaactacttgccagaaacttttccaaaaacttttatgttcattatcgaattcaatcctcaaaacaccactttgagacaaggtactatttctttttttttttttttgagatggagtctcactctgttgcccaggctggagtgcagtggtgcgatctcggctcactgcaacctcctcctcctgggttcaagcgattctcctacctcagtctcccgagtagctgggaatacaggcacctgccaccattccccggctaatttttgtatttttagtagagatgggctttcaccatgttggccaggctggtctcgaactcctgacctcaggtgatccgcccaccttggcctcctaaagtgctgggattacaggcgtgagccaccgcacccagcctttgcaaggtactatttctaatcagatgagaaaactgagggacttgccctgtcaagcctaagttcatattaccaacctcccttcctccctgctattctgctgccaatgacattcagatcatgaaaccagcagcttgctggcagccctcaatccttttgacctttcatcgacatgtgacattgctagtaagtaaaagttcacccaaagggagaactcaacccaaaagatctacaaggccaaaagatgagtatatgataatacacatcctccgacttcctctgctgagcacttcctagcttcgactgtcctttgtagcacttatgctgctaccaatctccaggaacagtctctgccttttaaactacctctcaacttacaagatgcttctggctgtcagtaggaatagaaaggcccgcagacacttttaggagcttcatgattaattcagcataagattcttttgccaggatgatggacggcgggtaatggctgctgaaataacttagcacactctggtacgacacaatatccacaagatgccatgaaagtgagcttgtctgtccaaggagactaagtaaaggtgaatcctaaaaataaaacacatattcctttagttccagagccccaatttttccagaaatatgtgttgctaactagtctgtggaataactactaagatggcctatggtaagcacagaacagttatgatatcaagtaagtatctactcgagttaggagtactagtgaaagcaataaccaaacttttggcaaaaacacattcatattaagatgtattgagtatctggaacccaggttcttttctttcaaaagaactccctgttctggtgggacatgccaaaattgacttcaagaagcatacaagagattgaagtagatattaatgagatacaaaataaagttgattaatacattctaactcagtgtggttctttgcataatttagaatcagataatgagctatccaagaaaatcaggcatctggttaaaggtacatctcatatgccaagcatctgttcacactgataggggcactggaaaaacaaatgaaaaactacgacctagtagaaagcaaagatctaagcagccttgccgaatttttgccataagcttcccaaacttactgtttggtctaccagttgaacttcctttgccaataaaatcatcatgaaaaggaggcagacaatcatgctgcgggtttctgggtggggactggaattccaggcatcagagagcacactaacccagttgacttcacagagtacagaccccaaaaataagaaacagctcttggggcttcctcgttccacctaaaagaaaatgaattaaaatcattctgttgccttgtgctatctatgtatctggaaaatgtatgtaaattgtttcataattatgtttttaaaaaacactttttccccagattatatcacttagaatcccacctcctagagatttagacttaatatttgtaatatctttccttccacagtgtatgtgtgtatattttagtttgtctgttcagatttcagcatttattccaatcattcttaataagcgaggaatgaccttccctaaccccaacctgggtggagaatcgctgccacagtaagtcactggagctgcagggagtgtatcagaatcctcaggtgtgccaggacagggcaaagttgaaatttactagtcagtagttcccaaacttaagtgtgcatcagaactaaatggaaggtatattaaaacagactgctgggcctacccctagagcttttaattttgcaggtatgggttgggagccagaatgtgtaagttcccaggtaatgctgatgctgctgtcccagggaccacactactttgagatccactacactagtgtatattatttatattgcctttttcctttttcctttttttttttttttgagatggagtttcactcttgttacccagattggaacgcaatggcacgatcttggctcaacgcaacctccgcctcctggcttcaagcaattctcctgtctcagcctcctgagtagctgggattacaggtgcctgccaccatgcccagctaattttttattttattattttattgcttattttttattttatttttagtagagtccgggtttctccatgttggtcaggctggtcttgaacccccagcctcaggtgatctgtccacctcagcctcccaaagtgctgggattacaggcgtgagccaccgcgcccggcctatattccctttttaatgtaatgctgtattataacaatgtctccgtattattagtctttacaatttttgatgactgcatgtttaaattctatttaaaatatgagaggccgggtgcagtggctcacacctgtaatcccagcactttgggaggccaaggcaggtggatcacaagatcaggagattgagaccatcctggctaacatggtgaaacctcatctctactaaaaatataaaaaattagctgggcatggtggtgggcacctgtagtcccagctacttgggaggctgaggcaggagaatggcgagaacctggaaggaggagcttgcagtgagccaagatcgtgccactgcactccagcctgggtgacagagcaagactccgtctcaaaaaaaaaaaaaaaattagagaatgaggaacagatgtactataaagtatataagaaacctcaaagatctcttacaagctatttaaatacttctaatttgtttaaaataaaacatggctactcatgaatttttcctttcaaaatgaagattaaaagctctagtctatttataaaatcatgatcaatggaatttggtgatgattcatttcttgtcattactgttattatattatgctaactactaattctcttccttttagaaaatgattcttcattgtccattataatctgttctctatcctcatcctcaaccccaccaaaaaaatatagtttattatgccaacaagacacaaagaattaaaagatccccagcttctggggtggtcagggtcatctgccattagaataaaactcctagagacagagtctacagcatcccttaacaggctgtgctactatctaatctgtcttatagttaaggtcatcctttttaaaactccatcttatagttctttaaaccacctttctctagtatgttcataatggtgataaatatttacttaatgcccgtctcatatactaaatctagctataaaatcattcttaagcctgggatttctctagaacaactgccctcagcttttcttgcatttcagctactgagtggctgacaagagcagcacagatggggttccattaagggcactaaaaaagttaagtatattttgctaaccttcataaataactgtagatctgtatcaaagcacttaaggtgtctcaacaataaatgtgacagtaagagtaaacactaactgatgagactatgaacaaatgaactgaaactaccataaaaacctaagacaagagtgtaattaaaaaaaaaaaaaagaagaaaaacaacaacagctccaaatgcctgactagtatgtaagttacactacactctctgttttctggttttgtaaccattgcttctactgcaaagactcgcatgcactctctttttttaagtcatttcaggtctgcacacgattatgatgcatcatcggttgtcacaatgcattttatctcctataatcaaattattcacttgcataactgctaaaagaaactaatagcttcagtaccaatttacatttgctttaataggacatttaacgataagcagttgttgacacaaactgtaatgacacaaacacatcaataacaaccaagattaagcataacggaggcattaaactacgtactcacacgtgacaaagtctaggggatgactgacatattatagataaaatctttctctgggttttaaaaatggtcctgtagatgttttaacacgataaaatgacttccacaagacactgttttccacaggcaccaccgaggcaacacagaatgtattcatggtccacgctagcacacactgccactatgcctaacaaccacagtgaccaggctgctccctagaagccagatctctctaggctgcgatgccgggaatgaagggcttactttgaagaaggcctccatgagcatctggtcagggtgcaggtccttccatggcagtttccggtacgtgctatggaaagcgtacagaatgaactctggcattttgggtgctgtacatgcttcacaataatgcatcaggtgcaaccaaagggctcctgcatcacctggcaacagcttatctagaatgtgaaaagaaaatagagctgaagacctttggtttaccttaaaaaaaaaaaaaaaaagcaaatttgaactaaaagtctaaaatctaaggttctcatgattgacccaatttcaaagattttcatgtagggagagtggttaaggggactactggcagattagtaataaagaatggtactttaattacccactcgggtaactggaatgagcagatgctgtgtgggaaataatcagcttttctttaaaatttctaaacgtatggctttttaactgaaatacactcctacagcttgttgccctcagtatgtattcagttttacacatttagtgcttcattcatttggcactcaggagaaatccaaaatccctcaaaaggaaatgttccattttttaaaagaaggcatacaaatagccaataggtgcatgaagaaatgctcagcatcactgatcattagagaaatgcaaactaaaaccacaacaatgtatcagtgcacagctgttaggatagctgttatcgaaaagatgaacgataacaagtgttagagaggatctggagagaaagaaactcttaaacactgttggggggagtgtaaattagtacaaccattatggaaaaaggcatggaggttcgtcaaaaaactaaaaatagactaccatatgatccagtaatctcacttctgggtatatatccaaaagaaaggaaatcgatagggagaagggataaccacactcccatgttcactgcagcattattcacaatagccaagatatggaaacaacctaagtgtccttcaaaagatgaatggatttttctaaatgtggtgtatatacacaatggaataccagtctgccttagaagaggaggaaatcctgtcatttgcaacaacatgaatgaatctggagaactcatgctaagtgaagaaaacgaggcacagaaagacaaatgccacatgctcttactcatatgtggaatctagtaagttgaactcattgaagtagagaatagaatgacagttaccagaggctgtggggtgtcaggggaaaagggagggaatgaggagttgctgatcaaaagggcacaaagtttcagagggcaggaggaataggtttcaggatctattgtacagcagggtgactaccgtccacaacaatgcattacgtatttcgaaatcagaagagaaccaactttaaatgtctcatcataaacaatgaaaggtaagcaaggtgatggatatcttaattatcttgatttaatcatgccacactgtaaatcacactgtacccatcaatgtatataattatgatttgttaatcaaaaataacattaattttttaattttagaaacggtggaaatgttccaaatgactaaaacttaattaacccttggtgcaatgaaactagtccattaactgtcattcatgtaagtcattctaaaataaatctcacgcttttctgagacctggattattactcaatattatcctcacaagtatcaattccattaatgccttcaagggctaatgactatataagggacatttagtctaaaacaagtggtttcagactttctggttccatgctaatggaatgcagtcaaagaagagagagccacacacagtaagaacagaaacctgatggtttctcaacacaaatcttttaaaaaatggccaacgaggctgtgtgcagtggctcacgcttgcaatcccggcactttgggaggccgaggcaggcagatcactttaggtcaggagttcgagactaacctggccaacatggtgaaactctgtctctaccaaaaatacaaaaattagccaggtgtggtggcaggcacctgtaatcccagctactcgggaggctgaggtgggagaactgcttgaaccagggaggcagaggttgcagtgagccaagatcgcaccaccgcactccaacctgggcaacagagtgagactccttgtccaaaaaaaaagccaatgagcatcaacacattgtaccagacaactctcatttctaacatgcttgtaccctcaattccacaacccggcatggaacaggaatgcacatttttaacaacctttaagacagaggttaatgatagcattcgtttaaatatggataaaagacagttttgtttagataaagttgggtaagtatgtagaagatatccagaaggatgtcttaggatagactgagctgatagttccagccaagacacaaattctgtgacgtcagataaattcttttcattttcaggtccccacttttctcatccatagaaggagctagtggatcagataacctcactaaaaagctgcaatacttcttcatcctaccttgcaaagctctcctgtttcctttctttgaacccagctaccaagtcttgatgtctgtgaacccttctgtcctatgccactttcttattttattcatatacaggggcaagagagccttggggtgctttcccctatactaagaaattaaatatggctgggcatggtggctcatgcctgtaatcccagcactttgggaggccaaggcaggcggatcacaaggtcaggagttcaaaaccagcctggccaatatggtgaaaccacgtctctactaaaaatacaaaaatcagccgggtgtggtggcgggcgcctgtagtcccagctactcgggagactgaggcaggagaatcgcctgaacccaggaggcagaggttgcagtgagccaagatcctgccactgcactccagcctgggcaacagagtgagactcagtctcaaaggaaaaaaaaaaaaagaaattaaatatatagcctttatgattataatttggtgctcaaatctttttctcagtaatcaatatattctggatggtaaaaagcagctagaagtctgcctttcaaaaaaataattgagtactactaggatttcatgtgttactcattgaaccactatttatcaaacacacactgagaatatggcattaccctagttttgtagggagcaaaaagaagcaaagaataacatttctgttattctatgaagagtttacacctcttcaaggtaagataagatatataaaagataaatcagaaatacaaataaggtacagccagacaaaatgaaatgagctatccagccatgaaaaggcataaagagacttcaatgtctattactaagtgaaagaagttaatctgaaaatgctatgattccaaccataggacattctagagaaggtaacactatggagatagtaaaaggatcaggggttgaggggagggagagatgaacaggcagagcgcagaggatttttaaggcagtgaaactgctctgtatgataccacaatggtgggcacatgttatttgtcatttgtcaaaacccaccgaatgtgtttaccaagagagaacactaatgtaaatcatggactttcattgataatgatgccttaatgtaggttcatcaattataacaaatgtatcaccctggtgtggaatgtccagagtggggaaggcttgtgcatgtgtgggggcagaaggtataaaggaattcttgtactttccacttaattttgctgtaaacctaaaactgctctaaaaaataaagtccgttaaacaaaaaataaaatctattacaaaaaaaaaacaaaactggatgacatatgcttaactgtatgtattagctcattttcacactgctgataaagacatatccaagactgggtaatttacaaagaaaaagaggtttaacagactcacagttccatgtggctggggaggcctcacaatcatggtggaagatgaaaggcatgtcttacatggcagcaggcaagagagagaatgagagccaagcaatacgggaaaccccttatcaaaccaccagatctcatgagactcattcaccaccaggagaacagtatgagggaaaccgcccccatgattcaattatcttccactggctccctcccacaacacatgggaatcatggtagctacaattcaagatgacatttgggtggggacactgccaaaccatatcactctataactaaatgccacacaaacacatggcagccacaggggcactaggtgtattcagtggaagaaaacaccatgggccagaagcaaagaggaagccagagtgttaaacagatgctgaaaccagccaaccgaggactatttgcctgctgagttttaacagcacaagaggacagaacatgaggttttctaaggactatattcttactgaaagggtagaatggggcaaaagaggaaacttctctgccttaccctagattgtgagtcaggagagatcaaaaagtttactgtgagaattgaggccagcccgcaagtgagtttggggtttcatttcatgtaactggtagcacgggaaaccccaaaccaagaagttaagtagttccaattgacaacaaatgtagatcctctctggaggacttacacaccctcagcctaggccttatgagattcccatcagtctctctaaatatgggctcacaatacaaaatttaaaaacacacaaggaaacatgcctccaagaacaagaatccaaaggaaaattaaacagcagcataagacaacccccaacaggaatttcagataatagaattaatgtacatacatcataaagtaagcatgtttaaacaaattctaaggaaataaaaaatagaattttaaatgaaagaaaagatactaccaaaaaggatcagggtacatttgaaaaacaaacaaatagatctagaaatggaaaaaataatcacttcaatgaaaaattcaattgatatattttaagcagatgagacagagctggagagagactaaagaaatggaaggaagacctctagaaattacccataataaagcaaaaaaagacagaaaatatgaaaaagaggttaagagttagggaggacaggaagaaactcaacatgcaggacaggcaatattggaagagagaaagactgcaaatttaccataactgagaaactcagagcaacctaacaaaaaaaggtaagaagttacacacctaaaggccgggcgtggtggctcacacctgtaatcctagcactttgggaggccgaggcgggcagatagcctgagctcaggagtttgagaccagcctgggcaacatggtgaaaccccgtctctactaaaactacaaaaaaattagccaggtgtggcggcatgcgcttgtagtcccagctactcgggaggctgaggcaggagaattgcttgaatctgggaggcagaggctgcagtgagcccagatcacaccactgcactccagcctgggcgacagagcaagactccatctccaaaagaaaaaaaaaaaaaaagttacacacttaacactaaataattgtatcagcgacttttcttcagtcacaaataactgcctattaaataaaaattaaatagaggaaagtagaagaaaaagactgactgacttagggaaaaatgaaaactaagcagagacagcctgacatcttcctacctttaaaactctcatgcagtgagtcaatacagtcagtgaacagctgcacaatgcttgaggccaccacagtatcactctctagccaggggtaatgccgctgttggctgctttaaagaaaagaagcacacacttaggaatgcaaccgtgattaaaatactgttaagtcccagtgtctagggctggcctaagtcctggaagcctgtccattatgtaggcctgacacacatttagaatacttaaaaggctgtaaataactgcaggcgaattgtagcttgtaacaccagccatataattttctttcatctccttcataccctttattccaatgcaattagatttcaaaaatgtgctatctaaataacccttaaattaacatctttttacatcaaatttagacccttggacatcttggttacatttcaaatgccgtagaaaaacaccctaagtcagcttcaacagttttctctactcaaagcattaaaaaaaaaaaatcaaattcacataacaaagagatggccaaatattaacaaatagaaaatgagcaaataaaatttttttttttttgagagagagagtctttctctgccacccaggctacagtgtagtggcacgatcttggctcactgcaaccttcacctccagggttcaagcaactcttctgcatcagcctcccgagcaactggggttgcaggcaccgaccaccacatccagctaatttttgtatttttagcagagacagggtttcaccatattggccaggtttgtcttgaagtcctgacctcaagtgatccacctgccttggcctcccaaagtactgggtttacaggcatgagccaccacgcctggcccagagaaattctttatatgaaaaatttaattggctgggcacgggagctcatgcctgtaatcccagcactttgggaggcagaagtgggcagactgcttgaggtcaggagttcaagaccagcctggccaacatagcaaaacactgtctctactaaaaatacaaaaaaaataaaaattaaaattgaaaaatagctggacgtggtagcatgcatttgtaattccagctactcagggggctgaggcaggagaatcgcttgaacctgggaggcagaggttgcagtgagccaagatcacgtcactgcactccagcctgagcaacagagtgagactctgtcttaaaaaaaatttttttttattttctgaatctggtctagaaaactcaatatccaaataggttccgttaattcttactggaaataaacaagcagccagcactatggtaagcagtctatatgtacacagtcactataaaatcctgaagcttgcagattattcagatagccctctagcaaaagcaaacattcagaaccttttatactttccttaagtggctcgtaaagcatcatgggttaatgcaaagagtctagaaacagaagtctaagacctgagttctagtcgcagcttcagcactaaccaaccagctatgagacttgagtttgacattcatgttctctgagtctcagaatcaaattcaagtttttgaaaacaactcctataatgtgatgtttaccactgtcgtaatttttataaaaccctgacaagttcaactagcttctgcttgtatactttcagggaaaaaaaagactcagaaggcaactcactgaatttggacagctctatacctctaagtatttcaaatgcttgtgaaataatgctttaattgaagagtcctagatttaaaggtaattcccacccaataattttatagccaacttagttccaaaacacaactgatgtagtagagaaaaatcagtctcataaaaccctcaagcgaacagcatcattttttctgaaattaaacactaaagtttattcaacctcttattgtggaaaactggaaatgagtgtccagttttgttccaaaattattatcaagataatatctctgatgatccagactagcaattccataaatagaaaatgtcttaagttttgaaaagaagccttttctaaatttaaatatggccttacactaaaaaattaaatctgtgaactcatcacttctaccaaataccatttagaattttaagtctacaaacgtcaaaggaatttgaatatctaaaaaactgtttacctttcgttgtcctctaaaaccaggatccatggcttaaagagctgaatgattactgaatgtagggatttcagcactaaaaagttttagagacaaaacaaaggtcatcatttgtcatttgtcaatatcactgctcacattatatagaaaaatctacctcttattatctgtagcttcataaacctatgttaatgtataaacaacatgcttagtgtaactatgtatgtttacgttttcattggctacactggaatttctctgaattgaagaatttgtattacaatacaatatcatggataattttataacacacttttaaaaaagataaatgtataagatttagaaccccatcttagtaagacaaatgacagaaagggttggaaactgaaacctctctgtaccccaacctgcaaaggaggggcagagacaagctatagcaagcaccctacattcactatgtaatgaatatatccattcatatattgtgacatatatgacacatatatgggctcatgcctgttctatatatttctactttctctccttgacactcaatataaatctcttaatgtgcctatttaaatctctcttaatggaaagtccaaacacctagctccacatcgcatgagaagtatattacctgttttcctgctggcagttgggtcttgggccaaacaggtcatttctaagtcaatcagccttttcacaaggtagcccaagaatgtcttcacatcagccatataaggactccattttgagaataaaccaaagcttttaaagtccatcttggataaccgaagcttataaaaaaagtctgaaagccactgtatagtctccattacctggaagagacaactagtcaaaaaatgcttactaaatatgtattttagtaaagtgttatgatacactgtgatgggggtgtatatagtaggtctttgactttataagagagtggcaaaaatataaagcatatgagaaataaatcaatggttttttgtttttgtttttgttttgaggtagagtcttgctctgtcgcctaggctggagtgcagtggcacgatcttggctcatcgcaacctccgcttcctgggttcaagcgattctcctacctcagcctcctgagtagctgggactacaggcgtgcaccaccatgcccagctcatttttgtattctttagtagagacagggtttcaccatgttgcccaggctggtctcgaatccctgacctcaagtgatccgcccaccttggcctcccaaagtgctggggttacaggcatgagccaccgcgccaggccatcagtgggtttcaaaccttttctaaatcagtggaaccattatttcaaataaattctcatgcaaatgcatatcaaacagaaaggataaaacccagagctccatgggacactgcatcatagaaacccgaccagaggtctcagggtggagtccgatgggctagggtgggcaggaaagatctacaggggagtgcctgcccttgtcttggatacatgggcaagaattagactcaggggaatggggtgagccatctggaaaaaggggacacgagggaaccaaagcacttaacacaaagaaaaacacatggctcttaaagataatgcacaagttttccaactgcttaaaaaatgaatagcaagggaaataaaaagaaatgcacaaacacgtcagagaccaaaggctacacacctgcttgtctgacaagagagcatcagaagagctgggaagcacggcgccctcggtggacgctgccccctgctggcagctgggggcgcagcagcccagggctctcagagtggccttccaacactcggggctcagaagctgctccgcggagcctgccagcagggacaggaagagcaagtcagtggctttcccgaaaggaatattttaacttgtaacaaagaatatgagcaccttataaaggaataaaaataaagccaaaatccaaaacaaactcacagggatatctggggtgaggaggcccaagtaaagagaacctaagagaagaactggccacctgcacatttggttttcctggttcctggtaaccctgctgggagtgagcgctgctgaagctggtggagctacactcagaggggtgggagacctgaccctccgaccctgactggggaatggtggcagtgcctctcctggctgggggaccacagctatctatgagtgtgacagaaacaacagtcacaggacaacggaaaccacatgatgaaggcaactcagggcctgggctctccagaaggagtctcctaccggccccccaattccccgaaaccaagacccagaggcagcatggaaacgctggacaagtccagcagcccatattctgaactagtcccaactctgctacttaataacttcccatcccacaggacaggaataatatctcctaaagtactttccacccagagcgaacatgagaatcaactaaaataacaggttcatggagcaggtctgaggagaacgatggtgaggccagttacaatatgtccagtgtgaggtacctggggacagtgccagtctgtgtccaatggccactggggtctggatcttaggacagcgccccaaaattaagctatcactggaaatcacacatgcctagaaggtggcagtgacatcagggaaaacaacgggctcacccagagggaatgaatgcagtagaagagcaaaggatgctcccaagggaacatcaacatggtagccaaggaggagaaagaaaccaggaggctgaagctcatgacatctgagaggtatcatattgttattcttaagtctgaattacttttcttggtaagaacaaatttctagctaaattccagtcaatagtggtctaatataaatggtttacaatctctttaaaagatttcagggaaaaatccacaacacacactatttgaaactttaaaagcttagagaaaaaattagctatgcacatattcattggcatttgtacaaatgtatttcccttccaccattctccacccaccctgcaacctgcctctgtgggaaacaattaaagcttgaagtgctttcaaaatgagaggctgcacatttcaaggtcctttgggcaacccgatacactggatcattaacttatccattaaactatttctatgatgtaacacaaaaatttggtataaagcaaaatttcatttgctattatatctataaaccgtatgaagtttgcattaaaaagtaaatactatctcatttatcaaattttaataaaattactgcctagcgaaactccaaaaataaaaaagcctaccctatttatttctcctctaaactctaaaattgctatagaaaattgtaagaagggggaacagaagtggcaggaatgtggagattgtaatgctgctctttcccttggtaaatataaataaagtctatcattacatatggataaaattaatttgcaaaaaacaagagtaaaagacttagaaaggaaaaactcccaaaatgtttggaactacagagaaacaaactgtcatattaaacatatcataaggcacaacctccttgctttgccagatctgtcgtctgcagagtaagccagtcctttcccaccccacttcaagacagctgaaaagtcaagacaaagaagtacctgcatgactgtggactccaccaaactggaggtgctgccttgcccaattagagcccattctcaaatttagaacaataactggccatatttacagtaacaactttttgggccttgttcatcaagccctttagatgacaattagtgattctaaactcctatactggtattactttcatatctttgaataacatctgtaagatgaaaaatgtgatattaaatattcactaagatctagttagttacaattaaatgaagacacttactttgcataagcagcctgagaatgtcactgtactggtcaggaaactggtagagaagaagataagtccagtgcttacagaaaagattaaatggcatcaaaatatcctcatctggttcaaggccccaggcagtaagtgccaagtgaatggactccagaagcctggtacgatcagacagaggaggtttagtggcgcttaaccattgtttaagatcgaactaaaaagaaaaagaaacaaaaagccgttttatttgcactagaaaaatagtttaagaggagagaggtctgtgtaaatttagtttaaaagccaaaaattacccagcattttataaaaattgaaattaaaatgtataaacaagtacataaaagattcaacctgaggaagctaattgtaaaataaataaataaataataaaaagagaagtacataaaagaatataagaagttcactaattgggtcgggtgcggtggctcacacctgtaatcccggcactttgggaggccaaggcaggctgatcacctgaggtcgggagttcaagaccagcctgaccaacatggagaaatccggtctctactaaaaatacaaaattagccaggcatggtggcatatgcctgtaatcccggctactcaggaggctgagacaggagaatagcttgaacccaggaggcggaggttgcagtgagccgagatcacgccattgcactccagcctgggcaacaagagcgaaactgcgtctcacaacaaaaaaaaaaaaaaaaaaagtagttcactaattggtgccattatgcatctatttctgtgttactatctagaatctcagaggcagagttttctaagctctgtgtgcttttcttgcaatttaaaaattttactgatgattcattattggcttataattttatactgttcctcagagtctcatacatttctgtcttataataagtttcctctccaagaactggatcagaacttcgtagctctccttcactggcgacagtgccacaaataagcagccactttatggaactgtctcaatttaacagccatgtttctggtctgcatcagttacctgtctcagttaataaaattcagactgttgatattcccttccaaaatcccaaactataaaacatgttctcctccattataggctgagatcaatctgtaggccctaaaattgtcaaggttgtctttttttttttttttttcacaacaggtctcactccatcacccaggttggagtgcagtggtgcaatcacagctcactgcagcctcaacctccagggcttaagcaattctcccacctcagcctctgaagtagctgggagtaccactagcctggtgtttttttttttttttttttttttttttgtacagacagggtttctgtgttggccagactggtctcaaattcctacgctcaagcaatcttcatgccttggcctccaaaagtgctgggattacacataggagccactgcacccgaccaaaactgccaaggttttgattcatagatgtaacagaaatacaagtgaaggcaaagtagctaagactctgaaattctcaactgcttaagtaaactcattaccttggtctaacagagttaatattctaatgttatatactaagatattaatataaaatataatattaatataaaataaaatattaaagttaatattcagaatgagatcaaaggcaatttgcttagatccagcttattctaaatatgagagagactaacaaaacctttgtcaaacacaatttaggcataaattcaggataaattttaaaaaaggatgtactaaactactattatgaatattttcaaaactgtattaagtttttaaaaaggggtgggaattaggtcctttttacactaagtggaataagactaccctatacaacagggatccccaagccccacctcctgtcagatcacccatggcattagagtctcatagaagtgcgaaccctattgtgacctgtgcatgtgaaggatataggttgcatgctccatctaatgcctgatgatctgaggtggaacagtttcatcccaaaaccatcccctctactccagtccatggaaaaactgtattccataaaaccggtccctggtgccaaaaaggttggagaccactgctatacaagacaaccaatgccccaccccctaagaagcagctgtggggtcagactgcttgaagctcatgcaaactgtgaaaaaggcctctcagcctctgctgtacctggaaacaaaactgcagaggtccttttatttctgtagaggaggaagcaacaatcattcctacgtttcaacaatatggtgaggatggaattacatcttaccttggttagcagcatgaaaatcatatcactgttgtcctcacttagaaacttcaccacttgctcatacagctgtatgaactctgcaggtgcagcattgggagtgaagaaaggagacagcagggagcagagcctgctgttcttcagaatggtttcaagtacttttctgcactctgatttaatgccactgataaataccttggaaaaataaaaaggaaaaatgtcaccagattcttccctcacaacctttatttaagcaagcaaatttttaaggggcaccaaataaggtgaatagaatttttttctaaacaaaagtctgaaacaatcaaaagacagctaaaatcaacatagataagcctattgcttccaatggaagtaatattagaaattctgaagaatccataaatctgatttggacaagtcacacagaaaatgctgagttagtccgggtgcagttgctcacgcttgtaatcccaacactttgggaggccgaggcaggcggatcacctgaggtcaggagctcaagaccagcctggccaacgtggtgaaaccccgtctctactaaaaatacaaaaattagctgggcgtggtggtgggcacctgtaatcccagctacttaggaggctgagacaggagaattgcttgaacccgggaggcagtggttgcagtaagctgacatcacaccattgcactccagcctgggcgacagagcaagatgccgtctcaataaagaaaaaaaaaatgataagttaactatactacaagacttttaagacattaaaatattggggtactttgaatccacaaacatgcaatgtccccaccatgattactacagtacccaacatggtgctgcattacgtcagaaaacaaaacttccaggttatagattttactgagagttatatttaatacctgtcaaaaactaacttccataataatatataatcaagatgacgtcatcttgttttaacttggttctaatatttaaaagtacagaatataagcaaaaattgaaacaatttcaccggcaggaaggctttcatatggttgaccacaggcggaaataataaaagaacaagactgataggcttgaatatattaaaattttaacttctataaggcaaaaatatcataaaattaaaggaaaaaaatgacaaactggaaaaatgtttttttaacacattccagatgccaggttaatagtgtgaggagctctttcaaagcaatcggaaaacaagaatctccaacagaaagtgtacaaaggaccacaatcaccaattcacaaaagtatatataaatggccaataaacatatgaaaaggcatataacttaacaagtacttaaagaagtacaaattaaaataataatgaaataccactcccttatcagattagcaaaacttaaaagaatgagagttcctaatgttggttatggtatgaagaataacaaactcaaacactgcaatgatagcataagtaggtgcaaaattcccagggaaggcagagtgactatgtcaagcatgatgtaaaacatcaaatatacaatgtgtatcaaattcctttgacacagcaatcatacctctaagaaattatcctaaagaaaatagtccaacaagttcacaaagacatacaagaatatttacctcagcctgattgcagcaaaacaatctacctaaatatccatccatcaaacactagctcaacacactgtaataaatctgtatcatggagcactatacagacatgcaatgtcatgatataggtctgtatttattaacatgaaataatgtctaaaagatgtgtttaaatgaaaaaggaggttacaaaatagcatgagcccattttaagtgcctatccatatctatatatctctatatatgtagaaatatgtttacatatacatatacacaaatagacacacatatacaagacaaactataatgaaatgttagctatgtagtcagtatttctaggtagttaggattataagaaagttttcttcttcatactttctatgctgtctgcattgcttataataagcatacattaattttttttttgagacagagttttgctcttgttgcccaggctggagtgcaatagcatgatttccgctcaccgcaacctctgcctcccagtttcaagtaattctcctgcctcagtctcccaagtagctgggattataggcacgcaccaccacacccagctaattttgtatttatagtagaggcagggtttcttcatgttggtcaggctggtcttgaactcccaacctcagatgatctgcccacctcagcctcccaaagtgctgggattacaagtgtgagccaccccaccggaccagcacacattaattttatgatcaggataaaaaacttcctacaaaaaaatcaatgatgatacctgttcagcattacttccttgtaagcatccaataagtaagtactcattcagttgaatttgggtgagagtacatggttaactagtgtttacatatttcaaacaagaggttttcctttcttttatgaaacatttcataaatctgtatgattacccttacccttattaaatatctatctatgtcactgtaagccaaataaataaataaacaaacaaataaatgttgaccaagactagcaaccgggacacagcagtggggaggtggagcaagcactgagtgttgtcagaagccctgggatccagtctcagctccacactcaccagctgaattctttaggccagtcacttaatcttctagaacctagttttctcatctttaagaagggaatctcaatcacacagattccccatgaggattaaacaaactgggaagtatttttataaacaatgaagagatttagtactgttattgttaagaacaccaaggatatatgacaagttctgatgtctccctagactttcaaatatgaataatctcccttgtatgagaagcaaaattctataccaacaattctaatcatattttgagaagcctacaactccaagaggcttctgacttgggtaagactctgaacctgtaatataagtctgaagtcaatgctgactatatccaaagaagacagacaccgcagagactcattatctgatcaaggcaaaaggtacagatagccttacctgtcccaagatctcaatacatgaagtaaagaactgccttgttgggggatgacgctgcgtctcatcgctgacgtaatccacaatagtaaagaaaaggctaatgccaactttctgaatcccaggtgtaggctgcaacttgtaggcattcactaaggccctgtgggaaaatgtgggtaagactgcagtctacagtaaaagattccatactcacaaggccttctttgataccctacaatttctcaggcaatattcttaagaatcctcagagcacccatgaaaatgtcactttagaaatatttcatggagtaaatatatgtatcttccaattttactgacaactgattttctttttttttttctttttggggtgggggagacagagtctcactctgtcacccagactggagtgcaatggtgtgatctcggctcaccacaaccttcgcctcccgagttcaagtgattctcctgcctcagcctcctgagtagctgggattacaggcacacgctaccacacctggctaatttttgtatttttcttttatttattttattttatttatttatttattttttgacggagtctcactctgtcacccaggctggagtgcaatggcgcaatctcagctcactgcaacctccacttccagggttcaagcgattctaacacctcagcctcccaaggaactgggattacaggcagctgccataatgcccagctaatttttttgtatttttgtagagacggggtttcaccatgttggccaggctggtcttgaactcctgacctcaggtgatctgcccgcctcggcctcccaaagtgctgggattgcaggcatgagccaccgcacctggccaatttttgtatttttaatagagatggggtttcaccacgttggtcaggcttatgtcaaactcctgacctcaagtgatccgcccaccttggcctcccaaagtgctgggattacaggcgtgagccactgcatctggccgattttcaatacttagtaataatttcatagtctcctaggggaaaaaaatcagctataagaactaattaacattctcatccttattaaaaatgttcatattttgcatgtaattcataatttgttatttaactttttgtattctttatataatttttttaaacacaaaaccctgatttctctacattttaaaatccaaaacactgactaaagttgagataaagatttctgtgtagaataagatcctagaataaagatagcccttccaattctcacacctttttgtgtccctttcccagtaaaagaaacatcaacctcttgtttgcctggtctcctccttcccaggagccccagcccaacacacaaaaggactcgatgctcccctccatacaccatcctactctactgaggggatcagctgttggaactggaatgtggagtcagtcaccttaaagtaaaggcagagtcaacccccacctcccaagtcatgtcatggtggctttggaaagaaagaggacagtgagagaaagccacaatgaaagccaaaagaaaacgatggtcaaatgcaagttcacaaccacacttgagagtcctaattcccctaaataattgtgctatgaactttgttcagtcatctgagttgacaaggataagttcctgggtaaatgtgactttgatataacacataagcactaaatctctccacaactgaatttcaatgcactatatcatctcacaattcaggggtcagcaaactttttctatatagggccagatagttaatattttctgctttatatctctgttacaaccactcaatccttctgctgcagcataaaagccatagaaattataaataaatggggatggctgtgttgcaataaaactttatttataaaaataagtagcaggccagatttgactcaaaggccgtagtttgctgatgtctgtactaaattaacctgtgggtgctgcaggggtggtggtggtatagtagcatgtatgattactattcatgataacaaaacagtatttcaaattataatgcctgcaaaacttacgtgatcaagttttctgcatgtacagcagcttccacaatattaagtgatggtggtttagcagcttctgcttgcaactgcttcacttccttccgtaaaacatgaagctgttggcttatggcttcattcttatgcatgccttcaaactaacaaaaattaaagttatcaaaagacatttccccccatgtgtcaggtttcccatgaagactcaaactgaaataaaattattgtcttataaaaataccaaaatttgtatctctttatatgactgccttataaactggtaagatcttgaattaatttatcaatagttcaaagccttttgtaggatactatttcacttatgtttcaactcctgaaatcctcatcaaaaacacatcccatgtcttccaccactgaggcttttcttgaagcacaggaagcccctccactgctgatcatggctccccagccgtagcccttctgtgtgctctcaatccaacatacaaaacactcaactccaaacactcaggctgcgtacacatgtgtgcccagcattaaaaaaagatgacacagatgctgctcacaaatgtcgttttgaaaggaagaaaatatatataatcataaaacaaacaacaaaataagataaaatatggggaaatgcccaaaccaactccatgccaaggaaagagcaattggctaattcctaaattcaccaatttaggttcctagaagctggtctttgataaaatttttattggttttcagtaaaggtggaaaaacaaggagaatttattgagcttctttaaaaaaaaactaaatttttttcaactcaaaagattatccttttttaagattagcctttcttatttgagaagccatcaacaaaccctttctctgactgatagtgacatacataactggtttgtttatgcaattttaatgtcattttttggatgtggatagaggcagaagaaaagagaagacatcctgggcccagattgcaacacaaacacagaactgacatgacagctgtgggggatatgggacagagatacaggaaggaggagcctggccagggttgcagagtgcagtaaaatcagactggggagctgagagagccctcttggagaggctttgaaatgcaggccggggagtctggacttacaggtacagctgaagagaccataacatttagaaggcaagagttctaaactctacattctcctcctgtcttccccaaacacatgggtgagcagtaaggtctacattttttccttacatgcacctgcccaaacccagtcttcagccatcactgcaatgattaaagatatcctttataaataatgtaaataattcacaaacttattacctgaggctcttatgtcacttatgaggcccagggttattatcataaattctgtataaaagttcctgaagggcggccaggcatggtggctcacacctgtaatcccagcactttgggaggccgaggtgcgcggatcacttgaggtcaggagttcgagacatgcctggccaacgtggtgaaaccccgtctctactaaaaatacaaaaattaactgggtgtggtggcaggcacctgtaatcctggctactcaggaggctgaggcaggagaattgcttgaacctaggaggcagaggttccagtgagctgagatcatgccactgcactccaacctgggcgacagcgtgagactccgtctcaaaaaaaaaaaaaaaaaaaaagttcctgaagggcaatggtccttcctatttgttttacttacccagaaccccagcacagcataactctgacaatacactgagcaactattttttatgactgtgataataataactttcttgtataaaactcattaatgtattaaaaatctttacaaaacttctttaaaaaagaaaaaagctctgtgacatcaaaatgcacaaaagtgaatattctagaacatataatgttaacaataattaacttttactattggagaaatgaaagattaaaaaagaaattacttgcatttaattagataataaatcaatacaagtatctgaattaaatttgaaatctttcaaataacagaccaatgtttaatatcctaaaatgtgattaggagtatctgcagtcagcctttttgttcaatacatcaccaaatacagttagaccgggactatgcgtgtcacagaatcccctggctggcctggagagacaggagccaaacaggaaaagagagaatctgagataaggaaggaagacacagaatgaagggaggtggaaaggcaaaggatccagagaccacttgactggaaaaatgcagacaggactaaaactactctgtaatccaaactttacaactgccattccatgttgtagaaactactaaaataaaaccaggtggtttaggcaagtttagaccctctcacaaaaaacatccccaaattattattattttctagtctacttatttttgtttattgttcccactactgttgaaagttttctttttttactgcaatgaaggtgagagcaatggaatgtctatcagttcataattacaagaagtagtagacaatagaacaaagtagcatggtggaagcccctccacttgagtcattttaagtggacacagaaatttaaaagtttccttgtctaaatttaaaagttggacaaagcatgtccttcagccagtttttacaataatgtgaggccctcagtgggtcttttccatcgttcatttcttggaattaacaaatttttcacatgataataaatcaatcctggggtcagcaagcatacccacaataccaaagtacatcaaaaggaacccaattataaatcaccccatttccccagggaacatcactgaattgttagagccttctactgggaagagagaacacagaaagaagcatgtctcacttcccataaaatatatttgcctttgtataccccaaacaagctatccatagctcagacgcttgcagatagctggaaatttccaggacattctttcccagaaaaaatctattaaggaataaaatattttcatgatataatttgaactctttataaaggagtcattcaaaattatatttaaaatctgaagtcatttcccataaagctaatttttaaaaactgatctaatctagaatgttaagatcacaaattctctaatcactgaaaaaagaaggcaatactattatacagactcagagagaaaatgaaatggtacctatattcatttacatgagatttaactgtcatgatcagcttgctcagaatcacactgcaagtattcagaagctgcagctgaaacagctgaagcaaaacgacctggcaatattgaatgggaaaagtaggggtcttgaatttagacatatgcaggcttgaatcctgatggagctactcactagctatgtgactttggcaagtctcacagtgtctctgaacctgtttctctgaactcatcctcattctgtgaagattaagttggataaactaggcacagtgcctcacatctgtaatcccagcactttgggaggccaaggtgggtggttcacttgaggtcaggaggtcaagaccagcctggccaacatgattaaactccatctctactaaaaatacaaaaattagctgggcatggtgttgtgaccctgtagtcccagctcctcagagagaatcatttgaacctgggaggtggaggttgcagtgagccaagatcgcaccactgcactccagcctgggcgacagagtgagactctgtctaaaaaaaaaaaaaaagttaagttggataatgaaagcaaagcacctagcataataccagggacatgagagtgccccaagcaagtgacaaaaagtactgtgaacatggctgggaaagacagtgcaaccatccttactgcttcccaagactgaatatttgggagacatttacactagagtaaaaatatacagtaagcagtgtatagtatttaagttgagtatttaagtatggaaagtattaagttgtttaaaagcaaaggtaagcacaatcaaggaatgaactgttaatttttaataagaaaaagttccaatttccatgatgtctgtcatggccaaacaatatccacaaaattccccaaagtagttaaaatcagggaacttacttatgaagggcataaatctagagctgttcattccttcaaacacatccattttgcagcactgactgtatgaggcactgatgatacaaacatgaataagacaaagtccctgaccttgtgtaactcaaaatctagtaacagcatagaactaatcataacacaaaataagttgtaacacagcctaatgagtggtgtgttacaaataaggatgcttcctttcagcagaggtgtactaaaaaaattaaaacaggccaggcatggtggcttacacctgtaatcctagcactttgggaggccgagatgggtggatcacctgaggtcagcagttcaagaccagcctggccaacatggtgaaacctcatcgctactaaaaatacaaaaattagctgggcacggtggcacctgcctgtaatcccggctactcaggaggctgaggcaggagaattgtttgaacccaggaggcggaggatgcagtgagtgccactgcactctagcatgggtgacaagagcaaaactctgcctcaaaataataataataataataataatattaaaaacaaataaagatggaaaccttattcccaaagagttcagtctggcaggacaaaacagcaagtgactgcaacagcatttaggcacaagctgcaatgagggaaagaacatctcaattcgactgcaagagtccgcaaagacttcaaaagaggtttggcctgaactaaatactgaaggctgagcaagaaagaggtcagaaatgggtgggaggagaacaaaagcagcatatgcgaagaacaaaggtattaatgtgtatgttgtgtttagaaaaatgcagaaagtctaaatggctgaaaagtaaaatgtctgtgaagtgggagagaggataaatgatgctgctagaaaaagatcaataacagattatgaagggcgctaagggtcatattccttttgatactgccaagtaaatatgggtttttagcctgaaaatgtgatcagatctatgtttcaaaagatgagtaatgagagaatggaaaacagactaggcagggagagagatatggacaggaaatctaattaatgcaacaggtcaagggagaagcgaggtgtgcataccatggagaaatggcaacagaaacacagagaagggaatgtcacgggcttcagaaagccatttcagaggcagaaccaatatggaagcaactttggaaaatacaggaatgaagtagggtagggtaactggaagtgatgatattgatgcctaagtttccagcttgggagaccagctatgtgaaattataggaagaagagatttggaaggtaaaggtgagattaatttgggaatatggagtttgaggtatttgtggaacattcaggtagaatgaggcaggtggaaatctagatttggaactcaagagagaattctggactagagaaacagaacaggattatcaacatatgagtaaatagctcttttgttcgttttgaactattctgagatctattggagttatacactctccagaaaaaaaaatttatgcacactttcaggaacttcaccaattctctaaagaccattcacagaccccagattaagaactccagcacagacagtaggcaaaagaagatgatgtcatatgaagaagagaatcaggataactagcaatttaagggtttgagttgaggaggaagaaaccctggaaactgagaagtgcttagagattcagagggaaaagatgtgactacataaagttcaatatcacaacagaaagatgttaaaaggaatcaaaactactgaacatagccatgaggtggtcactggacacatctatatagagggctacagttttatgtataaaaataacacaacctaccttttgcaggacatactctctcccaatgacagtttcatgatgagtcataaacactgagaactcaccctctctatcctccattaacacctctttttccaaaactaaagtcatccataaccaatattatccatttgggtattggatggcttcatatttaagtacaatctttggccaaaaatctgagcaaaacgaacaacttgcatagataattccccaacttcatagcaggtagagtttcagctttcctctatcttgccctttgccattaatgtgtaacaaaacatatttttatcttcaagtcctagaagtatcaaccagcaaataccgcctgggatagcctcaactagcaacaacagtactatataactttcaagattatttaagtctccgcctataaaagttgttcactgtccatgtttttaattgccctggcaaatctgcgttatcaggcaaaacactggctgcagtcgatactattattgatactgaacttctaggagccatcagtgagggatctcaagcttgtggaacttcccaagtgggactaaaagtcagggcactaagcaaacgagtgaggccagcagaaaagtaaaacctgctttaagaaaacttaaatatttctaatgaggttagggccacaaaatacagctattttttcaaattctttacgcttctgcaacatctccttttttccctctctccttcattacttttcccccttctttcttcaagctatattagcaattaccaatttttctttttttttcttgagacagggtctcactctgttgcccaggctggagtgcggtggcacagtcacagctcactgcagcctggacctcctgcggttaagtgatcctcctgcttcagccacccaagtagcttggaccacaggcgtgcgccaccatgcccggcttatttttgtataatattttttgtaaagacagagtttctccatgttgcccaggctgctgaactcctgagctcaagcaatctgcccacctcaacctcccaaagtgctaggattacaggagtgacccaccacgctcagcccaacttttctttaaagaaaagaaagcacaagaactttggtatgtttgtaaaaacatctaagccatgttcacatcagtccttatcataaatcatcttttctctgacctccctccaatcaaaattacctagaagacattttagaaaaggtgtttctttttatttcagaattaacaaagcaaaagattatgtttaaaatctcaattcaagggttcagacaaataatataatactatgatccctttttctgtaaaggaaaagagacaagtcacaggtaggcttagagcttcagctccctggcctgcctggtggtattttccactgcaaggcccagagagttaacaggaggtcagggcaagagacctgttctttagctgaggcagtaaatatttacagttcttcacagagcaagccatcagccagaactggaaaaacatttctttatagttatctcacttgtcacttataaaaatgcattttagaattctcttctctatataaaattaacagtctggcaaagatatgtagttttaaaatatggaaaaacacaaattggtgaagacacccctttttttattaaaaccggatacattttcagttttttcctcactaactcgaactccacccaaaattggcaaacttttctcccagttttattacttcagcaagcgatcttttcttaaatatttctaccttggtcttactataacagcattagtaactgggaaaaaaatacaccaaaagaaaaccaactgtataaagcacctggccaaagataactcaatgtttaagagtcgcacatatttacaataacatacgggaaaataagttggactcatcctaacttttaggtcaaatttctgaactttagacaaatacaactatgttgaaaaatcagagacacattttgaaagtaatgaaaaatacaatacatataaaagattatttcagagaagacattttgtagaaaagagtctcccaaggaaattgatggagacattggaatagttacaatgaaaattagcaaaaaaagaagggaaatttctgaaagacaaacaagagggagtaaaataaattttctccaatttccaaaagctaacaaaaaagaatcatttgtgtgtagacagatttagacaataggcagtgctaatctccaagcatttctctttcagcttaaggaatactgacttcactcgaaggaggaatacagtgcggtgattaatgaacacaggctggccgggtgcggtggctcaggcctgcaataccagcactttgggagtccgagacaggcagattgcttgagcccactagtttgagagcagcctgggcaacatggcaaaatcccatctctactacaaaaccccatctctactttaaaaagagcactggctctggagccggactgcctgggcctttctggctgtgccacttacgggctgtggcacttcaggtgagcaacttaattaacttctctgtgactctacttccttacctgagaaatgaagataatatgataaaggccaccttgcagagttgttgtgaggataaaataacttatttaaagtgtttagacagggcctggcataaagtaaatgctatggcacactagcttcagcgaagcttccattgtgaagtgcataccatattgcagatccaaattctgcctatattccagtgcaagaaggtaactctgagaggcagttcaagtttcagtcacattgttgcatgtctctcctctgcctgtcagcaagttccacccaactaatctgcttcccatatatccttcccacgttcatcttcaggggctccctgccatgtgcagcagacagccagagttcccaatgatggtgcacaccaagctttccaatgtgaattcccaccaacacccccaaaacacttggaacgggctgacctagccaccgacccctaaatgacatcatggccactccatttccaaattccttctaactgtatcatcaccaaagtcttttaatcaattgagaccggacgcggtggctcacgcctgtaatgccagcactttgggaggccgaggcgggtggatcaccaggtcaggagttcaagaccagcctaaccaacatggtgaaatcccatctctactaaaaacacagaaattagccgggcgtggtggcaggtgcctgtaatcccagctactcgggaggctggggcaggagaatcacttgaacccgggaggtggaggttgcagtgagccaagatcgcgccactgcactccagcctggggactccgtttcaaaaaacaaacaaacaaaaaaaggaatcagttgaagccctctctctaggaatcttctcaatgattctgatttttttttaattcctatttgaatatctgtcttataggactcatctggtacctacaaaaatgtgtgattagctctatgagtgttttcatgccctgcaaaactagtaaatgtttgggacacagacagtgtgctatatatgtctttcaatctttctcattgataagccaacattacggactcaattaaaattctctcagttctgaagaaatttaaacacttacctgaaccgtgacaactgcggctccttggcatttcttaccgctgctgcctctgcactccaaatgtagtgtggtctgttcttcacgattcacatactgctttggcattgtgtctaacagctcaccatccagagcaacctgctgagattcccgaagagctgcggttctgaaaaacatcatcaggaggtaaaagaaagtcttaggaaaggttatatgataggtgataaaggcttccagttacccacagccagcattatagtgcagcaaaagacacataaaccatagtaacagaggaccaaaggttgtgagccaagacttacccaaatcatcccccagcagagaggctaaagagaaagctaagaaatgaaagaaaagcctatagagaagtgagacaacttgatagccacaaacaaagctccatttagaatccatgttataccaacagaccctacaagaacaactgagaattctatcctaacttcatcaccctcaaggggtgccttaattataagtaccaatgacttcttaggtattagcaactcaaaacgaaatgtcaaagaccaagaaagctaatcgcatacatggggtgtcaaaactggtctaacggtatgtatcattacattaatgggcaggtgcttatatgtgcactcaacacacacgcaacaaatgcctggaccaaaaacagacaaggaaaaaaatactgataagaaattgattcatggcctggcgtggtggctcacgcctgtaatcccagcactttgggaggccgaggcgggtggatcacgaggtcaggagatcgaaaccatcctggctaacacagtgaaaccccatctctactaaaaatacaaaaaattagccaggcgtggtagtgggcgcctatagtcccagctactcgggaggctgaggcaggagaatggcgtgaactcgggaggctgagtttgcagtgagccgagatcatgccactgcaccactccagcctgggcgacacagcaagactctgtctcaaaaaaaaaaaaaaaaaaggaaattgattcacataggatttgtaaaagtaaggctcgcttactgttaatgaaacagacttactccacgtacgctccttctcacaagatctcaagttagatcaaaaccttaaatggttgatcatattgtatccaccttgtgaactcaaaacaatgacttttccacacttcaatcaatatttatgtcaatttcttaaagaatatggagaagtagagagtacagcaatgagaaaagaaaggaactcttacttcacacctttccaacatcatctttccaatatcagaagatctcttcatgagaagcatacgaaaatcttagctggcactgctgatgctcagaaatgccaccacaggaaatgtgaaattgatagttggtgagagtaccacataatttcgatgtgaaattataagacttgtcacaacttggttaaccaagtgaaccgtctgggccaggttggtcaaactatcctcattgtaaaaatgctgacaaggaagccactccaggtagcaaattatccaggctgtcaaagccaccaacatgggaacatgatccgtgaggctgcatggtcttacctggcctgctgttgcaacagattcaggtctgtgcacaccagctgggtggcgtccttctgactcaatagcacagcagaggaaataactggcacaggaggcttcgtcgggtgcagagcaaggggaggctggggagcctcatgcttccgcaagttacttaaaaccctttctttagctgaaagaaaattaagtcatatatactgagcaatcaggtgaattagcaggagaacagaagcatgtggtacaattcagtagaattcctatcctcaaaaaatttatagtcttacgatagttgaagagttaaagctcatgatcttaaattattaccctagacaggccttgcatgacatgctaacaagtttggacttgatattagtgtaaagctactatctagtgccttacgctaatatcacgtggatctagtgaacacctctatgcaagcttgaatcagatggtagctatcatctgaataatggtttaggtaaatggagtaggtctggaggcaggtcacccagttaaggttttaatgccatcatccagaattcagaggaatagaagaaaaaggaataagcgttatggaatatagccgagtcaaaaatctgaaatcaggtcaaggtttgaacaggaggactggatgcagtaagagataaaatgaatgaagacatatgcataagctccttcagcacttctatttatgcagtcatatagtccatcagtcatttattcattcactcaacaaatgatttatggagtccaaataagcaatcctgtgccacacacacacacacacacacacacacacacaaaggtgaatctctaccatgcaactttgccctagattacacatgatctcatactgtttaatcaaattcaaatgtttgatacttctagacttagtacagagctgaatacacagtagatatccaatagattcctatcttccctccctctcccttcaccacactatacacataccacacagcaggtggggactgaataacatgaagaaaaatgctgctacctacccaattcttttcaatagcaagaaacagaggaaggcagtggtcaagggaatttcaagtcagtaagtcaagtcaacaagtacttaagggactacagtgaatttccgattacattccagatgtaacattccattttctattcttgttgagaaaaattaaagaaaaattaatagccatgactttacttggcataaggagacttgtattgtttgtaccccaaacagatggaattcaacatttcaaataggtcaagtacagcactatcccttatagttagtgtttttccactagaactaactactctttgcacagatgtaaccaagttaggtattcaccactggataagacttgttactatttatgttaaagttcctttcaagcaacataagaggccatgatgctaaaggaaaactgggggctctttcaaacccaatataagttaccataaaagaaaaaccaaggtattttaaaaacaaacaaacaaaaaatctaaattcatatttaacagtaatcaccactctggaccacaactgacaaaaatattgaagccaataaaacaaatttagtttaagaaaaagaaattgctatcacaagggtgctagtgaaatttttcctacaaccaatcataaccacaaattaaatcatttgatataatcatcaactaatctcttatatctgagaaaaacctgaaactcactatttagaagtataggccctaattttgtttagaagtacaaggtatcaccagacacaagaggtagaataatgagtggtgaacagcaggtctctggagtcagacggctctgcccaataaccagctatgtggcccatgcaggcaggtcacctaacagcttacaaattgggtttcttatctgctcaatagggataacctaacaacatagggtttttgtgaggactgagttaatgcatataaagcactgagacagtgctcggaacaaacgaagggcttcataaattactagcttaactccagcgaaaacaattcgtattttagggcagtgttcaggcaacatagaaacactatgaatggaagggcatgaacggaaatcatttaatagttcccagatctgttcatatatttcttcttcttaacaaactttcaggaatagaaaaatgagaatctacgttgttggcttgagggcaattttcatccctttctctatatacctttctatatcatttaatatttaaaattaatatatatcttttataatcagaaaaaaaattattgtttcaagaaaaagtgcagggagaggaaatgttggagggaaaaattttagagccttagaagaaaccagccagcaccattttacagatgaatggcgtgaagtccagagaagttcttatttgtctctcttcatacaactaacgcgttttggttagtggcaagctggaataagaaggtattctgcatttctctgaatcacctcagtgtcttcttacactatatattgtaataaatattttggtcaacaattgaatttacaatgatatgtcctatatttttgaaatatagtcagtaattaaaattaataggttaccccaaatatcagcaactttataggttaaatgggcttttgtggcctgatagaaaactaactggtaatttataccactgtttctctagaaaaatgtactgggagaaacaagtaacttagaaacttcaggaatctgattcatttgtatggtaagggttctaggtacaaaggaaaagagtttataaaagaaaaagacagacttctgattttcaaaactgcaaagtaattacatttacagttgcaatttacaccattgtgtaagtcaactgaaatctctttttaaagcaccagaggaaaaatgaacactgggggaataaagtatgtcagcctcaaccctcaatggctctgattcaatcattcattcactcattcgaaggggcaggtgctcccaggacccacccagcaaaggatcagtgaagtccagctgcacggacaaactgcagggtgtggaatgggactcaagcttggcctgtgtccacagaccaacagtctcctgaaactcatgatagatgcgctccatgttcaaatactccatccacagatcctgaaacagaacgacagtactttaactctgacagacaagtcatagattcacatataaaactatgtatttaactataaagtgaaccagtaagtttcaacacgaagtggtctactccaagtcctccaccattaggataaattgccattaaaatgaccactctaacaatccctgcagtagctgtaaaacttttttgattgtgtatcatgattagaaaaaattttaacagccctatatgtatatttgtaaattatatacatacactataaagctaatacattatgtatactataagacataggtaaaaaatagcaaatgttaaagaggtaaaaaataaaatgttaaaaaataatcaaatctgaattagatcaagacactaaatccaactatcaatttacagtaaatacaggggacagaaaaacatgttaaactacaccgtgaagatacaattagcaaaatccatactgtggggagcctctatggacaaactactcagtttcttcaacaaataaattgcaaggaaaagtaaagggataaggggaggacttgtagattaaacagacttataagacatatcaaccaatcacaacatgtggatcctgatttaaactatgaaaataaataaaaaaaaaacttttatgacatttatgagaaaggtggaaacttgaacattgactaaatatttgatataaaaaattatttctaatatgtttaggtatgctattgggttatgtcatttttttatccctatcttttaaaatcttcatgcatcaagtgctctctgggattacctccaagataaaatggaagaggaagtggatgggctatagatgaaactagacacatggcatatgtggggagggggagaagagcatgcccattatactgctctccctattttcctataaaatggaattttttcataataacaggtgtcaaataagtaaataaataaaatgagaaaacaataaatatagtagctctagtaacctctccctacactcccatgggctgtcttgcatattctgaattatatatatttcactttggtgatcactacactttagaatgggggactgcctttaacaacaacaacaaaaagtcaaattatcaatgaactttaaatagtaatagcaagtgagcaaacagggactatgggtttgtggaccgtgattttttttggattttaagtgttctaaaggcccaaggatccctctaaaccaaaaaatgtccttggcttctcaataagcatactgctgtgaagtcccaactcattatttccaaaccaacctcacagtccaaggcattccagactcagaggaggagctccaatgtaatcctgatcacaatcctgaattctacatgcagctgagtgttcaatgtgctgggctagatcctcctattgcatacatgctcctttaaatagggtcactctgtcactttctctgcctttatgccaagtaactgttaacagaggctaatgaatagagcaactactaggaattaatgataggtaagcagagacatcttataaaccataaaaatacaaaacaaccctgagcttgaattacagatcaagaaattatacatcaagcaccaagcaagggctgacttaaaaagaaaaagagagagaaagcaagcaattaattctgttgatgctgaggaaccaggataaatctcagagaaccaagaaagctatggctaatttttaaaaacactgaccaagtacctaccatgtacaaagccttggatatggatgaggggtgtcaagcataaaaagatgaggatggaactgaactcaaaggatgtcaggacaccatggtctcatgtgtatttttcttgtttctctggccctatactctcagtcttatttctctgtgcgttaaatgctgttatctctcaatgttccatcttcagtcctcttcttaatctacatattctcttaccactaaatccacatatccgactttgcctcattcctgaattctagatatatacctccccttctgaccaactccttgatagagagctctcgttgaagcccctcaggcaccccctcttccagggtttatctctgggggacaaagtcagaaatttggaagtctttgggtatctgattcttcctcgatatatttttaattcatccatttgtttaataactgctgctatttcaatagttctccaaacaaagacttcaaaatacaagccaaattatttagaaaagtatacatggcccttagggatttcattcctactcatctctctggtttcatctgccccgcctcaggtgctatgccctaccctgcacctttctgaacatgcccatccctttctcacctgctatatgtcgctgcacatactggtctttctgcccattaacatcctctctgccactccctaacaccatgcctttcctttccatctgcccaactcccatttgtccttcatggctcagctcaaaggtcaccactccaggcccaatccaaatcaggggctattcccctatgtttccatagtaccctgtgcattccactctcgtaatttttttttttttttaagacagggtctctctctctgttgcccaggctggagtgcagtggtgcaatctcagctcactgcaacctctacctcccaggttcaagcgattctcctgcctcagcctcctgagtcgatgggattacaggcgcccaccaccatgcccggctaatttttgtattttttagtagagatggggttttgccatgttggccaggctggtcttgaactcctggcctcaggtgatctacccacctcggcctcccaaagtgttgggattacaggcgtgggccatgcacctggcccataatcttgatcacaaaatgtaataactgtttgtttagtctcctgttggccaataagctcttaggaggcagggaatgtatcagatttctttttgtatcttcggtacctggcacttagaagacactcagtaaatacacacagaaggcaaggaaagcaagaagaaagaaggcaaggaatgaaggaaagaaaacaagaaaaagacacctactggagataaaatatacacatgatgtgaaagtaggagggtttaaggatccaaatgaaagtgtttcaactcttagagtttcctaaatcccatcctggtgctggggtcaatactcaaaagactgcagccctagaaaaaaaagaactagaatagaagagaattatcttccccactttttccctgtccccaagatggctagaaaagcttagagaaaactgacatcacaagttttggcctgaaaaagggtcacagacatctttgagtgcctgggggagaacagcttaggacatacgaagactgaaatcaagtggttccagaagagcaatcagaactgtgacaatgacaagtaagcacctccaagccaaacaaaggtgagctcctgatctcctccatgcaaccaacctcccacatcacatatggatccctacaaattcttacaaattcttacactgcatgtaagaatgggagtagagataattgcttaaaggtattcagctactaacaacttccaattaaaaaaaatatacagtcagaggaaggttatgtttatgaggtcgtaaaaagccctagaacaagcttcaagccttcaggtagaaggcacggtggggctggagattcaaaagggagtattccctccatataatcacttagatactgacaaaaccatagaaacaatgaccatctgagtgactacccattttcttatcaataaattgttttattatgaatatgaccagttcaaattacattcagatatgctaaaaaaaaaaaaaaaaaaaggagggctataatttcacctgctgattctgcatcacttttgctagcctgtgaatatcataatgctttggtagagaagggatataggtatctcctttttgaaaattctcatcttctagccataatatatatacattgaagagcctaaaagataaaaacataattatacgaaacataaaaagatgagcatacaaacaaagcttcttacatctctaggaacactggcacccctacataagagtaaagaaagcccataatacagaaaatgtggccaacaaccaccacggctcccagagaactcctggtccagcaggggaggcacgtcacagattattcaaatatgatgcgataattgctaaaacaaaaggtatgaagaaggggctctgacaacaattcttaaagtagatttaaatacagtacacagaaaaaaataactggaaaagatgatttttaccacagacctgggatctgaatctggagcttttctttcctaggcaattcagtcagttatttttgcttagaaaagcaaaaataatacattcaaataaaaacattttcagagaaaatattaagagctattttaaacttatgcattgtaggaattttccagctttaggctcaagaaccatctcccacctcagagaatcgcaaataaatatcacagcatgtgtgtacgcccctctcatcaagaaggaataaaatcaaatcagacttaaaaaaataaaagttctggctgggcgcagtggctcatgcctataattccagtactttggaaggccaaggcgggcggatcacaaggtcaggagttcgagataagcctgaccaacatggtgaaagcttgtctctactaaaaatacaaaaatgagccgggtgtggtggtgcacacctgtaatcccagctactcaggaggctgaggcaggagaatcacttgaacccggaaggcagaggttgcagtgagccaagattgtgccactgcacttcagcctgggtgacagagcaagactctgcctcaaaaaaaaaaaaaaattccaattttccagtaaaaaccttttaaaaatacaatacttccttcatttttattttgcttttgtttttaccagcagtgctagaaaaatagtcggcaaatacacaaattactgggtaggggactgggagatggtctggcctgactttactcaataaagtggaaaattacctcctttacctctgcaacagccagtccaggaagacagacaaggacagggctttggggttcttacagggaagaggttgctaagtagttctctcctccagcttctggctcagtgaaatagatggccactttatgaacacataccaggagggggatataacagaggcagaaaggaatatcaaagactctcttggcttatctaaaatattcacagagaaagccgtccactggttaaggctggttaaaaataagttctccttcaacaagcaacataagggaagaaatcattctggaggctgacagagagtcgtaaaaggttgagggcaaataaacctaaggcctcagtgctagatgaaatggggacctcacctagctattgtgtattgaggattaattcttaagagccatttttattaagtcttatttgtaagactagtatttgatttatatcaaacttataaatgaaaggggaaggaatagtgtgaaaggaatccaaacctacttcagagttcttaaccttttagaggaggcaaatattgtaccctgattttatagggcacatatttttgggagattactagacccctcatctcaggtggatccctgaatcccgtgaaggatctatgaaccacacttaaagagccctgccctggtcatttgtttcttttgaagagctattctaagctacgtgtggtggcacacacctgtagtctcaactgctcaggaggatcacgtgagcccaggagtttggggctgaggtgcactatgatcgtctcactataatcgtgcctatgaatagccactgcattccagcctgggcaacatagtgagacactccttcttaaaaaaagaactattctagcaaggtttttttgtaacagagtctcactctgttgcccaggctggagtacagtggcatgattatggctcattgcagccttgacctcctgggcttaagggatcctcccacctcagcctcccaagtagctgggaccacaggtgcacgccaccaggcttggctaattttttttttattttttgtagagatagggtctcactatgttgcccaggctgtctagcaggctttaatagttgtttacctgctatgataaaatttggcttatttctatttttacgtaaagaagtagaagaggatttatcgctcagactacaggcactcgacacaagtacatccaaactgttgattcagttctcttgaggaacataaaagagaaacatttcaagatgcaaatctatatcaaagccaccttccatattcaatctaaccgtgttaagagaataacatctagcagtttgtaacacagttaactgctccagcatagtacctgtgctgcaaacaacaatgtaggtggctaaataaccatactcacctcaccagctccttgtgcagttctggtgaagtcaggtaaccaggggtgccagagtggctctctggcagcccttcactgccctctgctggaacacggagggccttgcttgcagcatggtggaagtcagccacctcggtcaaacgtctcttcatttctttcaacaaattgatatgagcaggactttgaaaaaaccttcttccaatacaaccatctatgggtaaccttaaaaaacacaagcacagatctataacctttcaacacaagatgtactttctgtatggcataaaatagcagttaattagcaaggcaatttactgtgattgtggatatacaccattaaattaacacctattatttctacctcaaagattattttgatggtccaacaagatggtgtatatgaaagtagttttaaaaagtgtgaaatgctacacaaatttaagacatcactacttagaggtacagcataaagatggtttctattcttgaagaacttgcaatctggcaaaaactaaaacagaagcgactaagaatctatctatctatctatctatctatacacacacacacacacacacacacacacacacatatatatatatatatacattttttttttgagacagagtctcgctctgtcacccaggctggagtgcagtggcataatcactgctcactgcaacctccacctcctggcgactctcctgactctcctgcctcagcctcccaagtagctgggattacaagcatgcgccactgcgctgggttgtttttttttttttttagacagactcttgctctgtcacccaggctggagtgcactggcgtgatcacagctcactgcaagctccgcctcctgggttcacaccattctcctgcctcagcctcctaagtagctgggactgcaggcacccgccaccacgcctggctaatttttttgtatttttttttttagtagagacggggtttcaccatgttagccaggatggtcttgatctcctgatctcatgatccacccgcctcggcctcccaaagtgctgggattacaggcgtgagccaccgcgcctggccgtgctgggccaagttttctatttttagtagagacagagtttcaccatgttggccaggcttgtctcgaactcttgacctcaagtgatcctccctccttggcctcccaaagtgctgggattacaggtgtgagccaccatgcccagccagtatctatatatttcaaatgagtaagttaagggaatgaggaattgaggcaggagctagagagcaatggttcgtaatagtggatggctctggctgggtggagtatcttcatatgaatcccatgaaaatgctgaatattcccaagtacaacctacaggtgacagacaaagcctggcctttgttcacacgcgcaccactcatcacaaggtcccctcctacaagccccatgacggtcacacaggcagcctcagtttaaggcagttgctctccctttgcatctccagaagttctgtgtgaaaccttgcccaatcccagggtgttgtctttactacactggtcatggaagatggtaaagagaagctgccacaagacaccagcaactcaataaagatccagtctaataaatgtcaaacatagagacagagaaagagtcctcaccagagatcaccaaagaatgattccaactcacactccacagtctaagaacacatagaatgagagcagtgcaaaggcagaaatggactcacagaaacctacaatactgggcagcatacccatactgtggtcccggacggtgaagatacagaaggaagaacttctgccaaatgagtggcaggagggggtgatcagaaggtgtgaccagagcctggtgggcccagcgataaatcagcagcctctggagggatggcacgatggggagcttcagctgggtctgggctttctacaaaaaagaaagggctttgagtagccacaaaatgaacataaatgcaaacggttaactctttctaagtgatccaactgaaacaccaaacattctgttttcaattcaataatatattttttaaaagtcacataaaactcacttctccaatccactagttaacattttaacctccttggtagcaagacatgtagggcagctttttattctgtcaaaacacttcacagaccccaaaatgggtatgggtcttaagagtcatctagtctaacctcattttcatttctgaaattccttggcgaatacaacgttatagtgcaagggaatagaaagatatgaaaaccaaaagtaaagccggggacagtggctcacacctgtaatcccagcactttgggaggccaaagcaggtggatcacttcaggtcaagagttcaagaccagcctggccaacacggcaaaaccttgtctctactaaaaatagaaaaattagctgggtgtggtggtgcactcctgtaatcccagctactcgggaggctgaggcatgagaattgcttgaacccggaaggtggaggttgcagtgagctgagattgtgccattgtaaaattccagcccgggcgacagggcaagactctgtctcaaaaaaaaaaaaaagaaaaagaaaaaaagaaaatgtcactatgtgactgtcaaactttatcaatcttttgaaaattcagatttcaaaaggacattcgagaatgctgaattctttgagaggctctgaaacccaaaagcaaattctttaacaggctctgaaacccaaaagcaaaatctatactaaaatagaaggtctttaaagccttattccagtctttcccacatattagtaagcctaagaatcagctaggagtttcaaaaaataacctccttgtcccactcgagactcagagactccaaatcccagaagatgaggtctaggaatctgctttttaacaagttctccagggaattctgatgtacgtgggatgcaatgacaacacccgtcacatgtgcaatgatccagccttcaaatactaggctgagactcttgttaaacaaaccttgagaagcaagtactcttcaattacacagttttaagtattggtttggttgttgagctttccaaacattcacaacaaaataaaacacaaaagctcaaaagctacgggtgaatccatcagcatcaaagtgtaagccaccttctaccactcaaatgcagaactgctatttgtaccttcagagcttggtcaggggtgaaagcagagtttatcaccaattccccttcaataactctccggagctgggagtcctcttcaaagatggattccatgttgagcactgtccaggcaaaccagacctataatgacaccagataaaggggaggggaaggaggagctcgccccactgacgaaatacatcctgatattccacaatttaaatctcttcctatctcaagctcaatcagcaaatatttgcagtttctaaaattaacacctttttatacctacctatatccttgtcgcagatataaatttaaataaaatagatcattggaaaatgttacattcctttggaaaggctactttagtacaagatgttcattaactccatatttaccaggcaagatctgtgtgcaagagagacaggaaagaggaccagacaggggctctgtctttaagaagtcttccatctactggagtagacaagactaatatataagtaagcaaaatgtgaagttgagcagtgacgaggactgagtcaaggtaaagtgctatatcagagaaggttctatgtagatgtcagagggaaaggcatgctggtaagagaatccgctaggcagagacaaaaagaggaaaagcccgggatgtgtctaggtaacagcaaggagtttgttccagctcaatccatgagaggtgggaagaagagcaagaagtaagacaaataagaggttgaagaacattactactgatttaagagatgaaacagacataattttatacacaaagtctaagaggtggtaatgataaaaataatgctgctgctgatgataataataacaatggccaacactcagtgagcactggttatgtgcgaagcactgttctaaatgctttacatataggtgccatcattattcccatttgacaattgagaaaactgaggacagataggtaggcaagctgcccaaggcacagagctaacaaacggcagaaaccagattgaaacccagactgtctggttccagtgaccactctaaacctctctgcagtgctgctgggcagtctctgcagtccggctggctgcggtatgatcaagagctgtctactcctgagacagtccttaattccactgaacctcagttacagctagacacagtagtgtgcctgtagtccccaaatactagggaggctgggagcaggagaatcacttaacaacaggagattgagaccagcctgggcaacaaagtgaggccctgtatccaaaaatgttttttaatttaaaaaaaaaaaaaaagaaacaactcaggcagggcgcggtggctcacacctgtaatcccagcactttgggaggccgaggtgggcggatcacctgaggtgaggagttcgagaccagcctgaccaacatggagaaaccctgactctactaaaaatacaaggttagctgggcgtggtggcgcatgcctgtaatcccagctactcgggaggctgtggcaggggaatagcttgaacccgggaggcagaggttgcagtgagctgagatcgcgccattgcactccagcctgggcaacaagagcaaaactccatctcaaaaaaaataaaaataaaaataaaaaactcagttaactcctctgtaaaacaggaatggcaacagcacaacctcaccaaagggctactgtaaagattaaatgaaaaagtatacttacactagaataagtgctaaataaaagttagtttagacaattagtaatttctttgtaaggatgatcatgagattaaagttcacaaagataacaaatgatcctctcagtgagtttcctacctgagtgggcgtggccaagccctccacaaaggaaggagtgatgttgcctgccacaatccagcttaccaaagatgagagcagactccggtcacagtggtaacccaaggcattctacaccgggagatgtggagcagagagaggaggttttaaggaaaatcttatcaatgacctttacaagagtatcagcaactgtcttactacaatacaagattctgataagacagagatttcaaggatgagtccaccagcagcaatagtccaaggcagagcattacagccaaatgtaacaagcgggactcttcctgggctgtcctttccaacttccctagggtctacgctagtggactacgattatcgggataaggtaccattaaggcaaagcttaaagaaggtaatggccacagagtagaactgaaaactgtacttgggggaatctttttagaaagctactttatctagccaatcactgaaagataaattctctaacaggttaattaccttatgttgttggtagagtaatttctgtatgcagtcttcctgcatcagctgaaaagctgctttacacaagtggtccatgaggaagaggataggttgttctcggtaccagagatgctggcttatgagagcctgaacccagaactccaacacagcaacggggcccacttcattgggctgagtgcttacagatatgtgtgcctgtggagaaaaggctcatgtgatgggaaagataacaaccagcctctcattttttaaatagcaacaaaatgctatctacctccactacaaatcccaaatctattgcctttcttggccaaaagcacactaagccaagtgatctgaaatgactaaaacctaagtgtgctaacgctagaggtcttggttgggaagacaggcgggagtgtgcttaggggcttgcaaggccctcacctggatcatgctgttgagaagcttcacgttgtccccatggctggctcctgtcaggtgctgtgccaccttgtgggtgacctgttgtgtgacaccctgagggacaccgctgtccaagtgtaggaacaagaggagatgcgataaaaacctgccaagcacacaggaggacgcactttaccttccgatcagaactcaacagaattttccctaattacttatgaggaaacagaaaattcctaaattggtcccatttttcgaccaaagcactatttaagaagggattctagaagaataaagttttcacatttaacatgggttaaaaggaattctatctacccacagaggtattaagaacagatccacgacacacaaacacatgcaagttaaacagcattagaggaaaaacacccaaaggcaccactctcccctcctcactccccaactccatgaataaaggcagagatgtttccaaaccattcagtttccaaacttgcctcatacccagggtgctgattcttaaaaaggggttgaagggttaggtgagtagttcccaggacctaacccatttctactaaagtaacatctccgggggagaaacctgggaatccatatttaataagctcttttgggcaaattggagacatactgcttgaaaagacacataacaggaaaactgtaatgctccccttgtgcctttggatgtacttcatgtccccactgtacagggttcctccatatggggtgaggcctcacctcccctttcatcactgttcatgaggccccagccagatgctttactcttgcctccctagacaggttgttctcttcccaccttcctagcatcttatctgtttgcaacactgcactatgtgcactgtaaacaatttaaaacaatcttttctattgttacaatggcaaaccatttgctgcttaatatcagaagcacgattcccagaatctcagggaaacaactgctccttcatatactattaagctttaataagcaattcaaagttataataaatgaaaaggaaaaatatctttcatggtaataaaactggagtcattattagaatcactgttcatcaacctgcattctaaactggggtgcagaatatttttgccccataatacgctgttgaaatagcattccctttattttacttaagaaaccagaagacacaatcatttgtacttgctggactgtttaagagtgtctcctgccatagatggaacacacttactgctcattcttcagaaggtaatactggcaagggtaaaataaaggcagaatcttatccaggacatgaaccactgttctcaaatgtcttgactggaccagaattcccaatagtgggatgccttctgcacagaacttctcaatgctatggaaaaagagaaaggcactgaatacacaagggagctggttcataaaattctgttcttccaatgagttatgagccttcaataccttgggttatctcaggtctccaacacatgttttatacccaatcttcacacagaaatactaaacccagaattctagaattgcaaagaaacttaaaagttaatctttattttcattgtatggatgaggaagggtgaagtatcatgcccaaattcacataatttcctagagtaaggtcaaaatgagaacgccagtttgcaaatttctaatccagagtgctctctactaccatattttatttctcaaaaagagcttctcctaagagccgtagggactctccttgtctggatattcccacaaggtatcacagcaaagaggagactcaaaagtgacctcaatctgtcagtacaggttgactatcccttaactgaaatgcttgagaccaagtattttagattttggaacactcgtatcatacttaaaagctgagcatccctaatccaaaagtcccaaatccaaaatgccccaatgaacatttcctttgagtgcaatgtcagaactcaaagtttcagattttggagcatttcaaagtttagattttcagattagggatactcaacctgcataaactgcaaaattctgctaaaaccaatttggcataaaagttttattctctgcctcacttcaaagaatctatccttaaaaaataatctcaaatacggaaaaaaatataaaatatgatccatataaagaggcgcttttcaggtttatttttaactctaaaactgagaggttgaaaatgacttaaggcaattttagaaaaatcctttcaattggaaatattattgtatcattttaaaataatacacatgatgaccaaaggcaatgtggaaaaacacttctgctataaagatactagggaataagacataaaattttatactcatgatcataactactagtaaagaaaagttatttgtggaggcgaatacagggacaatgtcacaacaaaagagtcattgtacaagagtggcagaagtgagtggctttttctccactttcctaattctgcagtttggttatactgctttaattctgggggagaaaatcatttcaaaaaataaagtaattgtgcaaaggttatgccacaaggaagctacttacaattgtaaagtgaaaaactaaggatataaaattatacatacatctttaaaaagatcaaaggaaaaatgatggatgaaaataaacagaaaaaaaatcaatgattttatgatgggaaatattctgggtgattttctgacttctctacaatgtctgtaatattatattcacaaacaacttatgtccctgcctactccacccatacctaagattgttttaagttacttctatattccagtacacctaatcccaaatgcccaccatggagttttacactagagatcagccctgagaggaaatgctcattctcactctcactcccattcaggattcagtgatcagcacaaatcaaaagttatctctagagagagcccacagcagtatcagtgaataaagggctatggtcccagaatggatacaagaaattcgagaaatcataaaacacttaagttcagataactgcactcaagagaatcacgtcagacactgttctaggcatgttacatgtgtggttttttttttttttttgagacagagtctcgctctgtcgcccaggctggagtgcagtggcgcaatctcggctcactgcaagctccgcctcccaggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccactgcacccggcctacatgtgctctgactcacttaagcctcataaagtaagtttggtgttattagtactcccattttagagatgggaaacctgaagtacaggaagccgttaataacactagagctactggaaacaatataaagagtatgttcctaaggacccttatcaggtctcctcttttctaaatcaattctaccttcttttacttagctttcaaatctctccataatttggcccaaccaaacacctgatcacctccattctccaacatgaatcacaggcgtcagtgagaagtgtttcctcatcatttcccttcctctccccttacccactcagacacctgaggctcctttccacattcattcaacccaccagcatttgttgaatacctactaagtataagatctagagatacacaattgaacaggacaatgtccctaccttcatagagcaaacagtcaatgaggagcaggggagattacaatgacaataaaacacagtgagtgtgctgttcagaatgtacaggggctgcaggtggcaggagatggcccttgaagtaactgtgggcactaagtaactgtaagaggaacacaacatcactctgctcatcagcctaggatgttgtcttagtccatgttgcactgctataaaggaatacctgagactgggcaattaataaagaaaaaaaggcttatttgagtcataattctgccggctggaagactgggcatctggtgagagcctcaggctgcgtccacacatggcagaaggccaacgggagctggcaggttcagagatcacatggtgagacaggaagtgaggaggaggcggggtgccaggctcttcttaacaaccaattctcatgggaactaagagacaagaactcattcattactgagaggatggcactaagacattcatgagggatcagcccacatgacccaaacacctcccattaggttccatctccaacactggggatcaaatgtcaacatgaggtttagggggacaaacatccaaactgcgacagatgtcttgtctaatttaagactcctttccaaaagtcagctcttccatgaaggtatcccaccatactgatctctccttcctttacattctttctgctcagcttctaagtagttctcaatccagggtgtacattagagatacttagagaactggcccccagcccacttaggccaggattctcacccttttccctgcactgggatttttaaaaggctccaaaagtgaatctaaagaacagcagaagttgagaaccactgctttccacacatcatccagcctgcaattatattctatagtactgccgatttatttatgcctatcatctcaacaaaactgtcaacaacccaaggaaagctatcaaacaattctttatctctcctacttcatagcacaacgctgaagactacagctgattgcaactggtatcccactgaaattacacttactgtggaacaagatgttgaaatgaggatgctaaaaagtgttacagtgagtctaaaacataagaatcagaaagcagaggtcaaagagtgtgaagacaaataaatagactagaaaaaaattaatgcataagaaaagaatctttaaagagaaggatgtttaatcaactgagaagtcattcatgcattcaattatttactgcaccagatatagtcttcatcactagtgataaaatggtaacacaagacaaatgccattcctgggcacttctctcatagaagttatatataactgaatctctgagaaaattgaacagattaactatgatatagtgtgataaatgctccagtagaagacatacagacagctatgggctcatatcagagaggcatctgacctagtcaggcatttcattcttctagacagttaaggggacctctagttaagaaaaccaaacaccacatgttctcactcataggtggaaattgaacaatgagaacacctggacatagagcagggaacatcacacaccagggcctgtcatggggtggggggctgggtgagggatagcattaggagaaatacctaatgtaaatgatgagttaatgactgcagcaaaccaacatggcacatgtatatgtatgtagcaaacctgcacgttgtgcacatgtaccctagaacttaaagtaaaatttaaaaaaaaaaaaaaaaaagcctgagttgggctacgatcaatttttcaaaaattttactacaggtgatcaattatttttatttgatcacaattctgaggaagacagtacgaatctactgctgacacgaacattccactccaggagacaagcagaactctcttcataaagtaacatttaggtgacttgcttgtacaaatctgaagtatgtgaatttgggcagcatctccccttgataagctgttaatcaaggattattatttggcccaattgctccgcaataggtttgacagaggcctcagaacttgggatatgaaacataaaattctagaactatctgcaaggttcagtaaccctagtggttcagcccaacactgtacctgtggcccacagctgtcatagataaggctagataacagccaatgggcatgcccgctttcacagccttcaagagaggatgaaacgtgggtgactctgtcatgtcaggcacagtgacggagaagggaacagctggacaattcggctgtattccataatcgtttttgtgcagttttagcctcaagattaaattccaggcccattggttaaatgaggtctcgggtgtctctccatatcgaacaatactggccaaatatgaaacctaaaacaattatttattttgagccacattagtcacacacaaattaaatcagtaagctcatacactcatctccttttgtgaccaacaatgccctcaacgcagaggaatattctacttgctggtctccaattaatgttcactgcactacatcaaagcaatttttcactcgcaacttgcgcttacttgctagtcactttgtgaacctgatcttagctcatgtaaaagaaaagtgacataaaagttgatactcaatgaatagtgtgccgataaataagtttaaccatcaggacggaggtctcatatatagcgcttgtcaattttggtggtgtaaaaattcccaccatggtcaattttaagctaccaatggtttaataacctggcttgcaaagtttctaaaaatttaagtcagttctccagagccagtacaaccaagctctaacacaccactgcagttcaattcaaattctgtaatattagaatagttatatacaggctatttcttaaagaagaatctttatcaaaccatagaagtcaattataacatcttaaattgctagaaatgttcttaggatacctaatggtcaatagtataagtctatcatctttatttctaaatgtcttgggaagataaagattcatgtttccaaatcagaagagaaggaaatacctgcttcatactttcagagagaatcccagcatatggcttctgtgcaaggtacttctgataagcttcaagaaccattaaagccacttcagcatggactgcttgatccagatgaagggtagccttttaaagagaaaaataatcacaaacatacaaccttggttttgttttgtttttgtacctttgaatcaaaacattaggcagaatagtaacaaaggatcttcgatgtagaagctaaatgttccaaaaatcacatcccacacagtcaaactataaaatgacaatgggcaaaaaactgtcaagggcaataacactgtacctagataggtttgaacctgacttaacccctactccagccaaaaaaggttatctttgaatgtcatcccccattccacccaagaatctctacaaacacttcgggtcaagggcaacgccacaaaccaggaagatgcttaattaaacagaaaaatatttaatgaactgtctaggcgtggtggttcatgcctgtaatcccagcactttgggaagccaagacagacagataacttgaggtcaggagtttgaaaccagcctggccaacatggtgaaaccttgtctctactaaaaatacaaaattagccaagtacggtggtgcacgcctgtagttccagctacttggaagcctgaagcagcagaattgattgaacccaggaggcagaggttgcagtgagccaaatcgtgccactgcactccagcctgggtgacagagtgagattctgactcaaaaaaaaaaaaaaaagagaaagatatttaataaattatgtctacattcccttttcctgttctatcattagttacaataaataagacactcagcaacacaggtaaaatattccttctgatgcctgaagttgcctatcaaatttcctacactatcttcctttgcagcctggaaaaatacattccttaaacctttcagaaagatgactttcctaactcttaacaaaggcataaggagactctcacgcagctcttcaagaggagagcctaggtgattctgttcacaagccagagaatgtgaaggtggaaaacagccccctgtagctcttgcctacgagcatgtcaatgagagagggcccagatgaatctatgggcagtcccaagtggtcaaggacacctcagcagaaaagctcccgggcttcagtttcctcatctgcacaacaggtatcatgctgtccaggactaaatgacttgctcagaacaaaacctgtcagacaggtgtaaagggctgagtttgccaccattttcccttttaaatgttaatcttcttatggaagagctaacaaataaggcctatggtaaagaggcagagaaggtcttttaacagtgaaaatcacttgaaatgtatctctgaagatatatgctacatagcaaacccttaataataaccacaccactgagtacgtaatgtgtggcaagaatcatcctaaacatcttgtgtttcctcatttgtttaacctttacaacaactctatgcgcagtggcacgcgcctgtaatcccagctactcggcagaaggctctcttaagcccaggagttcaaggccagcctgggcagcatattgagactccatctcaaaacaaaacaaaaaacaaccctgtgagacattgaggtatactcgttaatatgaatgtttacaaataagcaactaaggcccaaagagtttaggaaacttgctcagagtcacacagccagaaggtggcagaactgggatcagaacccagggaggctggcttagagctcagactcttaaccaatgcatagtgtttcagaaaacaaccctgacaatgacatgcaagacaaattacaggagaaaaaggaatgagaggcagaagaggcaattaggagaaactaaagtaactagccagagacaaaacaacagatacagccaggcacggtggctcatgcctgtaattccagcactttgggaagccgaggcaaggtggatcacttgaggtcaggagttcgagaccagcctggccaacatggcaaaaccctgtctctactaaaaaatacaaaaattagtcaggtgtggtggcatgcacctgtaatcctagctacttaggaggctgatgcaggagaattgcttgaacctgggaggaggaggttgcagtgagccaagatagtgccaccgcactccagcctgggtgacagggcaagactctgtctcaaacaaaaaaaataaaaaataaaaacagatacatgggaataaggaaaaagggaagaattttcaatgtggaacaatttatcctcatttaatagttgctcattctgcaaaagagaattaaacagaaaatcctaaactctgacacagctacaaagaatttgtagaccttgcaaatggtactcagaaatgttagtgttttgacaaaatccttctttgaaacagatgcatgtacaacctccagtctccagggaatggtttgaacacatacctgtttagcaaatccccaattcagtccttcaagaataacacaggccagtttattcttcaccactgtcaggttgtaattcaataaccaatcccgaatcaccgctatctcagatgcagaaggttgccaaagatacaaaggcagttctttaaacaagtatagagaaaccttattaaaaagaaaacaataatcattaaataaagacttagaaacaatgctatattactacaatattatattattaaactgcttgtaaaaaaatttctccaaaaggaactggagtttttgtttaatttttagacaagtgaaatggaaatcacggacaaccaaatcaagtgggtattaaaattgatgatacatcaaaagcacatttcataatcctttgtaaagatcaatctttttaaatattcaaattggtatgcttcagtttaggtaaaccaccacactaatgcacatttttaaagtcatgataaatcgggggacggctattcactttgcaaaagaatttagcactttaagtaattattcattctatggcatttagaaagatactctattggcttccaagccatccaggccgggggtggggtgagtgggagggtggtaagatgaaacaagatcaacaaagagaccaagagttgatagctattgttaaaacttgatgataggccattataccatactattctcattacttttatatgtatttgaaataatccacaataaaaaatttttaaatcctatttacagaaagtctacagcactacttttaaaataacacatccaagtgtgcaaattaagataaatctgggccaggcatgatggctcatgcctgtaatcccagcactttggggggcccaggtggacagatcacctgaggtcaggagtttgagaccagcctggccaacatggtgaaacctcgtctctactaaaaattagccaggcatggtggcacgcgcctgtaatcccaactactcaggaggcaggagaatcgcttgaacccattggcggaggttgcagtgagctgagattgaaccactgcactccagcctgggtgacagggcaagactctgtcttgggagaaaaaaaaaaaagaagccaaaaacaagaaaaacacttgagaaaaatgtcatgagctcaaactgaaagaatcatatgatccactgtacatttctctggaattcatccactaatcactcaagaaggagcaacagaaaacttcctactgtattgaactgtatatgaaaagctttttatctcaatataatcatcttgcagtagcatacaatgtttttcttttctttttttttttttttgagacagagtctctatctgtagcccaggctggagtgcagtggcgtgatctcagctcactgcaagctccgcctcccaggttcatgccattctcctgcctcagcctcctgagtagctgggactacaggtgcccgccaccacacccggctaatttgtttttttttccatttttagtagagacgggatttcaccgtgttagccaggatggtctcgatctcctgacctcgtgatccacccgcctcggcctcccgaagtgctgggattacaggcgtaagccactgtgcccagccaacactgtttttcttaaaaggaaaatgaccatgtactgccactatggaaaacagtatgatggctcctcaaaagactaaaaatagaattatgacatgatccagcaattctacttctcacatgcccaaaagaagtgaaagcaaggcccgaaagagatattggtacatccgcattcacagaaacattattcacaatagtcaaaaggcagaagcaacccaagtccccatcaatgactgaatggataaacaaaaagttatacacacacacacacacacacacacacacacacacacacacgcaccaaggaattattatacaggcttaaaaatgaagtaaatgctgacacatgctacaacatggatgaaccttgaggatatcatgctagctgaaataaaccagtcacaaagaccatatattacatagttccattaatatgaaatgtctgaaataggcaaaaatctagagacagacattagattagggcttagggccctaatctatgaaaggtgcttaggaccccaacctaagaaagcttcttagagctgaaggagatagaagagtaagagtgatagctgggccaggcacggtggctcatgcctgtaatcccagcactttgggagaccgaggtgggtggatcacctgaggttaggagttcaagaccagcctgaccaacacagtgaaacctcgtctctattaaaaatacaaaaaaattagctgggcatggtggcgggcgcctgtaatcccagctacttgggaggctgagataggagaatcacttgaacctgggaggcagaggttgtagggaggcagaggttgcagtgagccgagattgagccactgcactccagcctgggtaacaagagcaaaactccatctcaaaaaaaaaaaaagtgatagctgaagtctaagggtttttgaggtgatgaaaatgctctaaaattgactgtgttgagagttgcacatatctgtgaatagactaaaaaccactgacgtatatactttaaataggtaaattgtatggtatgtgaattacatctcaagaaaacttttgaaaaactacatgaagattgcaaaagggattgtgacaaatgacagaaacaaattaaatgtgtcctcctcaacttaagttactacatactatttattttgcttttggctgactttaaataggaccttctttgtcagttgtttattccaagtataaaatataaaaactatgaaagccaaacaaattatgaaataaaaattgttaattaactataggtcataagtaaagtaaaaatatgttattgaacgaggtggacaagtcaaccttgagatttgagagaaacaatcacatctttttataagcagcagctaatcccaagttggtgtggtgagtgacacagaggctggcacagtaaatgttagttccttttatcctgtttatacccctagtgacaagatcattcccaagaaccttcctatttttgccaatgttccattactccaagatttgaaaaaacaaaaacaaacaaaatcagtgctcttaccattccaacctggtcaatggtctcttgaactctatccagaaggacggaaattatctcagggtgaacagctgtgatagtccctaaaagctctcgaccaacctttgaaaaagtctctctggtagacaaggtgacataagatacctaaatggggggaagggggaagaagatggcacttttaatatcaattagcagtcaaaacacacttatatcattttttcaagcaaagcagaaagaatcttacattgagccttaattgacactatgttccaaaaaatgttaaaacttcatacaggcaactgtctactctgaggccgaaaggtgcagggagaggaatataagagaatggcaacttcttataacaatgacttcaagtgtggattcaaaaagtatatcccaaagtctgtcggtaacaataaaatggttcctgcagtttcaaaacttttctaaatctgaggaaatcactacaatgatgaaaatcagaatgcatttcatggaaatgcctagcttcccctacagaataagaaccctaactacaagaccttctaaaacattgtttaccaactccttttgaattatgtcttccaaagtgtatgttacaatccattaatgccaatggtattttttaacacaatggaatatacagaaaaataacagaataaaataaaatagaaaaatgtaatagtgtatcacaggtagattaagtattgcttcaattgtacatacacacacaggatcagaatgtaatatagaatgtaatttttattgtgactcctggtcaaaacactggaaactttactcaagagcataaatattactttagcaacagatcttgagaatgtcacttaatgtctgtgaaaatatgtcttctctccccaagtttttcagatcatgaagacagtctgaattccagatccatcgagatcttaactttatgcatggttatgaagtaccagtataggaacagctgaatcaagtatttgatcctggaaagaacatccaggtttgtcattctcaaactggattattaggggaagataataaaacccaaataatcatcttcaaacataattttacttgagcacactagaatactttggaggagatattttgtatgcagataaacagataaatgacagcttaaagtgtaaaatgtgcaaggctttttaaatatacaaaaaactccaatgaacattttggtaaccactttgggctagtccctagatgctcaggggtccaaatttcactcccctccaccttcacggatggctcagtgaaaagatgaagaatgcaaggatctcctcccagcctgtaatttcatattatagatgaggaaaatgaagcctggggtaataagttatcttttttgatgtgagatggccaattaatagcagagttaaaactcaggtatcctaactccaggttcaatattcttcccaccatctcatttaaactggctgggaagctaggtttctgctactagccagagtggaagagtttagttgaaggggtgggggcgagggaaacatacatcataaaaactgtgtcaggctgtgtcacattgtctctcccttactgaaactggtgcaacaaatttcaaaagataataagtactggggaatggatataattcacattttcaataatccctgtagcaaaataatgttccactgattctctatcccttctctgaagtgtagacagtagctaaataagtcacaatttgtaaaagcaatcccccaaaaaatcaacagatggacaatccaaaagaaaacatttttagctgatttataaaacttcatattctaacctcatatatctccagaacaataatttttatgaagtcttcgtccacattggttcttctggcctgagccatctgagcaaaggtagtcagaaggcaaatctcttctgagctattcatagaagaaagacacttctcaaagttggtaaaatgttctgggtctgcaagttcatatcaagaaaattagagtggggaaagaataaatttatatcttttaatcactcttccagagaaaaagatttaggaatatttaaagatacaaaaggtctttctttgttccaaaatagatttctacaggcatcaggaataaggctggaccagatggcctctgaaattccaacaaactctaaatataatgtagcctcacagaaaacatttaacatctcttagcttcagtacccacatctgtctcaaaaggttacttaataagaaggttaaatagcatgtcactggtgacgtgcttagttaactgcaaagcactgctgctgtcaccaggcagtcaccttcaaaggcagtactgccaacttcaaaggcacacttgaagctacttggtaactgtcagacaaacaaagacctgactaatgaaaactgctaatactagcaactacttggcacaaatagggcattccaaaaaaaagagatttgcttatgaagaaaaactgggggcaagaaattagttataaccgtaaatgaaatactaatgaatgtcataaacgatataataaatgtgatatgttttgcctatatcacaaaggatgttgtaaaagcaatactaaattctgccattaggaagcaatattcacaaatatacatgacagtaaactacatgcaaagttctacagcagaaaggaaaaaaagcccattttaaaaatatatgtgcttggccgggcgctgtggctcacacctgtaatcccagcactttcagaggccaaagatgggcagatcacttgaagtcaggagtttgaggccagcctggccaacatggtgaagcctcgtctctactaaaaatacaaaaattagctgggcgtggtggcacacgcctgtagtcccagctactcgggagactgacgcaggagaatcacttgaacctgggaggcggaggttgcagtgagccaagatcacaccactgtactcccacctgggcaacagagcaagactccatttcaaaaaaataataataataaaattaaattaaatatatacatatatatatatatccttgatggaacttttcacagtaagaaggcaacaagccaataattcttttcatatttacacatttgagaaaccaaggtagatagctcaccaaatttcctgcattttcaaaataactctgggacatttaccaaaccaattttcattttccatctccaaattggatttatagtggaaattattacacaaagtattcccagaataatgaaaattggcatgatcattctaacgtatattgtgaaaggatatttaaaaagaaaaaaaagaattatcattcaaacttacaatgtttaaggtacaaatcaaggaaaaggccttatattttaaataactctatagaaaaaacaatgggaaagtgaaataactttctaattagcttttaaaatattaactataaggacaaacacatttctacagttatttatcatcagatttgcttatggctacactttactagtagtcagaatgttgattagactagaaataaacaaaaagaagccaaattaaaacagactggtttttaacaatcattgctaagaaatctgctagttagaaaatgttaaaactagttaaaatttgttccctggaaactgatttcaagctcaccctactcctattaccacagataaataagaactggttataaagaataagcacttctggcatttactaaatataaaaagtgaggaagggaaaagatgttagaaagccttattcttccacaaacaataaaaatcaagcctcctaacaaaattgatatataaaagattaagcaaaggagaagatgaaaaaacagcaaattagagcaggaggatcaaattttgcaaagactccactctcaaagctagaacatagtaggcagatgaaacttctctactgtgccactaactcctgtgtcaggtgatacaggccctaagggagataaagataaaagtgccgtggaagcctggagtccagacagaaaactccagcagcaggatccaaagctctagggcaaggcaaggctggtactgccacttcagggtctggaatcacatccactacagagctgagctgtttgacatcggctccatctgccacatgctaacacagagcctggcagatagtaagtccgcaatgaagggagatgacactacaaaggagacctacccaggactcaggtatacaaagtagtgctgctgaccatcccaggcacttccaaaggaaatgtctgcttctgtattagctatttcaaccacagaaatagccgccagaggacagacaatggctgtgagacctctcacctagctcactcgtaagcccaggtccaaccacggcaatggtctaatagaagcactgcccccaggacagtggagaagcactttacaaagaataataatataaggaatccagagctaccactaagaagatagaaagaaaaacagaaagggacaaaagaggacgcatgcagagccccataaaagaaaaaaacagaaacagaagaataaagacatcaagagagacagaaatggaggctgagtacggtggctcacgcctattatcccagcgttttgggaggccaaggcaggtggatcacttgaggtcaggagttcaagaccagcctggccaacaatgtgaaaccctgtctctactagaatataaaaattagctgggcatggtggtgcacacctgtaatcccagctactcaggaggctgagctaggagaatcacttgagcccgggagatggaagttgcagggagctgaagttgcaccactgcactccagccggggcaatgctcattctcaaaaaaaaaaaagaaatggaaataaaaaaataaatcatgaatgtctgcagaaactactttgcaaacagtagaggcccaataatttttaaagtatatgattttcttttaagtgatacagacatttaaaaatttggaaaacagcctttacttcctgctgtgaaggaaaaaacacttggaaaacagaattatctttggtgtttttttttagtcttgtatttcagtaaattgtctatcttttttaacgtatagggtagttttttaaaatcactacaacatacatctaattaaatggtgtttttcatttcgaacattataattttgttataagtaaatatcctggccaggcacggtggctcacgcctgtaatcacagcacttgggaggccgaagcaggcagatcacctgaggtcaggagttcaagaccagcctgggcaacatgatgaaaccatgtctctactaaaaatacaaaaaatagccaggcgtgatagcgtggacctgtaagcccagctactcaggaggctgaggcactagaatcacttgaacccaggaggtggaggttgcagtcagccaagagcacaccactccactccaacctgggtgatagagtgagaccctgtctcaaaaaaaataaaaaataaaaataaataaatatcctgtagtttagaggtggtatgacgcaaaaacttaagttttcaccaaaattaatttttaaagtacacctgtctacatctttagttcataaaaacaatacaactttaaaaaaacagcaataaaagaaagatattaaaatggctgggcacaaagccttaacaaatttctagacaattaatacatatctgttaatacaactgtcaactagaataatttcacacacacatgcaaaaaagtgcttcctaaaagttagaatattgtgtgtattggtatactgtttgggactaatcaaattttgatttcagatatgctagttgctatttaatacatcaaaactgtgaagcagtctcctgaatttcaaaatcattacacatgagtatgtagagtaaaacattttctcttagtccttctaaaagtaaaaattaagccctgaagagaagcacaaaaagatagggagagctggacgccgactgctcggcggggctgtaccttggagctgctgcttgcactgggcgggctgcagggaggaggagagctgctgcaggttctcgctctccacctggtgcatgaggtagaagagcttccacagcatttgcacagacagagtcccaaagggcatctcggacataaacagccaaatgccaagtctgcatgtaagcaggaatcattttatttattaatcagcttcattacactaagaaagtagacaaaccattggctctcaaggaaaaaaagattcttaaatcacactatgatttttctaatatgctttagtcataaacacctcaaggatggctaagaataacagcaaatacaaaccacccagtctgtgccagggactgttctaaccacaacaatgtgtgcatgtgtgtgtgtatacatgtatgtacaatatcaactcaaaccatcctcacaaaaaccaagacaataattatggatatggccgggcgtggtggctcacgcctgtaatcccaacactttaggaggccgaggcaggtggatcacttgaggtcaggagttcgagaccagcctgaccaacatggtgaaaccccatctttactaaaaatacaaaattagccaagcgtggtggcgcatgcctgtaattccagctacttgggaggctgaggcaggagaatcacttgaacccaggaggtagagattgcagtaagccaagatcgcaccattgtactccagcctgggcaacacgagtgaaactccaactcaaaaataataagtattattattacggatattagcaccaatgcacacaggctactaaggcgcacacaggtactaaggcacacacagtagtgggtggcagagaggccagctgtggatgtgtgtgtctgagcacacacacaggtacacgtgtgcccacagacacatgtgcagtgggtgggaggaaaatcgaaatccatccagtactcctctctgaacactgaacaaagttcaaattcctcagcccacattcaaaggcttccacagtatggctctgaatcatatttccaaccacagccctctctgtcctccttcagttaccactgcattccagcaagcctggagagaccccacacctccaggctggctccttccatgggtcaagccctccttggacttcctcctctgcactattacagaactccatccatacctgactttgccatcatcatacattctgccagtgatccccacactgtagtggcagaaaaaccacctggagactttctggaaaatgcagattcccaagcctcacctatagagaccatgattttgtaggtcacagctggggcacaagaatttacacctttatagtcacccttggtgactcagactcaagtgattcttaaaacacaacatgagaaacccctcatggtactgtaatttacatatgacatactaacctaacagcaatttgagagcagaaaccatgtcttgttcatttttatataaaccagtttataactagaaccttgtattttaattatctgctacttaaaccagtatctcaaaaacaatcagcactcaatagatgcttattaaaattgtatgtaaatgttatcacaactaaaaaaaaacacttgtatcaggatggtggccatgccccaagtcagaatctgctaaggaatggctggatgcggtggctcacgcctgtaatcccaacactttgggaggctgaggcgggcaaatcacttgaggtcaggagttcgagaccagcttggccaatatagtgaaaccccatctctactaaaaatataaaaattagccgggcacggtggtgtgcgcctatagtctcagctactcgggaggctgaggcaggagaatcacttgaacctgggaggcggaggttacagtgatggtgtcactgaactccatcttggacaacagagtgagactccatttcaaaaaaaaaaaaaaaaaaaggaaatctgcaaaggaatgtacagcaacttacctgttattaaattaaaaaaaaaaaaacttaaaaaaatacgaggcactcaaagctgttgccgtatttgagaaacaactactacaaatcatccaattacaaattatctaattacaaataaaccaaatttaagaaaaaaatgaatagtgcatgcctaatccacatctatgaacctaaacaggcaactggtagttcaaacccacacttacctggactctggaaaagccagctagacttctgaacaagagattaagaaacttctctaaggtcagttgggccaggtttctatcttattagttaattatcctaacacttcacatgggacctgatgctgttttataccccaaaacaaagaagggaaattgtagaggacttaaaagtaatatcacaaacagggtgtatttcaggctataaaattccctatatggcagacattcaggaagtctggcatatatatacatatatatacacacacacacacacacacacacacacacacacacacacacatatgtatacacacacatacacgtatatatttatataggtatttatatatatatacacatatatatagatatacacatatatatacacacacacatatatatacacacacacatatatatacacacacacacatatatatatattttgagacagagtcttgctctgctgctgaggctggagtacagtggcgcgatctcagctcaccgcaacctccacttccggggttcaagcgattcttctgcctcagcctcccgagtagctgggattacaggtgcctgccaccacgcccagctaatttttgtatttttagtagagacaggttttcaccatgttggccaggctggtcttgaactcctgacctcaggtgatccgcccacctcagcctaccaaagtgctgggattacaggcatgagccaccacgcccagccctggtttatatttttgttgtctgtcttttagtatagttcagttttgttttaggttgaagggatagctattgccagaaatttccatttgagtgccgaataaatttaaatttcatggctttaaatatctggttctcatataatttgtttcctaaaataaacttaagaacaatagctgtcaacattttaaaacaattatctttgtgaaattatatacacaatgttacagcaagggttcacagctcaatatataagctctagtaagtaactaggatgagagctttgcctctccactaagcaagcacaagaacaagtaacagatcagagaaggaagactcctcccatgcaccaggccagcgtcagtggacaggtgctactgcactgatgccctgacacagtcctgaacaggatttggtgcatctcatgagaccaccaaatttatggtataagtataacaggagtaatctaaagataaggccgggtgaagtggctcatgtctgtaatcacagcactttaggaggctgagccgggcagatcacttgaggtcaggagttcaagaccaacctggccaacatggtgaaaccccgtctctactacaaacccaaaaaattagccgggcatgatggcaagcgcctgtaatcccagctacttggaaggctgaggtggaagagttgcttgaacccaggacacagaggttgcagtgagccaagatcatgctactacactccagcctgggcaacaaagtgagactccatctcaaaaaaaaaaaaaaaaagataaatttctatacccaagttctatttaagttagactcaatgccttcacagtgtctaaaagtggttaacacttagctaagacctcctgatctttctctaagtctctagattattctattccccagatgaaaccacacaagaaaaacccccacttacatttgaaaagtcctttatggtttaaaatgtatttcctcatattaccacaattcaccctcatcacacatccatgaggttaatggaacagtagtatcattatcaccatctccgttttagaaatgaaaaaagtgagaccacaaatattaagcgactttcccagggtaacagtaaatggcagaccaagactcaaacttactatacaacacagaataaatcaggggctaaggctaagagttacatggcaagagggagtgtaggcagctagctcaggagagggccaaagcaggggagagccagtagttcataagcacagctgggtgggggtggaggcagccccgcatctcctagcggagggcataatcctgcagcagagcccactcctcaacttggccagtggctcagggaagggagcacgggatgtgcagctatgcccttgcctatgcctcaaacaggtcctaggctgtaagcagtggcacagtcagcatgatccaaagacagcatttacaaagctaagacagggaaccaagatccatgacattcccagaccttaaaacccttaccggaaggcaaattgaacaataaaatcagcaaatcatttgcaccacatgctgcacacctactgcgtctcactgcaggcactgcagtgggtatgtgatagatagaatctatccttgttttcccctgctcaaggctgccccaaaagttcagggtggcaaaaaactgagacaccagaatagtgttatcttaaaacagaaagaaattgagagagagagagagaccatttcagtcaacaggtgggtactacagataaggaaaccaaggcccaagaatttgccctcaataagaaatagatgaaatacactaagaaactattataaaagacctacttaagtggctttcaccgaatggttcttactagtgaggaagttacttctcactaaatatcatcatatgtcttacttaccttttggccttcagcacatgtaggacagccctcaaaaacagttcatcaaattcaacctgtagtttctccatagagtagggctgttgggccaatcctgagccttggttatggctcacatactgtgcccaatggtcacttacataaccaagagtcatcctgagcatgaggaaagataatacagtacttttcattagctcaatatctgcacctttatattacatttccaacattcatttattcaacacatatttattgagcacctactatccacctactattgtccaggttctgaaactaatgaaatggggaaaataaaatcctaccttcatggagcttacatttagtgaagggcaaagagacaacaaataaaataaagtcatatacagtctgtcacatggttgtaagtgacactgagaaagataaagccagagaaaggaataaagtatgtctggaggtggaggggtgggcaggataaggaggtgggttgggagcacgaaagggcttactaaagagggacatttgataatgtctggaaaacagtgaggaatcacataagtctctatgagaagagtgtccacgtagaagaaacagccaatgcaaaagcgccgaggggtgtcaggtatgtttaggaacagcaaggaggccaatgtgctgagaggtagactggctggagatgaaatcagaaaagtggcaggaaaccagatcgtgaggggccctgcaggccactgtgaggacgtcggctttttccctgagtgcagtggggagcacagtagggtcctgggcagacagtgaatgggctgactcacaattcataaggaacactggctgtttaagaatacactgaggtggggaaagggcagaagcgggtggtgggcaaagtcagaagcaggaagataagtcaggaggtttaggaatgaaatggggtgctagcagtgaaggcggtaagaagcagctagattctggaaggagcatgtttcattgattcaaaaggatgcatgtctttcacactagtatccctgcaattagaacgtcagaatccatgttaatattaatgatgtgatgccataatttggcagcattttccctatgttagtggcatataaaatgtatcttaaaaaataattggtggcattttagatttgataaaagatggtattttgatggtggagatgataaaatttgcagttagattgaatgtggggtataaaagaaagaaaagccacaggtggcaccaggtgttttggcctgagaaactagaatagagttgctacttaatgaaactgggagtagtagtttgggaaggggggagagtgagttcattttgagaacactacgttacaatgttaatgagtcatccaagtggaggtgctcggttggtagttgaatatacaatgtgtttatgagagaggtatggactggaaatataactctgagaattgtaacagtgtttagatatttaaagatgaatgaatgacatctcaaaaagcaagtgtagataaagagaagagaggtccagggactgagccctgagacactctaacattaagaagcctggaagtgagaatgaaacaaccaaggaggcagaaaagggactgtcagtgaaatggtggagaaatcaggagaatgtggtatcctggaagccaaggaaagaaaatgttttaaggataaaatgatcaactaactacgagaaaggctgctatgtaagctgcgtgagagatgccaagtaggatgaagagacccagaactggccactggatctggagcacaaggttcattagagatcttcatctgtaggagctgtttgggtagcggtgggaggaaaagcaagttcaagtgaggatggaggaataaaatgggaactaatagacgatctgaaggcaagcccttatgggaaattgttctgcaattagaaggtatgagaagaatctgcactagatacaaaaagtaagcagatggaaagaaaaacaaagaaagaataatcataatacactacagctgttatttacacaataatgtaaacagtgatcttaaaacagtaatgataccaacgtccttcctatagagttactgagagaataaaataagaaatcacagtcctggcatacagtaagcacgcaatcctacatcatgtaagtgagcttatggacaaattttatttatggtcttatttattaagaaaaatcagaaaaagaacgtctggatggacttctgttaataacaggtagatgggcttttagcttttaacaaatttatctccaagtcaccagccatcctccctcccactgtctcattctcctaactctatactcaaggctttctctagacctcaggagggacccccaggccgggcacagtagctcatggctgtaatcccagaactttgggaggccaaggcaggcagatcacttgaggtcaggagttggagaccagcctagccaacatggtgaaaccccatctctactaaaaatacaaaaagttagctgggcgtggtggcacacaccaatagtcccagctattcgggaggctgaggtgggagaatggctttaacctgggaggcagaggttgcagtgagccgagatcgcaccactgcactccagcccgggtgacagagtgagaccctgtctcaaaaaaaaagaagggacccccacccttttagggcatcctataatcacttgactgatttataaagctaatggatacatatctaaaataaatgaattaggccaggcacggtggctcacacctgtaatcccagcactttgggaagccgaggcagatggatcacttgagtccaggagtttgaaaccagcctgggcaatgtggtgaaaccccgtctccactaaaaatacaaaaattagccaggtgtggtggtgcgcacctgtaatcccagctactcaggaggctgaggcacaagaattgcttgaacccaggaggcgtgggctgcagtgagacgagatcgtgcccactgtactccagcctgggcaaaagagcgagactcatctcaaaaaaataaaaaaataaaataaatgaattaaaagtaattttgttttggaagcgaaaggagggagagaagttttgtagttttatggagtttcttttgggtggggaaggaagttgaataacagcatacgtatatgctataagaaatgatccagtaaagacaattaaaattaataaagcagaaaaaagagtataaaattaattcaaagaaaagcagtacatattctctaaatttattaagacagctgaagcagtaagagcctgtattttcctagatgccttctctctcacccagacttcaacccagcaacagctttggggatctcaactccaagaacaatcatctagcaagccagttaaatttgagataattaacgaaatactctaactggaagcaattatgaaattcccatcttatagatggtgaagaaaaaaatcttaactattacgagaaataagacctgaggtttacaactaaaacgtccatcatcccaattatgcagtatctgtgtctgaccagggtgaaaggaacagagaagggtagagcaacagcagtattacctgatcatataaccaattcgcttcacaaactgcctatagcgtgctctattaaaggtttctaaccccacagccagaagttccactagtgagttggcaaaggcaaaaattttcatcatctcttgaggtcttgttgtttcaggtaaataatcacctagaagttaatcagataaaagaaaaaaatcatagttactatgaaaaaacatgaacggatacatctgtataaatattttaatgaggactcaaagccaaggtggagaagaactgacagtctcattactctggctcccatatcaacatgaaatgggaaaaaacttgagacaatgtgccaaattaaaaacaatttatttaagttgggaatgtgcaagctagctagctttctcacatttaagcaccaagtgggaaattacaagcacaagaggagcctagaacagctaggcacaagaaacccgagttggagcctacacaagaagtaagactcgggccaggcacggtggctcacgcctgtaatcccagcactttgggaggcggagacgggcggatcacgaagtcaggagatggagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcagagcttgcagtgagccgagatcgcgccactgcactcaggcctgggcgacacagcaagactccatctcaaaaaaaaaaagaagactcaatgcagagttcctgtgtttacacttgccactaccacattttacacttaagagaaatgagtctaccttttgctttaaacccaagaagatgctgaaagagttcatgaaaggggaactgtgctaaaatggtaaccaaatcatcttcattaaggagaatccaactggtctcagggtcttcatcctaagggaaaagacaaaaaatcatgtcagcagatttgatcagatcacactatgatctagcgttacaggagctaaattatcacaggtctcaatggtatacatgtgatatcctcatgagtcttcatggaccttttctccaggacagcaatttatagtatcagttccacagacagttacacagtaaatcccctgaaattccaagcacaattttatatgtatctgggtcacagcaagtgattgaaactgctctcattaaatgtccatcccaaagaaaatagaaaaaaagaaatcctctagagtgaggaccttatagggatcagtgctttgataacatcaattaaagaaccacagatgggccgggcgcggtggctcatgcctataatcccagcactttggaaggccgaggcgggcagatcacctgaggtcaggagtccaagagcagcctgggcaacatggtgaaaccccatctctactaaaaatacaaaaattagccagatgtggtggcatgcacctgtaatcccaacaacttaggaggccaaggcatgagaattatttgaacctgggagtcggaggttgcagtgagccgagatcacaccattgcactccaggctgggtgacagaacgagactccatctcaaaaaaaacaagaaccatagatgagagttcaaagttatgttagctgcaattctcttctcccaaaatcaagatctatgtagtatgcaacagacttaagacgaagcaattgacatttgctataggtgactaaagttctgttgtcaattactgctgccaaaagcagtataaaaataacagtggtcatacacaaagattacataggggaaatctttgcggtcttttcgtttgacacagagcactaaagtcaccttagaaaccaagttgattcatgtcccttaggacatgaccattaaaaaggacgctaccattaaaaagggaaggaagtaaaaagatcctgagaacctgaagaatatatcacctcaatttcaacaagggactaaggcaaaatcattcataatttccttaagccactcaatttttacactcttattatgtatctaaaatggctaacaagcatttcagaaactctacttaaggcagtagttctcaacttagctattctcaactcaaaggtacatttaacccccagggaggcttttaactatttggatgtctgggtgtgggcctgggcaaggtttgcaagttgcccaggtgattctagtatatagctagtaacaagaaaccaatgatgtggataattcagagtgccttcctccctacagccttttctgaggtaatggcactcccaactttctcatctactcctcaagttcttgaattcactgaatatttagggagtgctaaacaggagccaggcaccaatgcagggtgagataattaatcaaatattttgactggaagtatttataacgcctaatcattacatgtaattataacgctccttaatcattatctgtctgggattaaatgcaggaaacctaccagaaaaaaagacttctcccccaagaaagaccactctaaaaaaaacatattgctccactacaatctttaaaagaccaatctgtactggctcctaagaagcttgcttcagaatgactcctcagtttctagcaaaaatgcctgcacatccacgtcatttaccaccacctgaccacctcctcctgcaagtctcaggaagagaaaaacgactgtgaagggggctccctacttctgaatgagcactctgggaaatacacagacacgatccaacagctgccacggctgtcattctgagaactgttggctggacactttcatctccttttaagagagggattataataaatcggtcactggacattctagacaagaacaccaaatcaagattcagaccaaaataaaggactagaactgataattagctggagaacagaactgcttacaaatctaatcacaatgactatagtagaaaggaaaattaacaagggtgatctcgagaagctggattttgatcattaaattctcaccaaaaatggaaaaccatcttctacctttcaaatgagaatttctggataagaagtttatgagttaagggaaaactttgctaagctccagctctttatttctcagattcatatcatctgtaggtgaggctccaaccccagcaacttgttactatataaaaaaactcctaatatacatcttatgtaatatgactttaatttccaggtgccaaattctcccagctgaacagaatgatattctagagaaggggtgcagcacagcacactggctcaaagcataggctctggaggctccacatttaatgaccctatggtttaagagaagatacttcacacccctgcacctcagtttcctcatctataaaataggaatcataagtctttacctcatggagttgctgagagaattaaatgagatactatgtgaaaagtgcttagaacaatacttggtgcataagaagagttcacaatgattcatcaaaataatgcagatatgacaagttacctcttctcctccttcgtctactagcgtccaagtcccagacccaggccctgaggaggatggcttccgctcgctgggcttcatgtggcacataaactcagctcgatttctaaaggacaagaataatcactcccatcacttagatgtaggctacgtgagtgcattgtggattctctactcaccctgaagaagagccacacatcatcccaatcttccaatggtttaaattagtgaataagaactggccaaaaaccaaggctaataaaactgcactaattttggtggagaatgcaaccattctgaattagtaatgatgaataattgcagaaaagcagctacactagcacagctccctgcatgatgcaggacctcaatacatatgctgcggaccttaactcaaaccaggctcacaaagtcttgccagggaaactattttagcaactatgagttactgaataaaaaagggtaatggaggctgggcgtggtggctcacgcctgtaatcacagcactttgggaggctgatgggggtggatcatgaggtcaagagatcgagaccatcctggccgacatggtgaaaccccgtctctactaaaaatacaaaaattagttgggtgtggtggcacatgcctgcagtcccagctactcaggaggccgaggcaggagaatctcttgaacccaggaggcagaggttgcagtgagctgagatcgttccactgcactccagcctagcgaaagagagagactccctctcaaaaaaaaagaaaaaaggtaatggagaggcttgtttagggccaaaacatagatataaatgcaaaaacacttgtgagtcaaatcattatctaccacgtgcaggagcaggcccttgtatccaaggcagtaagggagaggaaccatcaaatctaaactcctcatttaatttcaaggacttctataatccaacccacccgagttcttcacctctattaccagctcccgcacacacctttgcttcagccacactgatctacctgtgctccgtacagctatcctaacctgtgttggggcctttgctcacactgttctcccacctacatgttctccattgtcccgttctcctactgaaatctaatccattctttttttttttctttcagttggaatttcgctctatcacgcaggctggagtgcagtgacacgatctcagctcactgcaacctccgcctcccaggttcaaatgattctcctgcctcagcctcccaagtagctgggattataggtgattacaccaccatgcccggctaatttttgtatttttagtagagacggagtttcaccgtgttggccaggctggtctcaaactcctgccctcaggtgatccacctgcctcggcctcccaaagtactgggattacaggtgtgagccaccatgcccagtccaatccattcttcaaacacagctcagttaccatgaaacactctgactactccactcaactctttattctcttcatttctattgcatagcttcgcaatttagcacttaaatctctctgtgctatttctcttctggcattaaatctcttcttccaagaaacagatcaccttttttgtctgtagcacctttcacaatagtatatatgacccactaaaagggggaacccataaaaatggttgcttatatataagcagttgaagggtcactttgaaacaagtatcaaacccaaagaaaatctgcaatgttaaattctagaatgccaacacttcccttagctgttcttctttggatctaggcagtttcaggagccaatcctttagaagaaagaagcatttcaatctctacttcacaaagctcttgcacacttacttgacaggagacatcagcagggcaagggattgcataaaatgaaagacccctgatgggttatgcaacactttgatctgaaatcagaaaagcaaaaagcatactgtagaaaacaaataacccaagtgtccataatcttggttcacaagcattctgaccaaagttgctgttaagagaacaaagctgaaactggtacctaatacacaagagtaaagcacagcccatgggttacctggtggcactgagtcagctgtactcaaagagcagaggtaactgagcagtttccaccaattatctgtaacaacatgggatgaaggacactactgctactttaatccaaagagagacaaaacaaaaacaaaaaaaatcctccttctacctaataagattcagacttcttgccaccagaagtgctaaagaaaaggaggtgtggagaagctgaatttggcaaacattttggctcctgcaaattctaagtggttgctatgagtaacaaaatgacccaaaggcaacagcagagaggagaatctaaaaaccacatagtcaactcctaagtatacaagagttgatcacatagacctgagatctctgctaatattaaagaactttgagatgtggtggcttctgtttgacctgtaccaactgtggtgtaagacagattgacttaggaagctgtattgagtaccacgggaaaaaagtcctggtgagcctttctacacaggaattgtgtagaattaaatgcgactgaaactacccagccagactacaagcagacttagtacagtctgtactatcaattatgggtagcccaacaagtttcagtctaagaacttttataaatgtatactggatatattttaagaattttattttaaatattactcttttttaaatagtcctttttttttcagcaatttcttcaggaataatgtctaataaaacctctcccccaacccctcagaatgagttgatgattcatcatacctggataaaaggaacagcccatttactaacaccagcggggcatcgaagaatatggtttagaaggaagaggtgatctccaggacagccaactctttgtagcacggatacctgaacaataaaggtcatatgatctcactatttttaataaaagaaataatttatctaggggtctagtaaagtcatttatccagtgcttcaatacatgcaatctttcaaaagagtaaccagacacaagatatactattcactgatgagtttctacgaggcctacaaatctatgagtactatgataacatcataagcagattctctacaaatctagctttttcttctttggcaaataacaaatcactaatttcctggccacaagtgaatagatataagtcaagtagtttaatctattcttagtttgtaatggtttcttaaatccaaataagtatgcttgaaacattatccttcatttaagaactctagtacaaacctaaaaagagcaaccaaggcagccccactgaaaacataaccaataaataaatagccctcttcccataacacactcaacatctttcctaagttttccaaatccttttacctttcttctttctcttaaaagaaacatttttaagcatgacattaaatatcacgacaaaaagaatgacatatagaaaatttttgatcgatactttatctaaaatgcacaagaccagaagtatttcagacttcagattttttcggattttggaatatttgcataaacataataagatatcttggtgatatggtttggatgtgttcccacccaaatctcaacttgaattctatcatccagaataagatagaattcttcttctccattgtgggagagacccagtgggaggtaactgaatcatgggggccggtctttcccatgctattctcatgatagtgaataagtctcacgagatctgatgggtttatcaggggtttctgctcttgcttcttcctcattctctcttgccaccaccatgtacgaagtgccttttgccctccaccatgattctgagacctcctcagccatatggaactgtaagtcaaactaaacctccttttcttcccagtctcaggtatgtctttatcagcagcatgaaaaaggactaatacatttggggctgaaacataagtctgaacacaatattcatttgtaattctgtacctgagacaaagtttctattaagtacttaggtgtggaattttccacttgtggcatcgtatcagcactcaaaaagtttggaattttggatcatttcagatttctgaattaggaatcctcaacctgtacctatattctgaatatacatctagtcttcaatttcgcatacttcctgcatttccatttctttcaaagctgaagtccagagttcatttagcataatctttactagagagaaacatactttgtgctcaataatgcactagataaataacttactaccatgtatcatgatcaaagaaaagtcattaataaactcatcaaataaattagctgaaaaagttgaagaccaaatgtaatgatataacagataattcctaaattatgaaagaaataaaacaaagactactgtgtctatctctgtccccttaccaatttctgcagccagagaagaatatcatcatgaaactgagtatcttcattaactctcctggtgaacatgaataagacactaatgcattcctttagttgacacagatcagagggaatgctttctgtctgcttagacgctgtaaatgaaagatattaaatgagtctctcataaatggtgtttttgggggaatttttagtgtcttcacttaaaccaataacaacaaaaacctttaaaatatttagtgcagataaaaggagaaaagttacatcaaaatacttaaatttttataaacagacaagtcaaaaatgtgtttaactttgaagtatttcaaaataatggaaaaatcaacctcatcataattttttttttttttttgacacagcctccactctgtcacccaggctggaatgcagtggcgcaatcttgactcactgcaacctccgcttcctgcgttcatgccattctcctgcctcagcctcttgagtagctgggattactggtgcctgccactacacccagctagtttttgtatttttagtagagaaggagtttcaccatattggccaggctgatcttgaactcctgacctcaagtgatccacccacctcagcttcccaaattgctgggattacaggtgtgagccaccacacccggccataatccactattttttatttgaaaatcagtacatctctgacctacccccagttaattgattagttaagaaaatgggggagggggaattttactttaaagtaccctaatacatcccccagaaataaaaattgcataattcaacaagcatacttaatattcatgtcataaagactaatttcttaaaatccaaaataagatgaaaaattcagaacattattaatcctctgttggaaaattaaacaaaacagccctacaaacaaagcagcccaaacaaaccacaagagataaagggtgaagaagtattccgatgattacttttataatcaaaaactatatttggactcaacttggtaacaagcacattaactaggacagcaaaggacattaatgatagatagtgagctttttggcatcctagagaagcagagaaagacagccacggagaaaggagacctggcaatgctcccaagaaatgtcattaaggcagatctcaatcctacagtgggggaggcctggtaaaactgcaagcacaaatggtaccttgtaagaccaattactatacagtcaattcaaccaggctatacccctcaatttttttttacttcaaaacacaagaaagagagcttcattacttacatacctcggccttgctggtgaattgctgaagatctcagaacagctgaactactgagcaatgcatagatgtaagactccacttgcaatcttgagagcacagaagtataagaatgaagggccagggtctggtggaggtgctcagatttggcatcgaatagcttctttagctccaccagtgcattttcattcatttctactctttggtagcgatgatagctgaaaactttcacttgatctgcacagataccctaccagaggacaaaaaggtacaatatgaaaccagttactctttccatttgaagtaagcaggcagcaagtataaggtacacaggcttcagtaccatcttcaaagagcttataatcatggtgaggagacatattactgtgtagagaacattaccagcaaatatatgatcaggtgcaaaggaacagaaggccaatcacaaatacatcgcaaattcagagaagggaagagtaactctagtagtcagcagtgggccaggcgcggtggctgatgcttgtaatcccaccactttgggaggccgaggcaggtggatcacgaagtcaggagtttgagaccagcctggccaacacagtgaaatgctgtctctaactaaaaatataaaaattagctgggcatggtggtgggcgcctataatcccagctactcgggaggctgaagcaggagaattgcctgaacccgggaggtagaggttgcagtgggccaagattacgccactgcactccagcctgggcgacagagctagactccatctaaaaaaaaagtagtagtcagcagtgaaagctgcaagaaaataatagaacttgtccctaagactttcatgattgatgatcttaccttctattttatgaatatgaagccaatgtgatatctccaaaacttcaaggtatctcaaaacatctctggatctaccctcatcattcttcatagttctactcaagagaatacacactccaccagctgtgttcttgattctatcctctcttcttcaatacagtatttccaaatatttccctccttactatgtacagagatatacaggtctgccaatgaatgaggattagggataggggaatgacatgtttctccccaatatcccctccagcttcccttcactgccaaacttgtcaagagtaacctcttcttccttgccatctctcctaagccactatgaaatggcttatgatcactttggcctccatagggttgcatctaatggtcttctccatcccctctcaaacttgagaggacgtctcccccttcctttgggggctctgtgttacacatcagggactctccattgcttatagttaagaaggtgagtttcactctcattttgtccactggcatcatcctggagctaggaatcagttactaccttcagattcctcatccccactcaatggggaagaccattggatgcaaccccatggaggccaaagtgatcataacaccttcagtttcctcatcccttctcaaccttgacactctcttcccattggatgttggtagcattatgcccaaggtcacaaactaatgacccatgggctgaatttcagctggagacatgatttgcttggcctacactgtctgtatgtgtctgattagttgctaacatttgcaaattaggattcctcacactaaaatctagatttctagtttttcttgtaaaatcataagatgtggcaatgctgaaccatcacaacctcacagcaaccatcatctagaacttgagaacggctgtcccatctaaaccaggcatgggctggcccagtgaccattgtcccactcagcctgcttcactcctccagcttatacacctggctcctgcaggcatttgactttgtgatccctgcactctattactctaggctgaggcagggtcagagtgggtgtaaggcacagactccagacctggacaacatcccaggaatagcagctccgctgcaaattccccaggcttctgatcaaaatacctgtacagacatttgttcctccttaaactgccacagccgacttttagcattttggcaatcagatgtcagagtaagcagctcagcttcagccagcagcagttgcttcctacatcgtgagtagttcaaaagcaactcataaaattcatgcctgtcttgatgagccatgctgtcaaattcttctaaatatgactcaacattttccagccatgaaccaggctccaagatttttagctgttctttagtaaatggtactagttccagttgagacgggagttctgggtagagtcgctcactgcgaagcaagggtttcactgccaccaaagctggtgcttctccagcaatttcagctggcaactggggatacagtttcttcactctaggtgtctgaaaaccatgtttggctgggcaagaactctgcaagccaacattctgtggcacctctgaagaacaaaccaggccttgtttgtcttctttactattctgagtttctctgacttgtatattttccattgctggctgagtataagaaaaattagattggggtgcactttctgaaagtccaccttgtaccgacatattttcctctacctctgtgaagttcttgggggtttctactttagttccaacattgtctccagggtggacctttggagtgactgcactgtcccccacacagggtctggcctctcccccttcctttgggggctctgtgttacacgtcagggactcttcattgcttatagttaaggaggtgagtggtacatcaaacatttcactctcattttgtccactggcatcatcctggagctgggaatcagttaccaccttcagatggtctcctttgaattcacaggctagagaagggatttcctgctctctggaggtttttggaagggagacttcactggactcttccctctgaggagtttcatacttcttcttttcctaaaaacaacatacataatgtgaaataatttatcacaataattaatgctttcagcaggaggaattttaaagttgcacataaaatctaaatttcatcatgtaacaaatgaaacctaaattcactttatcagtgtttttgaacagatatgaacaaatatgaaacagaaatgtgtttcatatttcgtattatccaatattgagcgtgttaaatttggagattcactagtctgatcctaatagaaaaagacatcacagtaagcagcaaattctgattcaaaaaatagaaggggaaagttaattagattgtacaccattttgccaggggttaagttaaatagatcagtctctacggatcttcagccacaataggtttgtcttcaccttgacaaattcactcaaaactcagggagaaaaggacggaacaacttgagcaacataacaattgtagtactggaataaaataaatatccaggagcccatactgacataattacctgaatgaataaatacataaataaaatgagtgagaagcgacaattcttccatacaggaaaattccaatgaatagaattaacagaaggaatgagaaaaacagaacacttaccacaagaacaccatggtaactgccacaggtaagatctacccatggatgctaaagtgagtaagtgaagagtttaagggaaacagagtatctgcatagtctcaaagtatctcctcccaaatatttaataacaacgaacaggaaaatagtaagtttcagtggagaatcctggaagataatgccttaaccaaatgatcaaagttacatcaccagtaatactgacatcagataacccaataggatattcccagtaatgagtaacctcaatctaatcatgagaaaacatcagacaaaaacccaaactaagggacagtctacaaaataactgaaggaatgtggtcatgaaagacaagactgagaaactggaagagactggagagaactacagtgatctgacaactaagtgtattgcgggacctggattagaaaaaggacattaatggaaaaactggtgaagttcaaataagttctacatcctactattgtaccaacattaattctttagggtgttttatttatttatttttttttttttgagacggaatcttgctctgttgcgcaggctggagtgcagtcacgcaatctcggctcactgcaacctccgcctcctgggttcaagcaattctcctgcctcagcctcccaagtagctgggactacaggcacctgactaattttttgtatttttagtagagacggggtttcaccgtgttagccaaactcctgacctcgtgatccgtccgcctcagcctcccaaagtgctgggattaacaggcgtgagccaccgcgcctggccaattccttagttttaatcattgttccatgccatagaatgtacggttatataagatgacgacacaagaggatgaagggtgaagagtacatgggaagtctctgtattatatttgcaacttttcactaagtacaaaattatctctatcatcataaaaaagctgttcactaaaaaataagttatggtttcaaaaaaaccttcaggcattaatacgcaaactagataacaggaagttaggctgaataaagaagaaaaaattatttaaataacatttaaataaagttgtttcattcaaacagactaaaaacctcattgaaatcactcaaatacttactttcttgaagaaattttaaggcaggcaaacatgagttatacaagctcttggttattttggattattctgctctgaatgtccagcagactaatagccaaaaaagtagggcctttatatattaaaaagaaaaaaaagatgaatatttttgacatggaatttgaggtcagcttgttgaaatgaacctgactgccaaacatttacaaatggtaatgattcaagaagtaatatgaccctccaaattacttcactccccactgtgaactgtggacatcagatccagaagtcagtcacccaatgcatacctcatacaaactactttgttaaactgcctaaaatcacaaataatagaaaaacattatatgagtgttaataaaacaaaaaagcaagcccaaactatgctgcaatgatgtttagcaaacttgctgtaataaacagggttcttagactgagaaatcagaaagaaaaattaagagggaaaatggttactacggcaagagaaatgttagtggacacatcagggactcttcatcgcttacggttaaggaggtgagtggtacatcaaacatttcactctcattttgttcactggcatcatcttcaaacatcatccttaaaaatacatatgattcgcttggcctatactgtgtgtgcatgtgtgtgtatgtgtctgatttgttgctaacatttgcaaattaggatttctcacacaaaaatccagatttctagtttttcttggaaaatcataagatgtggcaatgctaaaccatcacaacctcacagcaaccatcaactagaactcgagagtggctgtcccctctaaaccaggcacgggctgacccagtgaccactgtcccactcagcctgcttcactcctccaggttatacacctggctcctgcaggcatttgactttgtgacccctgtactctactagtctaggctgaggcagggtcagtatggcagaggccaaattttagtgagttgacaatcagaaaatgaaattagtaaaacaatttcatttataatagcataaaaagaacaaactagggataaattgagagaaagaagcataatacttgtactctgaaacttacaaaacattactgaaagaaattaaatgcaacttaatttatttaaatggaaagacaatctatgtctttcgcaatattgttaagatgacaatattcctcaaatggacctacaaactctacacaatgccttgcaaaatcctagctacctttttttgcagaagttgataaactgatacttaaattgcatacagaaatgcaagtgacccacaacagacagaaaatcttgaaaaagaacaaagttggagaactcgcacttggcaattccaaaatctactacaaagtacagtaataaagacagtatagtgttggcacatggacaaatagatcaaaggaacaaaactgagaatccagaaataaaaccttacatatatggcaaattgattttgacaagaatgccaaaacaattcaatggggaaatttgaacaaatggtgctacaacaactggatatcctcatatgaaagaataaattggacccttaccttatatcatatacaaaaattaatgcaaaaaggatcatacacctaatgtgagagctaaaacttttaaactgttagaagaaaacaaaaaaatctttataaacttgggtaggcaaagccttcttacatatggcaccaaaagcacaagcaacaaaataaaaagatcaattggacttcatcaaaattaaaaactttggtgctgcaagtaccatcaagctcacacctggtctggcaccagttgatcaataaactggttcatctgatcttgtggccccaacccaggaactgactcagtgcaagaaaacagctccaactccctgtgatttcatctctgaccaatcagcattcctggctcactggcttcccccaacccaccaagttatccttaaaaactctgctctctgaatgctggggagactgatttgagtaataataaaattccagtctctcacacagcttgttctgtgtcaattactctttctctattgcagttcccctgtctcgatgaatcggctctgtctaggcagcgggcaaggtgaaccccttgggcagttacaaaattagccaggcatggtggctggcacatgtaatcccagctactcgcgaggctgaggcaggagaattgcttgaacccgggaggcggaggttgcagtgagccgagatctggccactgcattccagcctgggtgacagagtcagactccatctcacaaaatacataaataggggccgggccaggcatgggcggctcacacctgtaatcccagcactttggaaggctgaggcaggtggattacgaggtcaggagattgagaccatcctggccaacatggtgaaaccccgtctctactaaaaatacagaaaactagccaggcgtggtggcaggcacctgcagtcccagctactcaggaaggtgagacaggagaatcacttgaacctgggaggcggaggttgcagtgagccaagatcgcaccactgcactccagtctggggtgggggcggggtggcaacagagcgagactgtctctaaataaataaataaataaataaataaataaataaataggcctgggtgcagtggctcatgcctgtaataccagcactttgcgaggctgaggtgggtggatcacctgaggtgaggagttcaagaccagcctgaccaacatggtgaagccccatctttactaaatacaaaaaattagccgggcatggtggcaggtgcctgtaatcccagctacttgggaagctgaagcaagagaatcacttgaatctgggaggcagagtttgcagtgagctgagattgtgccactgcactctagcctgggcaacaagagcaactgcctttacctacttcagttaaaaataaataaaggtcaggtgcagtggctcacacgtgtaatcccagcactttgggaggcaggaggatcccttgagcccaagagtttgagaccagcctgggcaacacagggagatcccatctttatctttataaaaataaataaataaagacacagaaggaagacataatgtatatataataatcattacagatcacaaagtaaaattcagacaactctatgtgtatcaattccatgtgtatcaagtaacataatttaagccaaaggtatttccttttttaaaaaaaaatcagagacaaggtctcactgtgttgcccaacctagagtgcactggctatttgcaggcacaatcacagcatactgcagacctgaactcctgtgctcaaatggtcctcctgcctagcctccctagtagttgaaagtacagactggtgtcatcatgccaacaaaagatatttcttacaactaaaaatgccaggcatattaagaaaaatctatttctttatttttgatctccacataagttacatacagattaaaaaacgattttaaagtcattcaaatggagaaacaataatgagtaaattttacaaaaagagttgataaatagagaaaaacatgcttaactatacattacagtaaatatgctctggagtgtgggtatatggggaaaaaaacctaaagaaaaatacaacaaaccattaccaacagttatttccaggagatggaattctgggcatttcatttctgggttgtacactgtgagagtgtgtgtatgtgtacactcatacacactttaagcaatgaggaatcagaaagtaatcatttaaaactaaagttttttttaagttttgggaaataaatgggaagtttctattcatcacttgaaaaaaacatgtaaagatgtagaataggcttggattcacatgtccaaggctactccacattgctacatgtttatttcaaaattaacatatgtaaaaccaaactcctgattttcccccctaaaacctgttccacccacagctttctccttctcagggtcttccttgactgttttctctcacatcccacatccaaacctcagcaaaccctcttggctctcagacttcaaacactcctcaccaccttctctctgacaatcctggcccaagccaccatcacctcttgcctgggtgactgcaatagtctcagatggtctctgcttctacccttgcccccttacagtctattctccaaaaagcagtcacagtgattctttaaagcacaagtggaatcatgtcactcctctgctcaaaaccctgtgttgattccatatgtcactcagagtaaaagctcacgcaaggcccaacatgaccaggctatgctacttttctgacttcatctcctactgttctcccctcactcactctgcactaaccacactgcctccttgcagttccaaggacaggtctggcatgccaccgccagacagccttttcctggctagtccctctgcctgaaacacttctcccccaatatccacatagtgaactctctcttccctttcatgtctttacttaaatgtcaccctcaataagaactagccaggctgggcatggtggctcaagcctgtaatcccagcactttgggaggccaaggtaggcggatcacctgaggtcaggagttcgagaccagcctggccaacatggcaaaacctctactaaaagtaaaaaaacattagccaggtgtggtggtgggtgcctgtaatcccagctactcaggaggctaaggcaggagaattgcttgaacctgggaggcaaaggttgcagtcagccaagatcgcgccactgcactccagcctgggcgacaacagtgagactctgtcccaaaaaaaaaaaaaaaaaactatccagaccacccatcctaacctctcaccagtactcctcaactcttcaacctgttctttttcttttttccatagcgcttataaagcatgatatattttcttcttcatgggtttttgtttgtttagcttgcttgttttttgtcttctccctcttgaatgttaagctccactaaggccaggttctttggggttttttctcttttacatcccaagtgcctagaatagttttcggaacataatgggtgatcaatgagtgtttgtttaataaatgaatggcttttaggaggcacgaaagaagctaaataatactatgcagcatcccccaacttcaaaccaataaccactcctgatagaaaggaactagaggtggaaatcaatcatttaggcatggcacaagggggatggagattcaaaggtttttcctgtgaccttctgggacacatctttctgtccttagcaattaccagatgttctcactattaataagttgttggcattcagaatttaatattaactgtcaaagaaaacactataaaatgcactgctcctgcagagtaagtccaaatctaagaatctactgtacttataaattatcaagatcaatgaagtcagggtgctcagagttgggggattttatagcagagaatgacactaaagaaatgaaaacattattaggtctctctcttaggcatcaggtgataagcaccacatacctaaccacaacctagcagccgaggttagctatcagatgattaacattgaggaatgtaggtcagctgctgggtgaaatccagaagccactcaaactgtctaaaggcaacagcacatgacactatccacttcctgaactgagactttgaaccagtttgtggttccctaaatagctgccaaattatactatagatggtaaaggtttcattaatataggactttataactataatcgaactataaccagcactaagaagtgcatcaattgactctaaaaaaaattactttctagattgttttattctaaaagaattaactttctagattgacaaagataggggccttgctggtatcatggacttttttcatccgttttctcatactagtcagaggaaattcactagagtaaattcctctgagtgacaaagcttggaaatattcttcattactggcatttatttcatcattcgacgaacattatcaagtgacaaagaggctacgaagggtactgagaacaagacaggtccctccctcagtgagttcaaaatctaagggagaagagaaatgttgacaaagtaaccacaaatgagatgagtggcacagaggggagcagagtgctattggagaggcagtgacaccaggaagatgagaaaaagcttctctgacgaagtactgtttagctgacacctcacaaatgagtagctggctaggtaaaaagggataggaaggggtgtcagaggaaacaacatgggcaaaggccctgaagcaggaaagaatataaaggttaagaatcaaaagagaactttgggaggccgagatgggtggatcatccgaggccaggagtttgagaagagcctggccaacgtggtgaaactccgtctctactaaaaatacaaaaattagcccagcatggtggcaggcaccataatctgagctactcaggaggctgaagctggagaatcgcttgaaccaagagacagaggttgcagtgagccaagatcacaccacttcactccagcctgggtgacagagtgagactcggtctcaaaaagaaaaagaaaagaaaagagagaaagttgggattggtggtagaactgaggctgaggaggaagacagaggcaagatcatacagagcccttagtccatgctttggactctagcctctgagtgatgggaaacctttgaaaggttttgaggagagtaacatgatcagttttgttttgaaaaatatatatccagctcagtttagagaatgggcagcaagaatgaacgtaaagaggccagtttagaagaaatcctccttggaggagggttgtactagttaggatggagaggaaatgcacagaatcaaaagaatatttagaaaatgcaattggcaagacttagtgaatgatcagatttggagggtgagcaaaagtagatgtcaaggatttttggtttgcccaaatgcctctgaaataaaggcctcttcataaactttaacaaaaaaaaattaatgtatgtttgtataggaaagttgcctaagatggataaaaaatataatcaattggtttttcatgatggatctaaaagcttaagatttttaactttttaatttagaaattgttttaaacaaaataaattaagagggaatccccttaacagactttttaaagcatctgtaacattctatctatggaaagacaaaagacatacagatacatgaaataactattaagttcctggattgagagtcaggatttctggctttaacctgagttctctcacgaactgcatgacactgagcaatatttaatccccggaggctttagtttcatcaatatcttgggggaaaaaaactagagattaagacttaagattctgctctcatagacaactaacatttatgtgttatgcactactgcattataggttcaggaatttttttttttcttcactggataggtatgttttcttttttttcctgtagtctcatcgttaagtaggtttagggatcttatgcatagctggccaatggcttttttcttcctcctgggcctggatagttctttaccaacccaatacaatgcaaaagcatttcttttaaaaatatttctgagccgggtgtggtggctcatgcctgtaatcccagcactgtgggaggccgaggtgggcagatcacctggggtctggagttcgagaccagcctgaccaacatggtgaaacctcatctccactaacaatacaaaaattacccagcctgtaatcccagctactcgggaggctgaggcaggagaattgcttgaagccaggtggcagacgttgtggtgagcagagatcgcgccactgcactccagcctgggcaacaaaagcgaaactctgtctcaaaataaataaataaaattcctgaaatttggtaccaaaatgactttctcaccagaataactcctcacagacctggatacaccaatgtgtctaactccactacagccgtttaaaaagtcatatcaagaaaacgtggtaaatactcagcatggaatactatgcagccataaaaaagaacaaaatcgtgtcccctgcagcaacatggatgcagttagaggtaattatcctaagcaaattaatgcagaaacagaaaatcaaataccacgttctcacttataagtgggagctaaacattaagtacacatggacacaaagaagggaataatagacaccagggcctacttgagggcagaaggtgggaagaagggaaggataaaaaaaccacctgtcaagcactatactcattacctgggtgacaaaataatctgcacactaaaccaccaaggtgtgcatttgcccatgtagtaaacctccacttgtaccctctaaacctaaaataaaagttggaaagaaaaaaaaagagcatcataatgaaagaaatccacataagtcatctacagtctactaagtatggtacctatgaacactaccctcctgttaaaaccttgttcccatgagaaaatcggattacagtatcatgcttaaattacacctgctttggaacatcacccacttctggggaaaaaaatgtcctgtacttgtaataccatcctccttatttcccaaatgtaaactctgtttcaggtaagccaaaattatgaggtctggccatgcgggagcagcatttaatctgttcatcttagaaaatatatataaatagggtgggcgcggtggctcacgcctgtaatccgggcactttgggaggccaagatgggcggatcacctgaggtcaggagtttgaggccagcctgaccaacaaggagaaaccccgtctctactaaaaatacaaaattagccgtgtgtggtggcgcatgcctgtaatcccagttactcgggaggctgaggcaggagagtcgcttgaacccgggaggcggaggttgcggtgagccgagattgcactccgccgagattgcactccagcctggacgacagagcgagactccatatcaaaacaaaaacaaaaacaaaacaaaacataggctgggcgcggtggctcacgcctgtaatctcagcactttgggaggccgaggcgggcggatcacgaggtcaggagatcgagaccatcctggctaacacggtgaaaccccgtctctactaaaaatacaaaaaattagccgggcgtggtggcaggcgcctgtagtcccagctactcgggagggaggctgaggcaggagaatggcgtgaacctgggaggcggagcttgcagtgagccgagatcgcgccactgcactccggcctgggcgacagagcaagactctgtctcaaaaaaaaaaaaaaaaatacatatacatatatatacacacacacatatgtatatatgtacgtatatatgtatatatgtgtacatatgtatatatgtgtatatatgtactataataaaatgaaaatccagactgcacttataaacaaatcaacttaaaatcactctaataccacatgtagtctaatacaggaaactcagaaaattcaaacacttccctactgtgtgagtcccgccctgggttaatttctagccattcatgccccttataaacaatcaagacaataagaaataaacagaggcagcactactatcatcttgaactttcaaagtgatcagaaatggcacagcactagtctacttataaagttctgccaaaggtaccttctccgcgtggaggaggggaacattccctctttatgcatggcagggactaaaaatgttctaggatataaaagagtaaagagagagtcaacgatggggctggaaagagaaaaattatttcacggcaggaaaccagacccaggtgaggaaagccaagagagcagaaaaggaagaggccagtgaagtcacaggagggagaaggaaaaatggggtcctgacagagtgtggcagggggatatggagaaggaatggaggagaagggccggtgtcaacgggtggtgggatcaaatattggaaggtggaggcggaagatgcagagggctcagggaacgggagtagaattggctggggaggccgaagagaggagcaaggagacacagcacactgccagagcctcgggagggtgggggagatcctcacctttgttttagtccggctggccttggccttggcccggcgctggggcttcaccgcctcggccatagacccttccgcggcgccgtcaccgtttgtttttgtcaaacccctgcgcttcaagcaacctgcccggttctggcctccggactgtcacatgatcgaatct

SEQ ID NO: 1695 - DNA, 37208 bp, Homo sapiens
  source 1..37208: mol_type = genomic DNA
tatattcttaaatatggtttaatactcttctccatttctgtacatcacaacaccaagattttgctgcttagtatctctctgcagaggctatagagaatgcaaaggctacggttttcaccccctcttatatgtgtttgtatgtgtaagtgtaatacatatcaatatatattgatacacacatcaatatataatgcaatatatatcaccgaagagaacacattgattaaagaaatacaaaaatttggcatcatttccaaacttaaatagtaaaaataaaaactacaaaaggagctgcataccctaaatgtatcatgtgaaacaacaagcatattcaaaaatgtaaatttacatccaatttctctggtcttgtcatatcacatcagacccatttacaatggcaaaaccctaaggtactgctgtgaagagagcatgtttgctcgctcttgggtgttctgcaaacaaatagcagagcccaaagcaaaaaagcctgttccggtgaagtctcccacgttggtgaacaccaaataatggactcttctcacagggggttgagacatcaggttacacattgacagacagtatttggacctcagagtacagtgtgagaaccagaaactttacatttaagacatactcccttcattcaagtgaaacaggattattggaacgataggcaggtctgtaacctgggaacaaggagctggttcagaccaataaagctacgagtgactgaatcaagtcagtaaagaacagcagtcaggcactaaagtgttaaaagtacccaatttgaaaaccaaatgcaccccactaccctagtcagtgtggaggtgataccaattgacttttaaaacctttggtccttcaaagtccatttggtatacttttttccatcgctaccactgggcacgtactatacactttgttcaactgtcaccaccctgggcacgccatgaccttgcatatcagctgggttcaagtctgacttacagcccagctgtgaagcataagcttcagggtttcaggccaacttttggatccaacatggtcttaaatccatggtgccagaagctgtgtcccatcccttcccacccgcccctaatttctcatgtgagaagtgcttgtaagtcccacatttgaaacagatgctccaaccccaccaggaggtcaggagtttataattacatgcagtcatacatgtctgtcgttcctgtgaaaaaccttgcagttcattttaataaatcaaaacattcacataatctcatgccatccaacacaaggaaaacacatccacctcccttttaacaaggattgacccaagcaaaataaaatcctctttaaatttcttcgcttccacttaaattgcatgttttatttctcccaatcccagcaatagcacagaagccccatcatatccatcccaaaccggtttcgagtaggttaaggttatagggacccttgtcagaacattgatacaaagggctcccaaacgccgggcacaaatgtgtctgcaaacagatggaagtaaacagtgcactggcccaaatgcttcatgagtcagtttgattttgcaatgcaatttgcatccttgaaactgccagtctggagggggacggggtagcgtgagggagtgaagttgaaagtgcctcctattagctcaccctttcaacattaaacagagaccaagagagaaatggttccaacatttcaccacatatatttcttcttacgcagtctaagctgagaatgccatgtaaatgggtcactgcgaaatgcagcaatttaatttttctccaatcaaaataagaaacaaaccagtatgatctcacttctattaacttttgaaggtttacagcagttaaagtatttttgcttctatgtatgaaggttaaaaaaatcattttttttcataaaatacaagagcaaccaatttcaccatccagtaaaagtaaaaactgggattcttttttaaattagtccaaagtggcgtttaggaacttagttgtaggctgctgcgctgacaccatgacaaaccaaagtgtagggctgggtctggttttgtttcggttttcttttcaatatccaatgctcatggattaagttctggaaatgttccaattgtaaggcagggatctgtttggattccaccatgggtatgctccttgggttggatgctggagggtgaggcacgttttgccggacccatgtcgactacctagtagtcatcaaggtcaaaaaattcatcgtctcctccttggtattccattccctggaaatctactcggtaccgcaagatacctggggaaacaaaccaaaaggtaaattacctgtgttcatgggatgggcatgtgtgtaggtggctggtaagggaataagggaagccctattctcttgcagaattgcagaaagcaaagaggtaataataaacatgggtccaaattaggaacctgcacctgctgcgtcaatcacctatcccagcagataataagcacctcaccggaagcagggctagggctagccaggagggaccttgacctgagaccctggttttaagtttggtttgctgatttgctactcacctccaattccaccaaatcctttcacaaactgagacccttcttgtgatttatctgtgacaatttccaacgtagctccaaattttttatagttgttagcaaaccattccaacaggggcatgctctcgataagctcatgttcctgtccggtctacagggatgaccatgagatacaaaaatgggggattaggatatatgaaggctaattagtccctctcacagccccttgcccacctatcactctcatcctcccatttataggcatgtctgtgtgtaaagctctgtaagtcatctctggttttgataacctaatggatatcagcagagaaattcggattatttcaaacaacacttctcctcaggctctaccctcagctatgaaataccaacacaaaaactcagtgggtattcagcttatgattcctactgttgactctagaagtcaggctgttgtagtgtctctaagcagcacccattcaatggctcagaagagacattccaggactgcttttgggagtggcctcgtagagaacaaagctctccaaaccagaatttgaggaagctatcatttaaacctatctcatacgggagggtcatactttcaactgttgtgatgcacttagagcaaaccagagaagccactgcagtggaagagctgatcaagtgaagaaagcagcacaggtttcacagtgcaggagaggcattatgtaaattacattttcctccctattaaatttcaaggataatgaaatgttttcctgattgcttaactacttaaaaacaaagacaaaaacaaacaaacaaacaaaaaccaggccaggcatggtgggtcacgtctgtaatctcaccactctggaaaaccaatgtaggaggatcacttgggcccaggagttcaagaccagcctggtgaacacagcaagaccccatttctataaaaaaaattaggctgcctggcatggtggctcacgcctgtaatcccagcattttgggaggctaaggcaggtggatcacctgaggtcaggagttcgagaccagcctggccaacatgatgaaacccagtctctactaaaaatacaaaaattagtcaggcgtggtggcgggcgcctgtagtcccatctactcgggaggctgaggcaggagaattgcttgaactcgggaggtggaggttgcagtgagccgagatcacaccactgcactccagcctgggtgacaagagcaaactccacctcaaaaaaaaaaaaaaaaaaaaaagggaatgagggcttgtgcctgtactcctggctactcagtagactgaggcagaaggattgcctgagcccaggggttcgaggttatagtgagctatgattgtgccactgaatccagcctgggtgacagaccaggaccctatctcaaagaaaaaaaaaaaaagaccggtcatggtggctcacacctgtaatcccaccacttgggaggccgaggtaagtggattgcttgagctcaggagtttgagaccagcccagggcaacatggtgaaaacgcctctctacaaaaaattcaaaaattagttgggcgtggtggtgtatgcctgtagtcccagctaccagagaggctgaggcaagaggatcacttgagcccaggaggtggaggttgcagcgagccgagatcatgccactgcactccagcttgggcaacagagcaagaccttgtctcaaaaaaaaaaaaaaaaaaaaaaaaaaaaaaagctgcagctccttccctgaaatcagattcgtatgtggcagatagatgaccacctcccacagcacccccaattagtataaggtttggtttcccaaagctcaccctctacacagccagtactctaacacacggatttacgcttgcacgtatcatcaaaccaagaaaataatcacatacctctttgtctgtgaaatgagatttatccttttcttgctctggagttagatagagaattttctcctctgtagtattaggaggaaaaaatgtgttaacctggctctcatatactaatctgtgtaagctccataagatgaggttagatgagaaaagggctcagggactcaatctctcaacattttttccataaacatgttagcatacactgagtgtctactaggtacaatgcttcaaccataaggaacatcagagatgttcaagatatagtcctggtcctcagcagatgtaacaatcttaagcagacgttaaacagttcaagcagaaaaatctatgcaggaatgtgctacagactgaaggactggggaacaatgggtagatctaccttctgattgctcctgaaatcagccatccctcccaaatctccaccccaggcttcctggctcagtaacaaatagcaaccttattttctaattctcataccttctgtgccttggcaatgaagaacatatctcattatatccagattttcatagactattagaatttctacagctcccatttccaaagcctttagtgtatcttcaacgccaaaacagtacttgcccgtgtcctggctgatttcatcaaagtatcgtcctacgattagggatcagtcaacaggatatatattaaagtttccctagtagatacaaacacacctattcgacctaatgactaaagaagataaaaaataatgcttttactgaggcaaaagagttaataaaaatactaaatattcctttttacatttttggtaccttgtctcatacatacaatcacgtacatacacacacacacatacacacacacacacacacacacacacacacgaaaacatttcacagaataagtagttgcatttcaccgatacctattaatttcttctcttgaatgaatttcacgttggagaggacttcagtagataactcaatagcttggttgaatccattttcaccaccataggatatatcaactaattttaaaacttttgattgtaacctctaacacacaaaaaaaatattattagtacttactggtacttatttaaaatattattaaaacacctttactcaaacccactaactcttaatggtatgcaaagctcagcattatgatcactgaagtctaaatatggggaaggagcccaatttaatcaaaagctgctcttaaagtgaacagcactgccaattatatcacacattttattagacctactataggacaactcattaagtgcaaacaaaaataagttattgtggaggaaaggggggaccactggctcctgccaaataaggtagtagaggttaagacgggctggggagggtggctcacacctataatcccagcactttgggaagctaggagaggcagacagcttgagtccaggaattctgagaccagcctaggcaacatggtgaaaccctgtctctaccaaaaagtacaaaaattagttgggcatggtgacacatccctgtagtcccagctacttgggaggctgagctgggaggatcacttaagcctgggagatcgaggctgcagtgagccatgattgccactgcactccagcctaggcaagatagccagacccagtctcaaaaaaaaaaaaaaaaaaaaaaaaaaaaatatatatatatatatatatatatatatatatatttttttttttttttaaaggcaatttctttggtggaccttctaccataaggctacttcctccagatcttgaaagtgtattatggctgagcccatgttataaaatgtgctttaaatgctttaggctgaatcagctgtcatactgctgagagctttgctgctatgtatctccaagaataaatcagaaaaagaaaataaggaacaggttttagtttctttgaaatcaaactccattctacagccaattctgacaacccaactaaacaaggaacctccacaggatccataagaagcccacctaaaaatggttgatttcagaagagaaggggttcagaaaagcacaggggaatgtttcctgataaacatctgtaaacctgctgtttaactcagaggcaagtttttaacccaaggaattttaaaaagatgtgtctgttccagtgctcacacagaggactcacctactcctacctagggtcttacataataaagcatctacttcttacttacctgatcaaacatatcagattgacttagttcagttttaaagtcagcggatccagctaaaactagaccagccacattcactttgtccccagaaataaacagctgcacagcagtctctgctactttccgaacatagttatgtcgcttttccattcttaaacgggcaaaacgcaaggctgactgacctcctctacctttgacacaaaagtagcaagagaaaaaggcaattattaagaactacaagatgtcttcaaattaaaaataaaataatcatgtcatcatctaagaaaaggacaaagaaaaatcaccattcccttaactaaacgttcagcataaactgctacttgttttcagagagcgactactaagtctatgtcaagagaggagctgtaagtaccaatgaggcaccagtcattacaggaggcttctctccccatcatctggattcactcccctcacatcatactgttttctctctctctcttttttgagacagagtctcactctgtcgcccagactggagtgcagtggcgcaatcttggctcaatgcaacctccgtctcccgggttcaagcaattctcctgcctcagcctcacaagtagctgggattacaggcgcccgtcacatttttgtatttttagtagagacagggccgggctggtctcgaacttctgacttcgtgatccacccggctcggcctcccaaagtgctgggattacaggcgtgagccaccgcacccggcccaccatactgttttcttattgctagacacaaagtaagtgggttcatgttctcctcctgtattaccgtgtttctttgggagatccacagtgaatttgtgcaggacttctcttgtgtttccttggagtgtgccaaaaagtgcaccactaccatctattacaatgaatccaaacttgctatcatctgaaagtagtgctgtaagagcctgaaaagcaaacacaagtaccacacggtgaatcccaaagctttgctaaggtcaaaaaaactctgaaaggatatatacaagccctttcactccactcaccatgctattagcactgtgggaaaaccttctacggaataatttatagacttcagttataaacatgtaactcttatggacaaatttgaacccaataaggaaataacgaatgatatctatgtgaagcttttcaacacatttgacatgggcatgtaaatataaaaccagaaagatatctgtatgcccatgtttatagcaatattacatacagcagttaatactactcaatctcaaaaaggaagaaaattttgaaacacactacaacagggatgaaacttgaatacatgctaagtgaaataaccctgtcaaaaaaggacaaatactgtatgactccacttatatgaggttcctggagtaatcaaaatcagagacaaaaagtcaaatggtggttgccaggggctggaaaaaagggggaacaaggaattattgctcaatggatacagtttcagttttataatatagagttctaagctgggtatgatggctcacacatgtaatcccagcactatgggaggctgtggcaggcagatggcttgagctcaggagtttgagactggcctgggcaacatagcgaaacactgtctctacaaaaaaatacaaaaattaggtggctgtggtgacacgtgcctgtagtccctaccagctacttggaaaggctttagtctgggaggtgtaggttgcagtgagccaagattgtgccagtgtactccagcctgggtgatccagagaccttgtctcaaaaaacaaaaaaactttaacttgttccttttttttttttttttgagacagggtctcactttgctggccaggctggagtgcagtagccatcatagctcactgcagcctcgaagtcttggactcaaatgatccttctgccttagcctcccaaagtgccggggttacaggcatgagccagcatgtctttaaaggtattgcagctaatgattctgagttttatgaggaaaaccttccttctatgttaactttatatccctttatgccttcccaaagagaaaatattgaaacagtcctgggacatacatagataagagttctcacagtggaatcggaatactacacacttagttgatctctaattgccaggggacaatctctttggaagtaagaaattgttacccattccattttatttttataaactgatcctcctctttggcctcccaaagtgctgggattacataggtgtgagccacaacacctggccttaccattccattttaagaaaatagccccttcaataattgactagaaagcagatggatcaactaagaatccatctttaacaaaccatgctagatagttggcattaagacatgaatattgtggccgggcgtggtggctcatgcctgcaatggcactttgagaggccaaggtgggtggatcactcgaggtcaggagtttcagaccagcctagccaacatggtgaaatctcatctactaaaaatacaaaaattagttgggcgtggtggtgcacacttgtaatcccagctactcaggaggctgaggcaggacaatcacttgaattcgggaggtggaagttgcaaggagccgagatcgtgccattgcactccagcctgggcaacagagcaaaactcaatctcagaaaaaagaaaaagaaaaagaaaaaagacatgaatatgaatattgcacgttaataatatagccttatcaaaatgacccgttaggtagattgaagtttttaataaatctgcttatcagggaataggcatatcccttattagaatatataattaccctgataaacaggatataaccctctcagttaaagctaaaatgtacaaagttagcaagattaaacagtatcttagaaaaggagttaaggtttggaaaaaagccaacaaggctaactcagtaagtgagcaaaagccagacaacatgggtacctggcactgtttaaatcaacaagattcaaaatcggctttcatccaaccagatacaggtaagtggtttcagtggctgagaggctccctgaaaaaccctctgctgtaagtagagtgtggtagtgaagagaaaaacagtctggattgtctatgcagtcgaccaagatccaactataaatggacttcccatcaagttagcaaaaatcatccactgtaaactgtcgacaaatgtcagttctaattccactgtagaggtttttccctaggttgatgaaaggcaagagaatgaactaaggagccagctgtgaattcttgattgttctactgttgactgatttaggtcactctaatgaggtttcctttccactgttcaagttcatcctatggcagctttgtcactcaaaagtttcaggggaaaggggggaaaatgagttcttacagttctgctactaaaaattttacaattgttatgtgaaaactgagtgcaataactcaaagagtataactggactgcttgtaacacaatggatatacgcttgaggaaatgggtaccctattttccatagtgtgatagctcacattgcatgcctgtatcaaaacatctcatgtaccccatatacacctactatgtacccacaaaaatcaaaacacacacacacacacacactttgggaggctgaagcgagcagatcacttgaggccaggagtttgggacaggcctggccaacatggcaaaactctgtctctactaaaaaaacacaaaaaattagccaggcatggtggtgcacacctgtaatcccagttattcaggaggcttgaggcacaagaatcgcttgaaccatggagatggaggttgcagtgggccaagattgcaccactgcactctagcctgggcgacagtgtgagactctgtctcaaaacatgctgaatgactagtgtcataataaatgtaaattgccttactttttgaaaacagacagctttgtaaaatggtacaacggtttggaaaacagtctagcaacttcttaaaaagttaaacataattactatataacctacacgattccacaaatctaagaaacatgaaaatgtatggtcacatagaaacttgtccatgaatgttcacagcagcattattcagaacagccaaacagtgcaaaccactcaaatgtaaaactgatgaaacgagaagctatataaaatatgaaatatggcatataggtatacaatggaatactacttggtaatcaaaagggatgaaatgtactgatgaatgctaccacatggaaccttaaaagtataaagtaaaagaagccagtcacaaaaggccacaaactatatgattccattatataaaatgtccaggctgggcggggttgctcatgcctgtaatcctagtactttgggaggctaaggtgggtggatcacgaggtcaggagtctgagaccagcctgaccaatgtgtttaaacaccatctctactaaaaatacaaaaaaattagctgggtgtggtggcatgtgcctgcaatcccagctactcaggaggctgagacaggagaatcccttgaatctgggaggcggagcttgcagtgagccgagatcataccactgcactccagcctgggagacagagcgagactccgtctaaaaaaaaaataaaaaaataaaaataaaaaaataaaaataaaagaagtacagcacaagcatatctatggaaagaaaatatagtggttgcctagaatgagacaggtaagtgggagggatgggggactgactgctaatgggtacggggaaagaattctggagcgatgaaaatgttctgggtttgacttcttacctctgtatggaatttgttgtcacacaaatacaatgacgtattaattggtttgaaaggttcaaagtcaatgttgactttcttttcctttccttcttctgttacaattgttccacagtatacaaccagaccatttggaggtactgcaaagaacacaaacaatttttctactttaccccatatctagtttttcgtcaattaatagaaaatgttcccatagcctattttccctgcctgatcctttaagtcataatttaaataaagcagaaaaagcttgaaatctctcaggcagaactctctccctaattttaaaacttcttctgagacgtttcagtacgatttattctttaaagtaaacaggctggacgtggtggtggctcacgcctgtaatcccagcactctgggaggccgaggtaggcggatcacctgacgtcaggaattcaagaccaacctggccaacatggtgaaaccccatctctacgaaaaatacaaaaagtagccaggcgtggtgatgggcacctgtagtcccagctactcgagaggctgagacggaagaatcacttcaacctgggaggcttgtggtgagctgagatcggattactgcacttcagtctctgggtgacagagcaagactctgtctcatcccaaaaaaaaaaaaaaaaaaaaaaattgagacaacgcctcactctgtcactcaggctagtgtgcagcagcgagatcgtggctcactgcaactcccacctcccgggtccagttgattctctcgcctcagcctccagagtagatgggactacaggtgtgtgccaccaggcctggctaacttttgtattttttgtagagacagggtttcacaccatgttgtccaggctggtctcgaactcctgacctcaagtgatccacctgcctcagcttcccaaagtgctgggattacaggcatgagccactgtgcctggcctacttaactttcaataaacaaaaaacaaaacaaaacaaaaaagctaaccaccaaggccaaagagacactgatgacagccgacttaagggaacattagtgaacaaagcaccatagcagcatcacagtataaaacataaccaaaatgtgtagagaaggaaaaggagcaaactccagattacctttgttataaagtttgagtctttgttgtacagatgtaatggctcccaggactgaaaggcggtttactcgtgacttaatgttagatgcagttccaaactcatccgctaacatttttgccactcgtgaaatctggtctttgggaggaatgatcaatgatatcatgctggtgccattgctgtggaagaaagaataactcattagggatttaaatatcatgtaagtaaactcatgtttctctctggtaaaagcaagctacagggagatgccccaaagttatggaaacaggtcactctcaaaggagtaatgtagggactatattagtcttgtttatgaacgtatacacagagttaggaacagtgttcagaatctagtgctcaatttgattgaatagtgaggtaagttatgtaaagaatacacttggagagatacttgagaaacacctcatttcctaaagaaagaagctatctatgataaataaggagtgtcaacaggctggaatttggtagtgaatctgtccgtgggagagccttcaaatgtggtggttgagtgggagacgccatgacaggatgatgcaatgagtctttccaaagtctaggcatatttgtaatcaagaatttagtattctaatgatgggaaaggagaactgtggaagtcacagaaatgtcccagttatgaaatctctctctctcggccgggcacgatggctcacgcttataatcccagcactttgggaggccgaggcgggcggatcacaaggtcaggagttcgaggcaagcctggccaacagagtgaaacctcgtctcaattaaaaaaaaaaaaaattcgctgggcatggtggcaagtgcctgtaatcccagctattcaggtggctgaggcacgagaatcacttgaatccgggaggcggaggttgcagtgagccgagatcatgtcactgcactccagcctgggcgacagagctagacttagtctcgagaaaaaaaaaaaaaaatctctctctcacaaactcattctctttaaatggcaacatattaattgcatttgagtttgattaaaaggaggaatgactgacagcctgataaattctgggtgcccaaccaaactcaagtttttagaactaaaaaacgggaccaaaatctgacctatggaagattttggttttttaactttttaataataacaatgctgatgtgtgtgagatgttgtctcattgcggttttgatttggatttctctgattaatgatgttgagcatttttttcatatgtttatggggcacttgttaaatgcgtatctcaaaatgtcagaaagatatcaaactaatgatccaatatcatacttggaaaaccagaaacataagagcaaactaattccaaacctagcaaaagaaaagaactaaaatcagagcagaactgaacaaaattaagaccccaaaatccagggaaataatcaacttaaccagaagttggttttttgaaagcataaacaagattgataaaccactgtctacattaacaaagaaaaaacgacagaagatccaaataagtacagtcagagatgacaaaggtgacattacaactgatctcacagaagtagaatgattctgagagacccttatgaacacctccatacacataaactagaaaatctaaaggaaatgggtaaataccatcaaggccctgccacatgggaggtcccttctgagcagttaccaacccatttttaagccccctttaaatttcaacaccaatgccagtaacatatcttttttgtctacaacttccaaagacacttatcatcactaccagtcaagaaatatctcatcggaaaattcctacttctatgcaaagcaaacacagtggctcacacctgtaatcccagcactttgggaggctaaggtaggaggatcacttgagtccaggagtttgagaacagcctgggcaacataatgaggcccccatctgtacaaaaaataaataatcagctgggtgtcacgtgatgcaggcctgtagccctagctattcaggaggctgaggcaggaatatcactcaagcccaggagttagaaactgcagtgagctatgatttgccactgcactccagcctgggcaacagtataagactgtctcaaaaaaggaaggaaggaaacaaagtgttggtgaggatgtggagaaattggaacccttgtgcattgccagtgggaatataaaatggtacagccatgtgggataagtgtggtagctcttccaaaaaaaaaaatttttttttaacacctaattaccatatgatctagccattctactttcaattacatacccaagagtgagagcggggacttacacaccaatgttcatagcagcattattcacaatagcctagaggtggaagcaacccaaacatccactggtggatgaacaaataaaaaaaagtggtgtgtgtgcacaatgaaatattattcagtcttaaaggaaggaaattctgacacacaaaatggatgaaccttgaacacattatgctaagaaaaataagccagacagaaaaggacaaatactgtatgattctgcttacatgaggtaacctagaatattaaagttcatagagacagagagtagaaatgcagttgccagcaactggagtaaggtggaactaggcagttgtttaatagttgttttagttttacaagacgaaaagtcctagagactggctgcacaacagtgtgaatgtacttaatactgctgaactatacacttgtaaatggttaagatggtaaacttcatgttatgtattttttacaacgaaaaaaattcttaaaaatcaactacttagtccatttataacttatttatttattttttttagatggagtcttgctcttgttgcccaggctggagtgcagtggcaccatctcagttcactgcaacctcagcctcctaggttcaagcgattctcctgcctcagcctcccaagtagctgggattacaggcttgtgccaccaggcccagttaattttctttgtatttttagtagagactgggtttcaccatgttggccaggctggtctcgaactcccggcctcaggtgatccccctgcctcagcctcccaaagtgctgggattacaggcgtgagccaccgcgcccagcctgtaagttaaaattttttagagcatgcacttccccaaaacagtagttcagttctcaattttttgcagatgaaaatcacctggggagttcattctaggtgattccttttcaaaaaggattcctgtaagtttcatttcttttctcatcctgatttttcttagtttagtcacaacatggataaacgactatttaaaatattagatgatctacatcaagtggatttcaaaattaaaaacttttaggctgctctacagagtagccattctcttgttttttgtttttttggttttttttacttctctaatcaacttgctttcattctcaaaaaaacccaaaaaccgacctttggacttcaaaggatagcattaggaaagtaaaaagacccacagaatgggagaaaatatatgcaaatcatattatctcttaagatttatgtaaagaatataaagaatatgtaaaaactcataattcatcaacaaaaaacccaaataaaaaatgggcaaagggtgtgaggagacatttctacaaagacatagcatgtgaagaaatcgaaatcttcattcaatgctgttgggaatgttaagtggtacaatacttccagaaaacagtctggcagtccttaggagtttaaacacagagttaccatatgacccaaccactctactcttagttagatacccaagagaactgacaaaatatgtaacacacaaaaatttgtgcttcaatgttcatggaggcattattcataatagtaaaaaaaaaaacaaaacaaacgaaaaaaagaaacaacccatatgtccaactgataaatgaataatcaaaatgtggtacattcatatgctaaaaactattcagcaataaaataaatgacatattgcattaacttacactacattggccaggtgtggtggctcatgcctgtaatcccagcattttgggaggctgaggcaggaggatcacaaggtcaggagatcgagatcatcctggctaacatggtgaaaccccatctctactaaaaatacaaaaaattagccgggcgcagtggcaggcgcctgtagtctcagctattcaggaggctgagtcaggagaatggtgtgaacccgggaggcagagcttgcagttagccaagatagcgccactgcagtctggttggggcgaaagagcaagactccatctcaaaacaaacaaacaaacaaacaaacaaaaaaacccttacactacatcaagtaaaaactgtcacaaaagaacacatattgtagacagggcacagtggctcacgcctgtaatcccagcatttcggggggccaaggtgggcggatcacgaggtcaagagaccgagaccatcctgaccaacatggtgaaaccccgtctctactaaaaatacaaaaattagccgggcgtggtggtgtgtgcctgtaatctcagctactcaggagggtgaggcaggagaatcgcttgaacccgggaggcggaggttgcaatgagccgagatagagccactgcactgcagcctggatgacagagctagactccgtctcaaggaaaaaacaaaaaaattagccgagcgtggtggcatgtgcctgtagtcccagctactggggaggctgaggcaggagaatcgcttgaacccgggaggtgggggatgcagtgagccgagaccacgccactgcactccagcctgacaacagagtgaaactgtctcaaaacaaaaaaaacaccacatattgtatagttccatttacacaaaatgttcacaataggcattccagagagacaaaggtagattagtggttgccaggggctgaggagagggaggaatgcagagtgattgttaaagggtacagggatttttaggttgatggaaatactgtttttctttttttaaggaaaatattttaaaattagtggttgcacaactctggaaaaacagtgaaataatgcactttaaaggggaaaggctgggcgaggtggctcacactggtaatcccagcactttgggaggcttgaggcagaactgcttgcgcctaggagttttgagaccagcctgtgaaatgcagtgagaccctggctgggcatggtggctcacacctgcaatcccagcactctgggaggccgaggcaggcagatcacttgaggccaggggttcaagaccagcctagccactatggtgaaacctcacctctactaaaaatacaaaaagttgctgggtgtgctaggcgtggtggctcatgcctgtaatcccagctactctggaggctgaggcacgaaaactgcttgaacctgggaggcagaggttgcggtgcagtgagccgagatcgtgccactgcactccagcttgggtgacagagtgagactctgtctcaaaaaaaaaaaaaaaagttgggcatggtggcacacgcctgtaattccagctacttgggagtctgaggcacgagaatcgctcgaacctgggagatggaggttgcagtgagcccaaatcgtgccactacactccagactgggtgacagaccgagactgtcacaaaacaacaaaccaaaaaccaaaaaaatatagtgagacctgtctctacaaaaattaggcaagtatggtggtatgtgcctgtaatctcagctacttgggagactgaggtgggagaattacctaagccctagaggttgaggctgcagtgagccgtgatcacaccactgcacttcagcctggaaaccagagtgaaactgtgtctcttaaaaaaaaaaaaaatttctttccgttttttgtttttttttttgagacagagtcttgctctgtcaccaggctgcagtgcagtggcgcgatctcggctcactgtagcctctgcctcctgggttcaagcaattctcctgcctcagcctccccagtagctgggactacaggcacacgccatcacacccggctaatttttgtatttttagtagagatggggtttcaccatgttggccaggatggtcttgatctcctgacttcatgatccgcccgccttggcctcccaaagtgctgggattacaggcatgagccaccgtgcccggccaggatatttctttctttcttttcttccttcctttccctttttttttcttttttacatttttggaagttaattttattatatgaagatggtatacaaaatacattcatcatgactaaaaataataggacccaggatatttcttttaatgtctcttggtctcaacctgacagtttcccccataaaagccaaagcatgttttcccgagaagtagtaatttgtgtttttactaaattatcaataaattctaattttatcatgttaagaaaaaccagcttactattaataattttttttttttttgagatgaagtctcacactgtcacccgggctggagtgcagtggggcgatcttggcttgctgcagcctccacctcctgggttcaagcgattctcctgcctcagcctcccaagtagctgggagtacaggcgtgcgccaccacgcctggctaatttttgtatttttagtagagataaggtttcactatgttggccaggctggtctcgaactcctgacctcgtgatccgcctgcctcagcctcccaaagtgatgggattacaggcgtgagccaccatgtctggcctattaataattttatgagaacaagcagcagtataaacagaatcaaatctacaacatataggaaactagaaatcccaaatctgccctgacctgatctaaaggctggctttagtacaatagctaccagtataaattgagctgacttacatcttgaaggcaaaggctgatctgatatgaaccgaagcacactaaaaaatgcagtatcacctggccaggcgcggtagctcatacctgtaatcccagcactgtgggaggccgaggcgggtggatcacctgaggtcaggagttcgagaccagcctggccaagatggtgaaaccccatctctactaaaaatacaaaaattagctgggtgtggtggcacacgcctataatcccagctactttgaaggctgaggcaggagaatcgcttgaacttgggagacagaggttgcagtgagcagagatcacgccactcacttcagtctgggcaacagagtgagactctgtttaaaaaaaaaaaaaaaaaagaaatgtgttatcactttataaactgtttctatctgatatttcacgagactgtaagaaagttacttcctgagatccttatagattattggatctatacccttaaagggtatataagtttaatattgtagttagactgccagaaccatctaaactttcccctaattactgagagtgcatcatctcacagtagcccaatatgccagctttaataaaatctcacctatccagagtccagtggaagctggcaagaaaaagaaatcagaaagctggttacagagtcaaattaaatgggcttacgtgttaagtgactagtaagaacagaagcagcactgtgaggggaacgaaaataaaccccctatattagcttttaactacaggtgtttaaaatatgaaaatatctcaaattgggtcctagaaagcttattttcataaagcaaaatttcataaacgtgtactatagtgtcttcggtatttgcattgggaagggatctcattaacaggacctcttgccctggaagttttctcctagtggttaattccacaggttttccaggcagaaaatggttttcttcccgcctaccccctgccccccaggatggagtcttgctctgttgctcaggctggagtacagtggcatgatcttggctgactgcaacctccgcctcccaggtttaagcaattctcctgcctcagcctctggagtagctgggattacaggcatgcaccatcatgcccaacagctattgttttttttttgagatggagtctcgctctgctgcccaggctggagtgcagtggtgccatctcagctcactgcaagctctgcctcctgggttcaagcaattcttctgcctcagcctcctgaggagctgagactacaggcgcatgcaaccacacccagctaattttttgtatttttagtagagatggggtttcaccatgttagccaggatgttctcgatctcccgaccttgtgatccgcccacctcagcctcccaaagtactgggattacaggcatgagccaccatgcctgaccttctaatttttgtatttttagtagagatgtggtttcaccatgttggtcgggctggtctggaactcctgagctcatgatccacctgccttggcctcccaaagtgctaggattacaggtgtgagccactgtacccggcccagaaaacagttttctttctaactagatgagctggctgtccagtcctcccactatcaaaaatagctactctcagattggcagccaaagttacatatccaaaaatcagaattctgtttgggtgtctaccttgaaggctggttcataaacttctgtgctattttccccaataaattacaagctaatcaaagacagtacacaggacagtatggtgtgtgctctgctgccaccccttggataggggagcaagcattctggccaaaccacggaatcaaggaaatttatgatacactgcttcagttatcatcacaaacacttgctaggcttctaaactgtaatttccaaaaaacctttttgataattccttctggagttatgtcaaactctacatacatgccaatggagagaaaagatacttgctttggaagagactggaaacactgggcaactaaacagaacttccatcacaatctagactgtaggtgccacctacctgacacaggggtccactcatgcacagggagaatacgaagagataaaagatggggaaaacacttgagtaccaattttactggcttatgcttggtaagccaattctcaaggggcctacaaccctaggggtttgtaggaagttctttcttttctttttttttttgagagggggtttcccttttgttccccaggcaggagtgcagtggcacgatgtcacctcactgcaacctccgcctcctgggttcaagccattctcctgcctcagcctcctgagtagctggggtttcaggtatgtgccactacgcctgactaattttgtatttttagtagagacggggtttctctatgttggtcaggctggtctcgaactcccgacctcaggtgatccgcccgcctcagcctcccaaagtgctaggattacaggcgtgagccaccatgcccggctggaagttttttcttaaaaggtgttggttttttaaaaagccgacatgctctgacttacagagaatagtttcctaagatgcagtcggcagggaatggaatgaaaacggatggcaaaggtaaagtctcagagctgaggaagaacaggcaacaaaccccaaagatttggaacgtttaaggctaaagaggggagaaatttgggacaaattaactgagagaactcaaaatgccttacagcaacccttcaaataagataatgatgtggagggcaaagcaatgaccttaagataagcagctacttactttccactgctgatagtttaagaagataaacattcattaagcaaccctactgtatagcccagttgggcaaccttacattccatatccatgtaacattccagaggaccaaggagcaaatacacctaagaatgtaatcttgttataggattccactttaaaaaatggctcaaaagtgtagcttgcctaagaattgttttttgtttggtagatttctacaaagttgataaatgaaacaaaacttgaaacttggtcttggcttcttattccttttgaattaggtgcaaaaaattacctttcactagtttccctgcatgccccctccccctaccttctatgggggaaacattaagtttctgaatttacctttaaaataagacacctgactagggaggggaaatgcagattattaaatggatggctttcactttaaaaatttaaagggtactttaataacttctgatgttttgtatgttaggtttaatacaagcagactgggccaggcatggtggctcatgtctgtaatcccaggactttgggaagccgagacaggtggatcacctgtggtcaggagtttgagaccagcctggccaacatgaggaaacccatctctactaaaaatacaaaaactagctgggcgtggtagtgcatgcttgtaatcccagcaggagaatcggcttgagcctgggaggcagaggttgcagtgagccaagatcccgccattgcactacagcctgggtgacagagcgagactccatctcaaaaaacaaaaacaaaaccaacaaaaaccaaaaccaaacaaacaaacaaacaaaaaaaacaagcagattaacgtttttccagtaaagtttccaaacaagataaacattcatttaccctcactcctgcaagtcaatcaaagttgttagaccagtttgtgtaaacacccaaaataaaattaaggaagctgaatacttccatgtcttttaaagtgaacacccttcaggggaaaatgaaaaataaagctctcactaaggagatgctggctacacaggcaaactacaaccttctttaactgtaatagttttccttcgtttttctactatccctatactcctcttccgaaatcaaagaactagtgaatcatggggtacagcaatgtgtcacatgcaggttgtaaaaactgggcaaaacaagagacaacatacagcaatgtatccctcaaagctcccaggggcctctgcactcagattctcttcttgttctcattggttttaggggcactttggcttatcaaagctttcatcaatgcttcgcccagagggttaacgtctgaaaaatcaaacaggtgaaaaaaaggaattgtaacagaactaaaccaaataaatcccaaacaaaactcaagtagaaagataatttttttagagatggggtcttgctctgtcacccagactggagtgcagtggcacaatcacagctcactgtaacctggaaactcctgggttcaagtgatcctcccaccctagcctgggactacaggtacgcaccaccacgctcagctaatttttctttttattttcgagataggatctcacaaggctgcccaggctggtcacgaactcttgggcccaaacactcctcccacctcagactcactgagcagctaaggttataggcgcaagcgaccgtgcccgcctgacccacaaggatcttaatcaatgttcaccatcatcaacaatgctcaagaacacttcagtttgcatacctcccagccctgaatccttttagagctttctaaagaagcaaaataaaagaatacatgctcagacacaaaagatcccttcttcctccatcctgactcaatagtttctgaatagggagagtgagggtggtgatgattttggttgagacagtctcaattttgaaatatgaaagattttttttttctctgagacagagtctcgctctgccacccaggctacagtgcagtggtgtgatctcggctcactgcagcttctgcctgctggattcaagtgattcttctgcctcagcctcccaagtagctgggatacaggcgcccactaccacgcccagctaattgttgtatttttagtagtgatggggttttgccatgttggccaggctggtctcgaacccctgatctcaaattatccacccacctcagtctcccaaagtgttgggattacaggctttagccaccgcacccagctgattcttttctttgagacagagtctcactcttgtctcctaggctggagtgcagtggcgccatctctgatctttgcaacctctgcctccccagttcaagcaattctcctgcctcagcctcccaagtagctagggttacaggcacgcgccacaatgcctggctatttttagtagaggcagggtttcaccatgttggccaggctggtctcgaactcctgacctcaagtgatctgtctgccttggcctcccaaagaattgggattacaggtgtgagcgactgtgcccggcctcaaatacgcaagattctaatgcagaactagggttgagaatcactgcatctggcttgctttcttcacagggtcatctctaggtctgctgaaggtaacaagcctccacaacctcacctccacccaaagaagaagaacccagagcagttgcttgctgcatttaccctatgctatggtttgaaggtgtccccccaaattcatgtgttggaaacttaatccccactgcaatagtattgaaaggtggggcatatggaatgtgtttaggttatgagggctctgccctcatgaatagattcatgctgctatttaaaataaggtgcttataagacctgagagctacagtcacacgcgcacacaaaaaagataaaataaggtgcttataagtagtgggccatctctcttttgttctcttgccatgagaggaacagtgttcctccccaacaaaggatgcagcgttcaaggtgccatcttaaaagcagagagcaggcccttaccagaacaccaatctgtggtattctgttatagcagcacaaaaacaaaaatcaaaaaacccccaaaacctaagacaacctagctataatacaaccataatgaattgtgacagctcagagatactcaactttaccagcccgaacactcactccccctcaagtactctgccatccaagtcatcacttgtaaatcacgttaactactttcaggttaggaccaggaacgttttagacactgcttactatactccctaaccgggatgtacagtacatgctccccaagaagctttcatcccagggtttgatggctgggttgtgcctaggctatggatggccaaatttttcaccacttcccttttcaagctcccatctgtgcctgcctcacaaagctcaatttaaatctcagccagaggccaggtgcagtggttcacacctgtaatcccagcactttgggaggccaaggtgggcggatcacgaggtcaggagattgagatcaccctggctaacagggtgaaaccccatctctactaaaaatgcaaaaaaattagccgggcgtggtggcgggcgcctatagtcccagctacctgggaggctgaggcaggagaatggtgtgaaccgggaggcggagcttgcagtgagccgagatcgagccactgcactccaacttgggcgacagagcgagactccgcctcaaaaaaataaaataaaataaataaataaataaatctcagccagatcatttctgggaaagtcactaagccagcagtattacatggatcaccacctgaaaatcaatcagttcctcttcaatttctactccatttccaaaactgtcattgttttattcactgtgtgttttccatttttcttctcccaaatttgcaaaactaagtttaaacttttaaactaagatggtctttttgatatggggttaatatgggaacagaataggaggagcccagattcaggctcacgtccagctctatcacttaatggccgtgtgaccgaaggcaaaccacacaaatccctgtgggtctgtttctacttacttcacaagatcatgaggattctacgagatcatatatgtcaagtgcctagcttggagagcagatagtaactgatcactaaatggtaatgagatggagctctagttcttgactatcgcctcccctccaccagtagtaccagttggaaagaagtagcacagcccaactagaaatggggaggggagagaggtaatatcagatggggttgaagtcttatttgaatcctgttaggtcctgaagtatgagctgattttttgtagcagatgatggtcacctttacgggattacaggacttgccaaatcttccacagaacaaaagagctataccaaaaataatatggccagaacactggaaactctgtaatttatcataagggagaaccatagaaattcattcctttctaaaacttgtgtggcatgagttcagtattctgatataacctatggccagtcttcacagggacctgatactcaacttctcttttctcttccaccaagtatcaaacaatgaaacacattgtttacagtaagtgtatataagcttctttttttttttttgagacggagtctcactctgtaacccaggctggagtacagtggcgccatttcgactcactgcaacctccgcctcccgggttcaagcaattctcttgcctcagcctcccaagtagctgggattacagacacggaccaccacgcctggctaatttttgcatttttagtacggaaagggtttcaccatgttggccagactggtctcgaactcctgacctctccatccacctcagcctcccaaagtgctgggattacaggcgtgagccaccgggcccagcccaagtgtatataagcatcctgagggcaaaaatcattttagcacatagtggtgctcaaacatttgaaaaatgaataaatggccaattcctaccatcatctctatatactcttttttaagcaaacaccagagatttattctaaactaccaaataaaataccaataaaaaaatctggccgggcacagtggctcacgcctgtaatcccagcactttgagaggccgaggcaggcggatcacgaggtcaagagatcgagaccatcctggccaacatggtgaaaccctgtctctactaaaaatacaaaacttagctggatgtggtggcacgcacctgtagtaccagttacttgggagtctgaggcagaagaatcgcttaaacctgggaggcagtggttgcggtgagccaagatcgcaccactgcactccagcctggagacagagcaagactccacctcaaaaacaaaacaaaacaaaaaccaacaacaaattgtcagtccttggagaggaactaatgtgccttaaattgactaactgtccccatctttcactgcacctaaaagttcaaaccatcatactatattaggcgtttaccttaagaaaaccagcactaaacaaaaccaacccttatgaagtgtcattttaattttgttgatcctcacattaatgccaccccactccctctgctactaccatctatgaggcatgttaggaggtggatggggctgccttttataaaaggtttagttagactatcaaattaggagggatgattctgttacccttcaaagggactaggaaagttacctgaaattagtttatgcaattgaccttagagtcagatgctattaccaaatgggagaaataccaagaccggaacttactgagacattacagcaacctccaccctagggtacagaataactcagatgtccaaacattttcagaataaagttcacaaaggttcattttagctttctgtcccccagagaacaaagatttactcagtcatctaaaacaaaaatgtacacatctggtagagtgtgtacactttttctacaatgataggcattattagtcttaaaaagaaaaattaaaagatcttcacaaacccagtggaatattccaccaggaagcagctttgaagctggaaaatttctctagtgttcttacaacagtgcaaagcaagagactgcaatcacaaccagtgttcgggattcattacttcactacttagatctttctaatatacgaatgagctcctggggagggattttgcaacaagttatttctctctccactgatgctcgtcaagaataaacatgttcagtatccaagttcttcctagggtggaaatagcatgtctgttttcttttaaatctttgcacctgagtctcagcacacctgctcctcctactaaattacaaatctccatggacaagagtcttcctttcagaagggaatgggagacgtctctattcagcaaaagaaatacttgccaaagggcaaggtagtgttgtacaaattagcaccacaggctttgaaatcagaaaagtgagtacagaatctggcactgacccttactaaaggctgtgatattaggcagctatttactccctgtatgtactttaatttcttcatccatgaaatggcaataatagctttcctcacagagctgttataaggttataagggggggggtcaaatgtatgcttactcatcctcagaaaactagtttcttttttttttttttttttgagacagagtctccctctatagcccaggctggtattggctcactgcaacttccgcctcttgggttcaagcgattctcttgcctcagcctcccgagtagctgggattacaggcatgtgccaacacacccaactaatttttttatttttagtagagacaggttttcaccatgttggccaggctggtcttgaactccttacctcagtgatctacctgcctagacctcccaaagtactgggattacaggcatgagcaaccatacccagccaatgttaccttttttaaagaagaagaagaaagcattagttcccccatgaagcagatggggaaactgaagcccatggatgaataattggcttttttttttgagacagagactggctatgttgcccaggctggagtgcagtggcacgatctcggctcactgcaacctccttttaataaaagatgaatttcggccaggcgcggtggctcacgcctgtaatcccagcactttgggaggccgaggcgggcggatcacctgaggtcaggagttcgagaccagctttgccaacatggcaaaactctgtctctactaaaaaatgcaaaaattagccggctgtggtggcgggtgcctgtaatctcagatacttgggaggctgaggcaggagaatcgcttgaacctgggaggtggaggttgcagtgagctgagatcacgccactgcactccagcctgggcaagagagcaagaccgtctcaaaaaaaaaaaaagaaaaaattagccaggcttggtgggacacacctgtaatcccagctactcgggaggctgagctgaacctgggaggtggaggttgcagtaagctgagatcgcaccactgcactcaagcctgggcgggaaagcgagactccgcctcaaaaaaaaaaaaaaaaaaaaaaaaaagaccttaatcatctgcttatactaaatccccttcaacatgtactgtgttattctgtactcactaatatggagttgaaaatggtttatattatcattccatggttgtgtggcagatcatgttttcattttattacatatttcttccaaaatgtctagtgcccaactcacagcagatgtttggtgaagcccattagcttactggttaatagtaaaagtgcatttctggcttcatattcatatacccagatgtgtattttggaggaaaatctagtttataaggtcacagacacagcaggaaaacaaaaagaaccttttattttgactatgatcattcttctaaaggagatcttagaagaacaaatgaaaatgtgaaaacaagagtacaaactcaacatgcagagctatctgtatgataagaaccagttgccaggcacctgaaaatgtcaagtcctctgaacctgaaaggattgtgagaagagtaaagagagtgggcaaggatgtgtgtcaaatggcataagataaaaccgtatcagagggagcttcatcatactctctgaggacagtacccagtgagaaacctcagactctcaatttctaacctgccggggaaaaaaagcctgaaccttcctaattccttctccccctcactaagatagtaggctgctgaagaattaaaagacacctacagaatgtatcctaggagaaggttctattctgagagccctagagaataggctggactgagaagtaatttctactgtccagcctcttagttgaacagatccagcagtgggaaggcaaatttctccttcctactcttcaaataggatcgaagaccatttatagccctgctgcaaagctgacactaacttttttaacaatgaagtaccatcccaggacagggggtggtgctgtactgggccgatcctcaatctcaagttcaaagaaaacgagccctgtgaagaaagggtccaactggtgtggaggatgggagagacctataacctacacagcactctgccttaaatgatactctaattatgtactcttgcttaccttgcaatatgtccagagtaagccttccttccctggaagcataagtatatctgctattacaataggaggtctgtcaagacttgaaattcaaagggagtaattgttcattaggttcacagtgcatagaacaccatgccagatacaacggctgttaggactagttctgagttgaagcaggcagcctacatacttggaggaaactaaggaccaccaccacatcctttctaacatatatactctgtcctcttccctttactacctcttttctctctcatctatttctcctctttctcatagttcagacctgtggcatctgtatcctgatcttttaataatacagttctccattagggtatctctacagaatcaatgtttgtatatacaaaaggaaagagctaacattacagagcactctctatgtggcaaatgtggtgttaagtattttaacccatattatctcaactgttaccacctaatccaagattaatgtccatagttacacatgtggaaaccaaaatttggaaagagtgagaagtctgtagttgtttgttctatattcatctcttctcacaaaacttaaaatagtctagttcttgacttttttctcatgtggtctttatttattattattgttattattattttttttgagatggaatcttgctctgtcgcccaggctggagtgcagtggcgcaatctcggctcactgcaagctccgcctcccgggttcaagccattctcctgcctcagcctcccgagtagctgggactacaggtgcccgccaccatgcctggctagtatttttagtagagacagggtttcactgtgttagccaggatggtctcgatctcctgaccttgtgacctgcccaccttggcctcccaaagtgctgggattacaggcgtgagccaccgcaccaggcccctattattattattattttttttttttctgagactgagttttgctcttgttgcccaggctggagtgcaatggcgcaatctcggctcaccgcaacctccacctcccaggttcaagcgattctcctgcctcagcctccctagtagctgagattacaggcatgcaccaccatgcctggctaattttgtatttttagtagacagggtttctccatgttggtcaggctggtctcaaactcctgacctcaggtgatccacctgccttggcctcccaaagtgctaggattacaggcgtgagccaccacgcccggcctgggcccctattatttttgagacagagtttcactctgttgcccaggctggagtgcagtggcggaatcccggctcactgcaacctacgcctccaaggttcaagcatttctcctgcctcagcctcccgagtagctgggattacaggtgcaagccaccacacccagctcatttttgtatttttagtagagacagggtttcaccatgttggctaggctggtcttgaactcctgacctcaagtgatccacccaccttggcctcccaaagtgctgggattacaggtgtgagtcaacgtgcccagtcctcatgtggcctattaatttgtctaaccaacagtttgggggaagggaggcatggaaagagccagaatagaggacaaaaaaagtcttctttatgagcctgaactttaaatggttcaggtatttgtatcaaagaccacaatgtatcattttagctacaaccagcccttcaacgatagtgagggaaaaaaaaaaagaatgtgaaattcagtgctttgagaatattatttccaccaccatttaggtgaatattctattaaccaacaatgtttacttggggaaggtactcaaacacatccaacataccttaatttattcaaagtatataaattaagcaatctgttcatattaattatctctaagatttaaaacattaacctattcaatgatctcgccaaaacactgttaaatctatataatgtgaggaattcagtggggattctttaaaaatggttatatttgggggcaggaacaaccaattttatttcatttagaattaagatatcaacaagttatttttaagtaaacagtttttaaaatgtccaaacactacagcagaagtttgcaagctcactgaccttcaaacaagggttatggttatgagggttatctgaccaagtgttcattggataagaaacacataaggtttcctagtgaagataagtgaagacattttaacacccacagacacaacctaacccaaattaacactgtccattcctttgtcacattcaccactgtccctggctagcacaggctctagttatgattttattaacattaccttaaaactataaggtgtccaacattatttctgaggccacctcttgcctgctcagaaaacaccaagggaaaaaacaaccaataattctccccctttttccaacatacgttgacctgttttagttccttattcaagataccctcaaccacagtattggtttatgtatacatttgtccttcataagccaactgtggagcatataccaggagcaatcatgaacagggaagaactaccatcaactttaagtggggcctatgtctaccaaaataattaactggttattttactagcacacacaaactaacattcgaccaggcttatctgaaaccaaataagcatgttctacccaaatcaaaaatcaagtttatgtgtgacactcctttcaactcagaagattaagtatgatgctggttacaaaacagaatgctatgaagttccccattttagtaatgtggcctctataaatgctcttctacacacgtgtaacataaaatagaatctgttatagctcagactacattttaaggaaatctagttttgtattttctgaaaataaaatatacccattatagcacattggtttaagttctgaactctgctacatttttgctgtgacatcttggacaaattatctcttagcctcaggtgccttgtctaccaaatggtggcaatacttgtgaggattaaatgacttaataatgtactgtagcacagtctataatatagtatgtgcttaataaattattttgccaacatacttccctttattcagatgtagttagtgagcccattttgcaggtggttcctttttcaagctacattaaatttgggtcatatatcaagagataaccacataggattatcttaatttcaaaatcactcttattctagcatattttaataactactgttaaaaacaaatccatgattcctatgcctagaattctacactgctaaggggaggaaagggctttttcatttccaaaacaatactgttactcaaccactaagtctcactaccttgtcctaataaccatgcctgaaaacctcagtttcctcctgaaaaccagagtatccccaaaacatcagcaaatacagattcattttgccatccacttaagtctttaaagcccattacaattcttctaaagatattttatcactaggtaaagtaggaataacattttccactgtaccctatctatgaaaatctagagtctgactttaacacaagttggcaatgaaaatattcccacctccaaaaactggtatatactggggaatcttctgactcccttaccaatactcagagatggccaagattttaaatttccatgggatcaagatgcaaccaaatcctgattaaaagcaaagtaggacatgattattaaccacaatgtgtagcggaaggtcctccagctattttagacagcttaatcatgtctgaaatatccaaactcaacaacttgaaatacaagttgtgtcttataacttcatttttagcatgctttaaactttactgaactttgctaaacaaagaggtaaagccttcaaaagccttaaagaggcgcttaaaagtttctagtggctaggtaacatgggtagaacaaatttaagaatgagtttccttcattaagcagtagaaaggaatgctgttacttattaagcaatgtcatcttcaatgttacttcattcaaacaggcaaattatagtcatgatttaattttttggactgtttcagagaatataacgtatgcaaattaaaatgtgtaaacctgcctgctactgaaagcagtaagaacaaatccagaggtcacatccacctatatacaatactgcaacaacagcaatctataaaatgcaatactggattgaaggcttcaagtaacaaaacaagatcctactgaaacaaaagaacctggctaattcttggtagtgcaacataatgggtcgtgacctatgttaccctttctgtacagtattctcacattttgggaataactggtcactctatcatacggcacaagttcctgtaagatcattaagaaggtctggatattctattgaattcaaagaaaaacctaaggactaacaagccgctgtcttcgattcatattaaactaacgtttctccagtaaaccgaaggagtgagcacaagcccgtcactgaatggggccaaacttttagaagcctcattccaaacagaactgtccctaatttattaagaacaaaacactagtaaaaccaacctgtgaattgggccttcagtacaattaagcacatcctgtttcatataacagtaataatgaagagcttggaggggctgtcattctaaaattgcaaatctacccataaatgacaatcctgggctggaaaccagaatgtcaaattcttgtgctgaaatcaacttttcacatggcctgaggcaggccattctactattctaagaatgctcagacatacaagtatgtaataatgttccaaacacttttttttgggggggggggcacttcctgtaagtaaaaagtttctatgactgggaaaggaacaaaataaagtaataaaagaaacaggaatacccctggcacaccttcctcaaacgaacaacgttaaaaaaaaaagaaaacacacacacacagctaattttaatctagcctactctccccccaatggacacacctacagtttcttatcaaaatgtacaagactcaaagcccatttaattcaattatgaatctcactcaacaagcatcaagcacatcaggcgcctctctacagcgatatccccacaagtttcagagaaatgccagcagggactctgtagttatgattcctatcaaacggccccctaacccgtatttctcctggacatacacatgcagattcattaaccaaaacctacccagcacccctcacatcgcgcgtacgttggcattttcagtttataggtgggtcctggaacagctaaaaccaggaagctccggggtaattagaggacttgggagaagtcatcttgggacaggtggaagacccagagaaatcaggaatcagaaagaagctgtccctggccacctctgcttcccgtcccatccaaacttcacccacccgggtctcagaagcccagaagggagaggccattttaatgaggcctggctgagaaatgaagggagaagaggaaatcagggaagggccctgggaaaggaaggccgaacactttgccacaatagcacccgagtcgggtggcagcacctggagcccgaagagggaggacctggacttaagggcccgggagaggtgcaaaagtagcggtggcctaccacgaggggggccgagtgatctaaaccggggagcgcgggccccttacccccatgcggggaaaggaccccttctcgggccaaccgcgccgaccctcgcccctgggtcaggggctactacccagagatccagaaggcgggagttggctagtgcctggttctcctcatccggccatgcggcgcgggggcgtccatcctgaggggtccgggaaccaagagggcacggagggtgccggacgcggcgctcacccgcgggccgcctccaagctcttaatgagcttcttgatcttccagatctccacgttcctgtcggcagcactggggtcgtccgccatcttctcgcctcctcctccctagagcggcccggcggggcccggagacaccaagaccacagagttagcgccgccgctggggcagagcggcccccttcctcgccatcccccagaggccctctcctcccgtccggtgcagctcgccacaaaggtcaccggcctttccctccctgtgccttacctaagggcccagtcctgggcggcagcggctgctcctccccggcggcggctccgcggcggcggcggctctgacgtaggacaccggctccctctctccaggcagctgcatgtgttgcaatccgctcacatggggcctgtgacatcacttcctccgccaggggcggagtggaaggcggcaggcggaagggagggggccggtgcgagt

SEQ ID NO: 1696 - DNA, 32723 bp, Homo sapiens
  source 1..32723: mol_type = genomic DNA
accactttcacaatctgctagcaaaggttatgcagcgcgtgaacatgatcatggcagaatcaccaggcctcatcaccatctgccttttaggatatctactcagtgctgaatgtacaggtttgtttccttttttaaaatacattgagtatgcttgccttttagatatagaaatatctgatgctgtcttcttcactaaattttgattacatgatttgacagcaatattgaagagtctaacagccagcacgcaggttggtaagtactggttctttgttagctaggttttcttcttcttcatttttaaaactaaatagatcgacaatgcttatgatgcatttatgtttaataaacactgttcagttcatgatttggtcatgtaattcctgttagaaaacattcatctccttggtttaaaaaaattaaaagtgggaaaacaaagaaatagcagaatatagtgaaaaaaaataaccacattatttttgtttggacttaccactttgaaatcaaaatgggaaacaaaagcacaaacaatggccttatttacacaaaaagtctgattttaagatatatgacatttcaaggtttcagaagtatgtaatgaggtgtgtctctaattttttaaattatatatcttcaatttaaagttttagttaaaacataaagattaacctttcattagcaagctgttagttatcaccaaagcttttcatggattaggaaaaaatcattttgtctctatgtcaaacatcttggagttgatatttggggaaacacaatactcagttgagttccctaggggagaaaagcaagcttaagaattgacataaagagtaggaagttagctaatgcaacatatatcactttgttttttcacaactacagtgactttatgtatttcccagaggaaggcatacagggaagaaattatcccatttggacaaacagcatgttctcacaggaagcatttatcacacttacttgtcaactttctagaatcaaatctagtagctgacagtaccaggatcaggggtgccaaccctaagcacccccagaaagctgactggccctgtggttcccactccagacatgatgtcagctgtgaaatcagactgaaatgctgaaataacgataaaaaaaaatacagaggttaaactagcaaagtgagtaaagtcaagggataaagaaaatttgttggaaaactcacaaagcaggacataaagcaaggccattagatatatctcattagtgtgacatctgggaggacaaagcatccaaaccctttcttctatataagtggtgagatgatgaaggttgtaagagggcttctgcccccttgaagacttcagatgctggggaaaggatagataagaataaggatgaaccaggcttttggagcctgggaaataatgactagcgataaacctgaagggaagttaagtatacgatccccagataatactaaggagaaaggcaatgtgattctgcagccattgtagccagagataataagcccttgaggaaggggccaggggaatttttctaaggatagacagtattaatgcagcactctcttctgctattaaactctcattggcttctaaaaggagtttcggtgagtgatttgctgagatgttgcattttcatggctgctgcctttaggtattattgcaacagtttggaattttgaaattaaaacagttctgtaaaaccagtttagttttgtaaagtgtatgcatcaaagatgtccttcattcagacattactgagttacaactatggtgccaggtactgtgtcagggtactaggggtatggggataaaccagactccctctttgatctaaagcagcatgaggccaggtgagaggtttcaatataatgtgataaaatgtgcactaggtactaagggatcatagagaaaggaacacattaaatggggaaacaattgatagagagagaatattttcatctgggtcttaaaagatgagtaggcgttctctctctttaaatgtctgatataagggcattttatgcaaagaggatcactcgtgcaaagactcagatttgcaagaacgtgaggtatttcaggagttttgtatggttccatatggactatgacaagtgagacaggtaaactaggcagagctggtcatcagataatgaagtcattaacctaaggagattggacaataaaatgcaatatggaggtatcgaagtataaacataaggagtaccactgatggctgatttaggatgcccagtctggcaacacgctaatgaaatgatagtgggggagggggccgtaccaagactaggagagagcagtcctgagactattgcaattatctgcgggagacataaaggctagaacctgaacagtagcagtacaaaaaaagaggggagttcaaatgatattaaggaagtagaagtggtatgacttaaccatctgggtatggaaggggaaatggctagagtcttggggactttgtgtttgatgtgattatggaccacagaataatgtctaagagaactggctctttagtctgactgccagagtctgaatcctgaatgttttagtatgttaccttgggcaaagcccttagcctctatgaatctatcttcctcattcataaaaataagatgacagtgcctatctcgtgggacttttgtgaggatgaagtgagataatggatgcaaagttactgagcacagtgtccaacacagcagaagcattacatatacattagctattactggctacattatgatatacagttagggagttggaaagataatctgaaattcaggagacgtatctgactataggtgagtatttggaactcattgttctgtaaacagtagttacagccacgtgtgtgggcatctggagagtgagcatggatattgtgatacctagtacagtgcctggcagtagtggttgtatgctcagtaaattttgttgacagggtcagggccggactagactgtggtaagcaaggcctgtagggcataaatatacttgtatgccccgagaagtgaggacctcttaaatattgtgccctacatgccttgtttggttcactcttgtcccagccctagcaagtatatataaggtgaaaaaggaaaaagctgaggctggagcctgggagaaccctggacatttaagggccatggagaggaacaggagttaatcaattcaagtgctggatggataacaggagttagagcaaagcggggaaccagaatagagtgattattataaaaagagtttcctaaaaagggagagatcaacaattagaaattatttagagcagccagtaaatacataaactcaaaattattctttaggtcattcctgattgtgacaatagtcatttcattatataaatgtgattaaggaaggaaaagagctacacagaagttattaaagagctaaagagaattgagaaatttaaaacagaagaaagtagggccaacatgaaaggagtagggagaaaaagagataaccagcatattgtctcactgatcctgccaacacctgtgagatagatattcttattatactactgttaaacctaatttacatttgacaaagttaaggttcagagcttgtgtgacttgtccaaggtcacaggtctagaggaggcagatacttgattcaaacctatttctgtctgatctgattctaaagtctgttttttcactcaaccacactgtacagtcagctctccttgtgagttccacagccacagattcaattaactgcagatcaaaaatattcaagaaaaaaatggatggttgcatctctactgaacatgtacagactcttttatctttcattattccctaaacaatacagcataacaactatttacatagcatttacattgtattagctattaagagaaacctagagatgatttaaagtacaaaggaggatgtgtttaggttatatgcaaatagtaagccatttttatatcggagacttgagcatccacagatcttgatatttgcagggggtcttgccaccaattttccatggatactgaggaacgactgtaaatggatgcaggcatggatgctatttaggagtgtccagggccaagtaaatgagttgctgagcagagaggtgggtggaggctgtgaggcatcaatatgtggtggcatccatctgcattttggtgatttttttccttcacagtcctcggctgtctgggaagagaaggatgaaggcagatggctgctccaatttaggggctaggattgcagggtgggcacagcattgcaaacgagtgaaggaaattgagaaatatggccaatgaagagttgaagagaggcctggcatggtggctcacacctataatcccagcactttcagaggcccaggcaggcagatcacttgaggtcaggagttcgacaccagcctggccaacaaggtgaaatggtgaaaccccggctttactaaaaatacaaaaattagctgggcatggtggcgggtgcctgtaatcccagctacttgggaggctgaggcaggagaatagcttgaacctgggagatggaggttgcagtgagctgagatcgcaccactgcactccagcctgggcgacagagcaagactctgtcaaaaaaaaaagagttgaagagaaaaagtctaggctaaattcaaagaaaaaaagtgagcccaaaaggaacttgcagagcaagggaaaagcagggatgtcaagggactagaacactccataaagtgaacagctgcaatgaaaataagggaagaaagtttagttcatctccgtttctttcctttcctttttactttcctttctcttcctttttggagttaatcaggaagtagtcccaaataccccagaaagttcatcttataagcccttggtcctcttgagatggtatcagatatattgctagacccttgaagaaaggaacaactccaggcaacttcttgagtccctgttattaattttatacatacacacacatatatgtatatacatgaaaacacacaaacacatgtgtgtgtatacagccatgcattccttaacaatggggatatattctgagaaatgtgtcattaagcaatttcatcattgtgcgaacataatagagtgtacttacctaaacctaaatggtatagcttactacatacctaggttgtattgatgtggcctattgctcctaggctcctgggctgcaaacctgtacagcatgtgactgtactgaacactgtaggcaatggtaacagtggtatttgtgtatctaaacatagaaaaggtacagtgaaaatacagtattataaccttatgggaccactgtcgtataatgtggtccatcattgaccaaaatgtcattgtgcagcaaatgattatctcatatatatatatatatgatatgatatatatgatatatatgtgtgtgtatatatgtatacatatatatgtgtacatatatgtatacatatatacacacacatatatatgtacacacatatatgtatatatatgtacacacatatatgtatatatatatgtacacacacacacatagagagagagagagaggagaggagaggaaggagggagggaaggagaaatatgattcagatagagacatctatcctccagagttcaggagtgtctcttcagactaggtagatgtagcttaaaaaaaacatatcctgaattctagagagatgcttaaatcactgcaattcctataacacttgccaaccaaaggtgctgttgatctgaaattgcttttttaaattaatgcagtgatttttctttaacatctagtgacagacactggggtcacatttgcagctggaccataattaggcttctgttcttcaggagacatttgttcaaagtcatttgggcaaccatattctgaaaacagcccagccagggtgatggatcactttgcaaagatcctcaatgagctattttcaagtgatgacaaagtgtgaagttaaccgctcatttgagaactttctttttcatccaaagtaaattcaaatatgattagaaatctgaccttttattactggaattctcttgactaaaagtaaaattgaattttaattcctaaatctccatgtgtatacagtactgtgggaacatcacagattttggctccatgccctaaagagaaattggctttcagattatttggattaaaaacaaagactttcttaagagatgtaaaattttcatgatgttttcttttttgctaaaactaaagaattattcttttacatttcagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacagtgagtatttccacataatacccttcagatgcagagcatagaatagaaaatctttaaaaagacacttctctttaaaattttaaagcatccatatatatttatgtatgttaaatgttataaaagataggaaatcaataccaaaacactttagatattaccgttaatttgtcttcttttattctttatagactgaattttggaagcagtatgttggtaagcaattcattttatcctctagctaatatatgaaacatatgagaattatgtgggttttttctctgcataaatagataatatattaaactttgtcaaaaggactcagaaagatcagtccaaccctctaacccatattgaatggtgatatactacagggttatgccagtgtgggaactatcgctggtaaataagtttaatcctccctagggcttcacaaagaacattgttccaccccaggagggtggaaggaagaaactgaaatgattgtgtcttagaacctaatgaaagtttgcattcctcagtaaaatcagagactgctgattgacttaaatgtttatagcttcaaagtcctcctcattatcatggcccacaagcccttccatgattgtccttccccaccctccccattacccttcttgcctcctctgctacttctctcctcgcacactgggctccagccaccctggccttcctgtcacttcttgcacactctaggaatgctcccactttggaggctttatctggctgtttctcttatttggctgttcccaacttcctgtgggctgactccctcacctccttcgggtctttgcccaaatgttaccatcttaatgaggcctaccttcaccatctattaatacttcaacctgccccagtagccttaccactctagacacctgtacagaactccactctactttttaacagagcttttcaccatctaatgtatcatataatttcttactcatactatttatcatttattttctcctactccactaaaatgcaagtttcatgttggcagggatattcaattgttttgtttattgatatattcctagcacctagaacagtatctggaaaagaggtactcagtaaatatttatcaaatgaattgaccaaaagaaggaaaactcaaaactttaatgacaactaactttaaagctacaataacttaaaattcagcagtaggattttgagggagggtaagtttcaaagattgacttacctaagactatctgcataaataaaaagaaattaatccagacaacaaattcaccaacttccatcaattggaaatccaattctattttctacagtttatgttctggagacactactggacactcttttactctcataactcataactcctccacttttgtttttaaatcatgagagaaaaagagttgactctgttatattgttttatctacctttccttgatcttagaaacgaatactaccataccagcttctactgaggtgccccctaaagttagtccaaataggtctttgcaatctccattcccgcagaatttagaactttgaatcacatgatttatttctaaaagtaaatccatgccgattttccccaccaaaaaattcctgactattaaactcctacaatcccttcattgctcactccccacccccaggatcatattttaaagttgggcccttgccttttgggtcacataggtacactgtttgctataccacaggtatagctatctggaaaacatggagggtattattctgttactactgcttcgtcaaccaaaaaataaaacaaaacaagaacaaaaaagaaacaaactccctgcctcttttcacttgcagtcaaggttcctaaccactacaaaattagcctatgtttcttcttgcacatagtagaaacccaagcttctcactgctgtgctattctgtaccatcaactcatcacataaagagcctggttgaagaatgattgtccaaccacattactagcatctgtcaagactttccagtttacaaaaggcctatcacatttaaccctcacaccatccttgtgaccaaagcattattaactccattttacaggagagtaaactgaagcttagggaagttaaaagaactgccaaaggtctcccagttggggagtcatgaagcccagaagagaagccaaattctctgctgctcaaccccttgctttcactattacacctcagggccttcaaatctaaatgcagttattcattaaacaggaacctggtagtcttaaacaggaatctctcacttggtaagatcttgtctcttgttgtatttgaccccaactgtctatggctttgcctgaacccaaagtacacacagcctagaaaccaaaggagaaccaaatgtgggataaaatgacactcattttaacgacatgtctcagcaaatgagttcctgtgtagctggctgaaagcccagaccctttcagtaaaacatcctgaataattcacatttgttggtctataatataaagggcaaatgtagctcatttttagaccagttctgaacatcaatagtaacaaaccagagataaccgattttgttttcatagaattggaacaaattagagtatctgtgcaaaagcatatcagatctaggagcagaggggacaaggtctaatttttaaataagcaaattttccagggagggactacttatgataaagggatattagtctcttagtcaacggaacctggatacacgcttctgacagagaagagggagaataggcaggaatctacacaccagatgtcaaggagatttgctttaaaatacgactgataattagaaatttctcagtttcccccttttccctcattctttgattcttattgttatctttatctcttactcctttgtttctcatatattgagtcttacagatcaagctcctatttttttcttcaggggtatttttctagttcaaagtgcctaccatctcccttctggttctattcatccttctctcccaaagctcctttagaagtgtggattaaggcagagcactaagaaaccagacttaaagattcccttctcattctgacttttctcctttcacctattccttcctcctgttttcttaccatcagtgtcttcaaaggctttcaagtacacggtaaatgcagaaacttcaagaaaggcagaatggaaacataaccaatgcatacataaataaagcacactgtagaatctttttaaattctgtatgatatatcgaatgctgtctctcacattacctagaccatttgaaaccgaatttgtaaaacatagactatctttaagtagtaacagatgcttctgacatgttttctattgtcttgaaccattactgcatatgatacatcaaagttaagtgacaatacaagaaagcagattcatttgctccctgcctaggccgtcagttcctaaagtggaaacgccatatattatctagctcagtttgctctacaagacctgcaatagagccttgtgtgacatagagataatatttgttgaagcaattaaatttgacttggaattaactctgccatcattctataaggaaggattgaaaatccttctcaccctgtgctgatatagtacctttctatacaaaaacgtccttctccctcttcccttggattgcataaactatgtacatgccttcctcagggcacttttctaggacagtgtcagcctaaggatctttgtttgggtggcttttagaaactcaggaagacaggagcatcatatgcctataggcagctggcttccaggtcagtagttttgctctgaccctaaaatcagactcccatcccaatgagtatctacaggggaggaccgggcattctaagcagtttacgtgccaattcaatttcttaacctatctcaaagatggagatcagtgtgagtccaatccatgtttaaatggcggcagttgcaaggatgacattaattcctatgaatgttggtgtccctttggatttgaaggaaagaactgtgaattaggtaagtaactattttttgaatactcatggttcaaagtttccctctgaaacaagttgaaactggaaaatgcaatattggtgtatcataatttttcttaaaaacatacctttgatgcttataaacatttcatttgtagtgatagttttcaggatatgagttcaagaagctacattaaaatcaataacaatatttggtaactaatattaagtaataatgatgttccactcacttattaatctttaatacaaccgtatgtggttagtactatcattatgcgcattctatgcagatgagaaaaccgcaactccaacggccaaaaattacagaggcataaatggtttagacaggacttaaacttcagtgtgaccaaaacccatgcttctaactactatattcaaaactcagagaaaactgaacccagaaaattgaaatcatgactaaattgctatcaacataggtagtgaaagtcaattaagtacagaactggagtatgactggccaattatcccatataatgggaattctccacatgtacaaaccacttcatatgctaaacttgttgacaacattcaaagctcatccctgaatttgactatattgattacatcaaaaatgttacatagcaaccttagaatccttgtgtaccttttcttctcaaagcctagattatttctttttccgacgtttcagtaattggagcagtaaaccccagtgtcccttacctacttgtttattacctccagatgcaatattactggtactgtgattgagaaacgcacacagtgctaatgaggaattcactttctactctgacactctggaagaatagagatgcaatcctaaggaagaatttaacaccacaggctacatgactaaggataaagagtagaaaattagcaggactctattaaggcattacagcaatccacctgacagatgaaaaaggcatgaaatgaaatgaaatgtagcagctacactcgtcctattgagaaaggaaaaaagtcacctgtaatgttgttcagaaatcctttcagtactaaaaaattcattgaccatcttcctttagtctcgaaaatttcttagaaggtaaaaaaaggaaaaggtgacagggcaaagacatttgaaaagaaagaaaagagtgaatgaacttgcacacctggcttggactcccattcccttaggtttccattgtgggggacaaactaatgcctgggttacctttcttgagagtgtgttaattgattcaatatctctgaagtgctactttcatctgaaaggttataatttgaaattcagatttacctggataaatttgatcttgctattatggaaacctctagaaatccttggagtagttactcattatcagcttaaataatatagccggtggagctgagggaatgagtaactcaattagtctcagttacaactgaagggcacattgttgtaaactataattgaaaacataaatatctttacctagtttaaaaataaagatgctttaaaaggaggaagggaatagccctgaggaatgtaaatataagcacaaaacttctacaacagagtttgctacgtgtgtggctgtgttccacccagcaaaaatgctaagtctacaactgacacaacttggatactctcatgttcccacattttggtttggtcaaggctgtgcagttgtactgcagccaccaccactcctggcctctacagtatattgatctgacccaccaatctgatcaaggtttagaaaaatattttcagcccagttagctcacaaacaaaatgagaattcccacaaattgctctttatctcagacaacagaggaaagctacagcaaaagcataaacaaattaccatttaagtttgttgcttcaaattaaagactaattgcaacagctactagatagcacagtttatggggcatctcggccccaagtcttttgtcttataaggtcttgaaaaaaagaaaggagattttcatcaataagagttttttgttatctttttcccttgttcatcaggcccttcactgcgagagagaggtgtaaacgttcagggcatgcattctagttaaagaatattaattggctattgggtccctttggttagaataaagacctctgtatgatgtccctagctgtacatcaaacccaaatatctctcagataaatgaaggtctgtaagaatttggtcattcctgtctcttctaaagagtaacagaggcattttcccgcagtaaagtagaatggaaagaaaacaaaaatcacaagcctataaacaccttcttcaattttcccagcatgtcacagacactactgtcttatttactacgtatttctgaggagtaaaaaaaggaaatatgttgagtttagctgaagcacagcatattttgtggtaaacttgttaaataaaacatcttttgtccaagctttggttgtcacacaagtggatatatcaggaaatataaaggcagaataaactaaagcagaacatactaacatttgtagtaggcatgaagggaattagaaagtgtttgtgttaacatggagggagggagaacagatgctttgagatgttcttcaacagatattctaggcactgagacccccttcgggaccagagagagcccatatccaccacagtacctgacacataaatgctcagtaattgataaatgagtcccattctaactgttccttagccctgctctatggaactctcccctggaattccttgtgccattattttatttctggaatcttcagccttttagctgagggcaaaagattgctgattaggaagcaatatttcccacctcctgcgcaaaacaagccaaagatcaacagcagcagcaacatactgagccctaaagggcaatgacaaatgtggagaatgatacagaggtctggttacttcttagccaatgacacagaatcacaattgagaaaacacagagtttattcattcccattgtgcatgccctggacaaaccaagctgcacctttcgtaacttatcacaatctcatattgacggaacactttctacaggtaatgtttgatttggctgaacactttagcattgcttcgtagcaacaaaatgatagctagtaacagaaaaagatccagggatattaccactgttagtgaggagaaaggccttttaattaattaattaattaattaataggaccaagtgccatctttttggatcatgcccttagtggattattggtagcaaaggttaaagctcaagctggttcctttgtccccctggcaacagttgatttgcctccctttatctcctgaagtatccgtaaggactaagagccaattattacatttggctatgctagcatatgtaaaatagagtttaaaagtttagattcatcactcaaaaattcatattctccaaaaccatacagtcactctgttagcctgtgttcccccagaaaaaaagtcacaagcttatttattaacatgtgcaatcccagggggcaagagaaaggaactgaagagtgaggcagaaaggaaaagaaagccaataagaggatgagttatcaaactactcgtttctaacagcaactgattgcttaacttcctgggactgtctccaataagtcaaattggcctcaggttagtccacctgagtgggaagaagcggtgaaagaatttgtctgtcagtatctgtctctcattggttagaagttcgacttatggggaattaactccctcacatttcctagttggatatgcttgggtacccagagggtcatatggcatccatgcctcagcatgaacagggaagcttcaaggcaaaagacacatagtgcagctatgagccaaggcaattcaaggatacacccataggaggctggttgacatccacccagagctaatcaccaccatgctggaaaaagacacaggtgaagctgagaagaatgaaggtggtgcataggaggtatctaatacagtcactcattttcaaactttccatgttatgattgcactgaccactgaggatttctattgaaagttttactgttgtcaaacacgtacacaaggggaaaggtgtcttacattgtttatgttcctgtgctgctctagaaacagaaataggctcaagagcagagcctgtttttcttaattcagcaggtctaagctaacaagtcctgaaacatggtacttcctgttattggtattgcataggagaaacaaagggaaagcacagtaattagaaaatacaaaacaagatggcaggaataagccaaaaatatcaggaaacacaattattgtgaattgggattaaactaatctattaataatgacaactttcagcttggagttaaaaatttaattgtatactgttaacgaaagtgatacctaaaataaaattacactgggaggccaaaatgaagggatgtgaaaagaactatcaggtaaaaactaacaaaaagaaactagcaaagcaatcttaatatcagacaaaatagaatccaagaggaaaatcatttcaaaagacaagagattttttttattaataaggggaattgcataggagagtaaagaaaatgtgggccactggaatgcttagcactaatgacatattggtctttggtcttcagttaccttacaggaccctatttcattctcttatgtttgatatgtaaccacctcagccagcttcaagttgctttttggccctaatggacttcctagcactataatttcttttttttaaatgttttattttaggtttaggggtacatgtgaaggtttgttacatagataaacatgtgtcacaggggtttgttgtacatattattacatgacgcagatattcagctcagtaccaaatagtgatcttttctgctcctctgcctcatcccaccctcctccctcaagtagactccagtatctgttgtttccttctttgtgtttataagttcttaacacttagctcccgcttacaagtgagaacctgcagtatttgatttttgttcctacgctagtttcctaaggatgatagcctccagctccattcatattcccacaaaagacataatctccttcttttctatggctgcataatattccatggtatatatgaaccacattttctttatccggtctgtcattgatgggcatttaggttgattccatgtctgctattctaacactgtaatttctaaagacttccagattctacttttataggtaacctgttaaacagtctagctctggaagccaagcaatttctagaataactaagcaatagaaattacacttcaatgcagaaaggcagtatctacatgagattatgaaattgcggttgctttttgtgttcactgaaaaaaataagtaaaactgtaactttcagaaaaaatgattgtacatatagaaaacccaaagcatctaaacaattaaaataaataagtatagaaagattactggatacagagtcaacatacaaatatcaattgtatgtctatataccagcaacgattcaaaaatgatttttataatagcattaaaaattagacgcttagtaataaatgtgagaaagatgtgcaagaactctacataaaaaattatgagacgttattgagaaaaattaaggaaaacctaaataaatgaatgaataggcaatgtttatcaattaaaggatacaatatagtaaatatatcaaatgtttactaatggattcaatgcaataccaaagtgcccagcaggctttttttggtggtgggaggtcgggcaggattcataagctaattataaaatgcatatggaaatgcaaagagccaaggatagccaagacagttttgaggaagaataaacttgtactacttacactaccagatgtcaagacttattatcgagttacatttattaagacagtgtggtactgacacaaggatagacaaatagatcagtgaaacacactagagtgctcagaagcacacctgtacatatataaaggcttgatttatgatagaggtgccagtgcagtagagaaggaaattattggtgttttcaataaaaagtgataggtcaattagatattcatatggcatgaagtatgaaacaataacaatttatattcataacttgcagaaagcaaaaatttcttaaaatacaaaaagtgatcaccataaaggaaaagattgataaactggactatattaaaactaaggactcctgttcagcaaaagacactacttcgactgaaaagacaagtcacagagtgagacaagatatctgcaatacagatacctaataactgaaccccatacagtgatggtgggaatttaagttcgtacaatcattttagaaaattgcttggcagtatctactagatctgaacatgtgatccagtaattacactcataattataagccagtaaaaaggcatgtttatgtcaccaaaagatatatacaagaatgttcattacactattatacataagagccaaaaactggaaacaaaccaaatatccattaacagtagaatgaataaataaaagctgtaatagtaatacagtggaatactacacagcaatgtaaatgaactactgctgtacaaaacaacatggtttaatctcacagacaaaatgttaaatgaaagacacagacgagtacatattgcgaacttctgtttataattcaagaactggcaagaactgtttactgtgttagaagtccaggtaatggtaacctataaaaaggaaaaagggtggaatgattgggagggggcatcttctggggtattgataatgtgctatgtattggtcagtttagtgtttaaacaggctcatttactttgtgaaaacttacactaaaattgtgtgtattttttgaatatatgttatacattaataaatagggtttttaaacctgtagttcataatttagtgaaagtagaatatccaaacatttagttttaaaccaatcaattatagtgctaccatcatttttatgcattattgagaagtttattttacctttctttccactcttatttcaaggctccaaaatttctctccccaacgtatattgggggcaacatgaatgcccccaatgtatatttgacccatacatgagtcagtagttccatgtactttttagaaatgcatgttaaatgatgctgttactgtctattttgcttcttttagatgtaacatgtaacattaagaatggcagatgcgagcagttttgtaaaaatagtgctgataacaaggtggtttgctcctgtactgagggatatcgacttgcagaaaaccagaagtcctgtgaaccagcaggtcataatctgaataagattttttaaagaaaatctgtatctgaaacttcagcattttaacaaacctacataattttaattcctacttgaatctgcttccttttgaaatcatagaaaatatcagtagcttgaattagaccaattaattttctagattgcatcatattttaaatataaactatgtaatcatctacaacctgaattctttctgtgtccaatttgtccaatttttttctctaacatttatatcacaaagcaattaatttgtgtgatttctgcatatgtatttgtaattcatcaagtcaaatcaatgtagtaatactatatcataaaatatacacaaataattgagtgataggcttctagtataaggacggtaagtttgaagcatgattctatctgggctggctagtttactctgagaaagttattttttattgttgggtcttaagctgagtttacacacttggtgtcagaatgattccggcaatgaactgttttatgttctgctaggctgatcagcacaatctatatggctgtgaacaaaacaatgtttcccagtcatgccaaccatgccaccattttaacagctgattagtgtattcagaacatctccactccatgttcgtatggctgttatctaaagatgaaagcagtagacacttttattttttgaaaaatttaggctctgcagggtcaattatatttgataaatgaggggcttttttgaagcaaactagatataatttcttttgcatttctaaagcctgatatcttattaattggtacattaaattgtgcaccatttctctgtaactgtttcagtacctgtctcagcactataccaggcagaagaaattaaagaaagaaccagtgccgagatcagcttggtcagggagaccctaatcctgcggcactagaggaattaaagacacacacacagaaatatagagtatggagtgggaaatcaggggtctcacagccttcagagctgagagccccgaacagagatttacccacatatttattgacagcaagccagtcataagatttactgaaagtattccttatgggaaataaagggatgagtctggctagttatctgcagcaggaacatgtccttaaggcacaaatcacttatgcaattgtctgtggtttaagaacacctttaagcagttttccgccctgggtgggccaggtgttccttgccctcattctggtaaacccacaaccttccagtgtggatatcaaggccatcacgagcatatcacagtgctgcagagattttgtttatggccagttttggggccagtttatggccagatttggaggcctgttcccaacaaaccagaagctaggaatatatatcctgcaaataaaatgaagaatctctaaggcttcagggcctgcccacttgttcttctgcctggttcttcacatacactgtctcaaagctagtctaccttgagaggagcatgaatatgtgtgtgggtgtgtgtctgtgtattttaaccttaaaaacctaacttccagtatagacagatggcatactagctaaacccttacaagttcttctatgctataaaagagaaacagaattgagaaccacctccaactattaagtgttatatttgaatatagccttagctttagcagaataagtaggccaaacttaaaataagcttttctgccttttcaatgataaaggtcccttttctgtagccattgttgattgtgtacacttatacataagtattttgaactaatttcctgttttctcaaccacttgctgtcttcatgatactttgtcgcagctggttgctatagaaatgtctgttacaaggaatgtggcttgaaggaaagtgataaatgaaaatgaaatgtgaagtgactttgtttgactacaaattcccattctggtagtccccagtgtatcaatacattatttttctttagaaaataaaccaacccaaggaaaaatggtgggcaggtcctggtgaatatggctgtgataattatattagcaatctctttggctaatatttgaagcccaaataattgaatcacaatgatctctccccagaaaatatataaaatgcaccttggaatctagaaggccttttagtctgcaaaagaaaccttcttaatcataagcagcagaagtcccatttaccaaattggaaagttaaagttacaaagcatcaatcataagacttccattcagggatggcaattgggagtaagactttttagtaaagaaactaaacacaaagtcattagactctgtaaaagtcttaccaaatttgattctggaacacctattctatttccgtaaagatgatgaattccggagccaaatgttcttttcatgaaggatttgaaaactgtccatgaaaataacgcaatcaaccttttagcttgagactctattcactgattagatttttttaaatactgatgggcctgcttctcagaagtgacaaggatgggcctcaatctcaatttttgtaatacatgttccatttgccaatgagaaatatcaggttactaatttttcttctatttttctagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggtactttatactgatggtgtgtcaaaactggagctcagctggcaagacacaggccaggtgggagactgaggctattttactagacagacctattgggatgtgagaagtatttaggcaagtttcagcactaaccaatgtgagaaggcctccagagatgagcagttggtgaaagagaggctcaaaaccagctaccatacaggtcaagaagaatttggcattaaggaaacagcatagcaggattccagacaggcaactggtcaacaacatgaaggtctggaagaaaggtcgcaggtactcaggttcagggcactacttcagcttcagcccttgcaaaaactggtgagagttggaaagtctttaggctaagaaaaattggattatttaaaagggggtaaagaaagggactcaaggaggaaggattaaggcaagaactaggttccaagaaacagggcatgagagagagtcttgatctaccactatagttctcgtggtagcatcagaatcacctgggaacgtagaaatgcaaattctcctgctctacactagacctaccaaatcagaatatctagggggtggggcccagcagtctgtgcgcaaacaagcactgcaggtgattttgatgcacattatagtttgaaaactaggccaggtgcagtggctcatgccaataatcccagcactttgggagactgagacgggaggattgcttaaacccaggagtttgagaccagcctgggcaacacggcgaaaccccacctctaattaaaaaaaatacaaaaattagctaggtgtgatggctcccacctgtgctcccagctattcaggaggctgaggtgggagaatcacctgagcctggaaagtcgaggctgcagtgaattgtgatcacaccactgcacttcagcctgagtgacagagtaagaccctatctcaaaaaacagaaaaagaaaaacactggcccaaaggaaatgaacttgttacagaagccggggttcaaaacaccaaataatgcacttgtacctagtccttcccgggtgctctgcagacatttctccaagcgtagtctgcaaacaacctacatatgtagaattacctatgcacatttttcatttaacaaccaagagctacatttgtagcaaaatctgggttgtaacttagcctacagctgaagcctaagagattccgtctgtgagaagaaataacccacctctttggcccccctccccaggcaggaagccaggatggtccttatataaagttgtgctgtccaataggtaaccactagccacatatggctatttaaatttaaattaactacaattaagagaaattaaaaattcaattcctcaattgcacctgccaaattttaagcacataacaaccacatgtggctagtaactactgtattggagagtgcaagcggagatagaacactctattactgcagaaatttctattggatagcacttataatagtttagtgtaacttaaaactccctagttgccacagtcatgatttagtagtaatttcatggatttctctactgaggttagaatctctgccattagagactgataaatttaaagtttgcaattatcaaactggtgacaatttaagccagaatcaggtaaatgtcctcagttttaacagcattggaattttctgggactagctgtgtatctatccaggattcttgagaatgcctgccatttttcaacataatggatgtaaggtattacacatatacctggggatggggtggtaggtataattgcacaagcattgtggagaatggtatcaaagagtggcagaacatcacaatcaaggttttccctttcttttacctttgctttttaaaaagacaatatttgctggacctgatcttataactcataaatgggacactgtatgttcctttttacctcctctgtttctacttaattgcaccctatgaggactgcttcccttacctaccataaccccttccttcactcatccatatctttactcttcttcacaactctgtaatattgaccttctttatgaacctttcctggaacaatccctcttaagtgcaagcactgttattatgccttcaatgtatttaatatccatgtatctattctctctaattttgtcattttgtgttctcatgtattttcattcattatgtgtccaacttccatggataacatggttacaacaaaagatcctactttatgacaattatcttccttgggtttgtgggacatagaacagtgctcagagtaggggatccaagaacccaggagaatatattagctaagaagataacttccgtttttaaaagtccaagattcaggagatcaaaaccatcctggctaacatagtgaaaccccgtctcttccaaaaatacaaaaaattagcccggcgtggtggcaggcgcctatagtcccagctacacgggaggctgaggcaggagaatggcgtgaaccggggaggcggagctggcagtgagccgagatcccgccactgcactccagcctgggcgacagagcgagactccgtctcaaaaaaaaaaaaaaaaaaaaagtccaagattaaaaaaaaaaaaaaaaaaggatgtctgctttgtgagtttagcattgtctccttgtcattccagaaatgaaatggcaaatacatttaaatcagaactaaaaaggggaacagggtataaaggctcaatttagtcacatcatttccgtttctcacccaccccctttaaaccagatgtttgccaatgcattaacaatgcagatgtttcctgaaagaaagtttagtaactcaagcagacaccttattttcttttcaagcagaaaagactatgagatggtggttgtggttgttccgggagggagaagatataaatgatacacattatttcaaatcatttcatgacctcactgcacacttatagttattgtacctgttgtctttttgctgtcaagcctagctaagatcatttggaatgttcaagatcactcatacatgcatgtgcacacatacacatgcacatatgttcactccctatttcatccacatgaactaagattactgatgtgtacagattcaaagcacttttattcttttccaaaggcaagaagctgagctactttccagaatagttgtgaaagaccctgtcatacttctgcattgtttcctccacaccacctccatccagttccttatgaatggttactggttttcaaaaatatgagataaattgagtgtataaaagtcatttttagacaaaatgaaacaggaaatgaaagaaaccagaatctctcctcatttgtggatgggccagctccaccatgtcatggttaatctgcagggaggaaatactagatttgattgcagatcagactgcagcaaacctgctgtgactaaggcatcaagagaaagcaagcaacagctggggcttcagtggtgaaaacattatatatctagctttgaaatatgaaatactgtttagcagtgtcacctagaaaagagtgtttcaaaatgctgatgcttcataagaacctttctcttcagagttgtttcttttatctttcaaattagccagggtgggaaataaagtgatcacttggtgaagaaatctcacaaagaagaacatagagagttcactttcatctggagtaatgaacagattgaacaaactagaaatggttagtctgttaaagaaaaggtgtaggtgagctgtttgcaagagccacaagggaaaggggaagacaacttctttgtggacttaagggtgaaagttgcaagcaggcaagacgattctgacctccattaagaaagccctttccaaccaacaaccactgggttggttacgcaggttgggcagcattgggagcaaatgttgattgaacaaatgtttgtcggaattgttgacttaaagagctgttctgtcactggggacagcagcggctagatagccccattcagggagagggcatttgttcacctggccagagatcagagcaggctaagggactgctgggatcctgtccagctttgagaccctacagagccatgttcacctagcacgtatcccgtctgcggtcacgctcatttcttaccttattccagggctttcacctcagcttgccaggctggagccaagggccaacgcagccgcgccttgttcgcgatggtagcttcccaggagccccctatggttccggaacggcgctgccggccccatcctgtttgctacctcctaaagccaaaggcactggcgggccgggccagcttctaaagtcgcgcaaggttagaaggttccggacaggaacggcgtgaggccaatggaaggaggtacttcagtttccctccagatgcccagcgatgggctcagagctccttgagaactcgggaaaggaagcagggtctctgaagaaatacttcaggagtagaaagaggaagctagagggttaaatgcactacacaggaacagaaatgagtttttcttagagttagtatatgtctagaggtgtagtaaactaaaacaagtcttgaattgcataccgccacgtagggaagaaatgaaaacctttgaatattagtgaaaaaagggaaactgcaacgcctgtattactagatagctttcatcaacagctcaaaaccgacagatttaaagaagcaacaccgcattttggctttctaaagctttaatttggtttggatcccatgcccatgaccctgccagctgacaattctaagcatgcgcaaactggccccaaaaattcctcccacatttccgaagaactatttggccctttatgtgaagtacctggtttttccattttctgttttaccataggcctcagttcggtgtgtggcgtatttattctacatttaacaatttgaagatcattctattagattaaaaaaaaagaatacaatggaagccaagtgattaagctttccttatgcttatattaagttgtagcatatgcatttaccgatagttaaccgtattaacctacagaaaatgtccagggaaatggtctatttcttattctatttttgacctaaagaaaatctttaaaatgtcttagcattttccccagtctccatccactttcctcagctttggcctgaagctatctttaaaggtaccctgtacagctcttgccctgtacagctagctacagagattcaatcctttctgttcgattaggacacatctcagtggcagataacatgcaaagttattatatgtatgaaccagaacttgtttttccttaggggccaggatgttacactaaggtcttaagactatagtaatatcttcacttgaaaaagccctctattattcctatctcagatgataaaaattcaattaagagaaataagaacgtgacatgtgtaatcgcacctggctctacaaagctagtctggacagacatttaaacaattatcctctaagattatttgatgaaatgcatttcaatgactagttaaccattaaaaaccaaagtgagcatcccatctgttcccagtcaaatgacctagagcaaaggactaggcaaaccacatctgtgggcatagcaagctgtacatcacaaacaaatgaatttgctttgtatatgagtgagagcaaacactctttattgtacaacttgggtgggtaagtagggagaataatggttttactgaaatcgcaggtaacggttacgttggagttaaaggttaggaagaaaaccaaagggtaagagctgttgttctgggctggcattgtcaatgaagagcataaattcagatgtgaatgtatattttgtagaagcatgtgtgttgttggtttttgtgtatgtgtgagtctgaaagagggaaaacaggctcccattagactatgactaacaaaaatgtttgacagattataactcagatgtcttactcagagcatatgccttcccattttccccattattccccaacatgatgtctttaagaacttgtccttgaccgagcagacatctcataccccaaatagctaatattttgatagctatgatcctgaacggccaaacattccaaaaccaagtagtttgtaatatctttaaatgcaaatatattttaggccttttccttggcaaggatgtttggtcaggggttggcaaaaataatgctcttcagacttaaaagaacacaaccatatttcttagccatccaccagaaagtagtagaagctccaggaagcaagtctttgtcaggagtcagactagctacatcataatctctctgcccaggggctgtggatgtcatccatcctggcctaactagcctactgagctgagagatgtccaatttccccccaatacactaaccagaggagaaggaccgtgatatcattgcatgtgaattcttaattccaattgcttaaacaaatatgttcagttgtaactatcaataccagtatataacagtgttggccaagttttattgatgctgacaatcaattggagttacagccagacacatggtcttatgaccggcgtacttacgcagggctttgcactgagacaggtcgtgcatctgaggtttactgctttgcatttttgttttgtaactgaagtctgatgagacagccagagcatgtgctacctagggacttgaatccctgcagccccatttcacttctcaccaccttccggggtggtttctcgacctcccactcccctaccacctggtgccttagccagccctggctctccctccaaacacctgcccaatgagcactgccaccccatggtgcccagacatgctctccctcctcatccctacctagctaccattgccactcccctcccccagcggggacatgggcataggagcagggagagttaaggttggtcaggtgcacgtgccctatgctatcttggaagggggcttggccatgtggcatctctggaccaagaatgcgccacagcacatttggagggtgaatggtgggggcacaccccttgtccacctctatttcaggcatggaacacatcctggcatgaaagttgcagtcccttgggaatcacctctccaccttgattgccacagtaggccagtgacaagggaagattgacacatcatcccctgctggggcccagtgtcctgtggctggcaggcaggggatcctaaggacatgtgggtgttaaattgtagggtgcacttcctgggcacctttgagggtctgcactgccccagcaaatatccccatgctagaaggagcaaaatattaaatggcaaattttaaaaatgtaacaagatgggttgcaaaagagactacagaggaaagcaaaagttttgtattttagtatcttccatggcacttttcttcctagcttttgaacaaggggccccacatttttatttctcactgagccccacaaagtatgtagccattcctgcccggagtgaggacttttaaaacataaagattatcaagtcttggaaattctgattcagtagatatataacaggtctcaaacttaattatgtaaagaatattctggagagcttccttttacccagtcccacccaccaaatattctgataaattaagcttcgattagcccccagatctgcattttataaggatccccagatgattctactgcaattggtccacagaccatgcctggaccgaatttgggtgcttaggagcacaaattctggagccgggcagacttgagtttgcttcctagctttaccaactgatctcaggggagttaatgtttacctctaaactttagctcatgcatctataaataaatatattaatatcatgtcataaggatattatgttgtattaaatgtctttaaaacaccacaatgattagcccaaagtaaacactcaataaatgttcaaaaatttaggaaaattgttaagactgggttgtatgcacactggtgtttattatattatgtagttttttctgtatttttacaacatttcagaattaaaagcaacagctagaaaaagagggaaatggccgggtgcagtggctcacgcctgtaatcccagcactttgggaggccaaggcgggcggatcacgaggttgagagatcgagaccatcctggccaacatggtgaaaccccatctctactaaaaatacaaaaattaactgggcatggtggcatgcgcctgtagtcccaggagaattgcttgaacctgggaggcggaggttgcagtgagccaagatctcaccactgctctccagcctggtgacagggcaagactccgtcaaaaaaaaaaaagagagggagagccagagtatgaaaaaggaagtcagagccctttaatgagtcagctttgtaggtctccaggtaggaggctagtgcttcagtgtctaggacatagtaggtgttcagtaaattaaattcaggacaaaaagaacatgccccaaggaccatctgatatccacttaaagtgatggactacctcgtttcccttgtttatgaatgggttcatgcctaagactgtgtgcactttaatacaagggcagtcgttcagaactagtcaggtcctgaaaaggatttaccaaatgttgagtgtgccctctagtgttcacacttcccagctttcttcctataaaggtggatcaaggcacttgcttacaactggaactgaaatcctccaagtcgatctagacattgagatggagaaaatattcattgtcgactgtaattatgcaacgaatatccagttgagataatggacttgcctcttatctaataatacccaggctcaatgcgtcactgctttgtccactttgcccaaaattcaagcacagctaagttgatattttaggacaaaggcagcttactatccagccagaggggagtagaatatggttaagagagagtggaaagaatgaatgagccctgctattcctcactgcctggatggctataagcacagcccttatggaggccttaggtcttgcttcataatattccagtttgaaaagggtttgaaaagacctcctagaaaaatcagtagtttttctcttttgagtaacatgtagcaaaaaaaatttcatcatgtaggtacagggaacaccctaataactattaatctcaaggagtcaagccagtgtgtttcctaatgtatctgctgtatccccatgaagcaaattttgccatcagagaaactgactcatggggaaaaaatccaaggacctcaaatcaccaaaagaagccattcctcagatttgcctaagcttaagcttccctgtctctcattgtgtgttgctttcaatgcagttacataaatggcttttttgtttatgcaccaaaaacactaattcatctgcaaagctcacatttccagaaacattccatttctgccagcacctagaagccaatattttgcctattcctgtaaccagcacacatatttatttttttctagatcaaatgtattatgcagtaagagtcttaattttgttttcacaggttgttttgaatggtaaagttgatgcattctgtggaggctctatcgttaatgaaaaatggattgtaactgctgcccactgtgttgaaactggtgttaaaattacagttgtcgcaggtaaatacacagaaagaataataatctgcagcaccactagctctttaatatgattggtacaccatattttactaaggtctaataaaattgttgttgaataaattgggctaaaggcagaagggtcataatttcagaacccacgtcgcaccgtcctccaagcatccatagttcttttgatatacccctattatcactcatttcagtgaggtacaattagttcttgatgtagccatttccataccagaaggccttcccaaaaatcagtgtcatgtcaccgatccttttatctctggtgcttggcacaacctgtagcaggtcctcagaaaacaaacatttgaattaatggccaaatgagtttgtgctcaaaaaaggggtgaggatacttgaaatttggaaaatctaggataattcatgactagtggattcattatcaccaatgaaaggcttataacagcatgagtgaacagaaccatctctatgatagtcctgaatggctttttggtctgaaaaatatgcattggctctcattacatttaaccaaaattatcacaatataagaatgagatctttaacattgccaattaggtcagtggtcccaagtagtcacttagaaaatctgtgtatgtgaaatactgtttgtgacttaaaatgaaatttatttttaataggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccgtagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 1697 - DNA, 25255 bp, Homo sapiens
  source 1..25255: mol_type = genomic DNA
cctacccgcgcgcaggccaagttgctgaatcaatggagccctccccaacccgggcgttccccagcgaggcttccttcccatcctcctgaccaccggggcttttcgtgagctcgtctctgatctcgcgcaagagtgacacacaggtgttcaaagacgcttctggggagtgagggaagcggtttacgagtgacttggctggagcctcaggggcgggcactggcacggaacacaccctgaggccagccctggctgcccaggcggagctgcctcttctcccgcgggttggtggacccgctcagtacggagttggggaagctctttcacttcggaggattgctcaacaaccatgctgggcatctggaccctcctacctctggtgagccctctcctgcccgggtggaggcttaccccgtcttagtcccggggataggcaaagtggggcgggcgcgggacgcgtgcgggattgcggcggcagcggcgcacgcgggcacctgggagcggcgggctgctgcgggaggcgttggagactggctcccgggggctgttaggaccttccctcaggcccgggtgctcagaacgctggaggacttgcttttcttgggccttgatgcgaagtgctgaccccgctgggcaggcggggcagctccggcgctcctcggagaccactgcgctccacgttgaggtgggcgtggggtgcggacaggaattgaagcggaagtctgggaagctttagggtcgctggagggggaccccggttggagagaggagcggaactcctggacaagccctgacaagccaagccaaaggtccgctccggcgcgggtgggtgagtgcgcgccgccccgcgggggcggggagagagcctgcagccttcagaacagatattgctcattttctggcagttctcagacgtaggaaataagtcagcaccgaagcagtggttaagccggagggctcggaagaacggcaccttttctttctcgaaaaagttatatgggggctgaatgagcttctggaggcttgtttaccgttttttattgtcacacagaaaaagaaactgccttgtctcccttccgggaattctctctttaagactgtaagtcgctgcctgagtggtttcattttgttttgtttttctgcccttctctttcttcttttgccctttcttagcttgcactcccatggtgatttctgcttggtctcctgctggggttggtggtactcgttcccaccgcacagaacccggcgcctattattggccaagaaacttgagcagcctgttttgaaaagtccctcgctcagaaatgccagcttgcagatggctaatcaaagagacgtggatccaggaggctcatttgagtaccggagcctctgagagtccatggatttttattttattgggccccaacaaagtgccaggcatagcgagagaagtgtttacaaatgtgatctccgcggattctcacgagagccatgtagtggggaagataaccacatccccattttacagatggcgaaatgaggttcagagagcttcagtaattcagccaagatcacacagctagtaaatgggagatatgggattgaactcagatctaattccaaaactcaggctgttcgctgattgcatctgatatccagattacaccaagaggctgagatgtctgggtccattttatgattagaaaaaaaaatcctgttcctttcagaaatagtgtgcactatttgggattctttagaaacttccttggagaaaattaatgattcaagattgagaaaacatttatacaacctcaggccacactcttctctctcttgttattaaccattgcaccactgcaatgttggctgctttgaaaatctcatagtttttggacagcagtattagtaaagtgtaagaaaattgtcaaagcttggagctatgcttgttgaacttttgtaccaatagcacctttaccagaggctgcgtgtttaaagcccgaagaaaactttgcttttctgaaagaatacacacacacacgcatatgtaaatattcatacatttatgtatatatacatattataatacctataagttaggtataacttatatttgtatatgatatatggcctaggaaattaaggcttattaaataaaatttataaatgcagatgagtcaaatacaaagatcagacataactctatcacctaagtaatcattgtttacgttttgcagtttatcttccatttctcccctctaatatgactcttttaaatttagttacacagaaattggttttgcgctcacgacatgcctaacatcaggcctttatccttaaagaagtttcaacactcttgtgtcacctcatgtgtctacagaaaatgtttgcttttatgccttcacggttatgttttcttagtagtagcaataaataaaatagatgcaaagtgctaattacttggaatacagaagcaaattttaattctattaatgggctggacatagatgggtggggagctgttttctgcttttcccctcttcccctagtcctctgactctggtgataactatagtcaacaagtatccccatccttaaccccttttgcttctctttctctttccttctctcaaccttcctggtgttagttttctctttcctatttctgagtgtttttactccgacacttacaataaaaaagtttgaaatcccaaaaagttgacaaatttctaaaggagacagaaaaagagtcaaacttactttacaaattaatttgagaaatagctgtgggttgcattttttttttttattgtgcatgaccctgttattggccaagaaacttgagcagcctgttttggaaagtccctcgctcagaaatgccagcttgctaattgaagggatgtggatccatgaggctcatttgaattccgaagcctctaagagtccatggatttttattttattgggccccaacaggttttgtcttgcattatttaggacattggccaggcaatcactggacagccagtttgctctcctttacattttgtagaatggttatcttatggtcaaaggaaagggagagggcctttggaaaataaagctgtgtatttacaagcagtcatacagaatagttttgtggggaaaataaagaacagttatttaatttgtaatttaatcatttttcttaaaccaacccaaagagcataaaatggaatatttatttatttttgtagcttaatttgtaatttaataatttttcttaagccaacctaacgaacatattgggctgtttattttcatttttaatgggccatatttacatcacaaaggacttgagaagtcttacaaatacaataaaatgataaaatatgaattaagacattagcaaccaggatggaaaaacacaaatttgtaaatgatggccaggtttgcaagcaaaaattaaattgataaatggcagcacccccactaccagctatagttagactgatgaaaaatcctctaatgttcatgcctgaaatacagttaccacccttagcagcaaattagaggcaaagaagttctggaatttggacgttgtctctgagtaagctctttgagacactggacaagtaatttccttctgaatactcttatactgacacataggagaagtgtcagtgtttcaaaggaatctctttgaaggctactacattgctttaggggtgccagattaccagagtaaactgccagtttgagagaataactgtttcttaagagatggtctgaaacctaagtaaggaaatccccccacttgaaagcccctaggaagttaattgcttttggcaaattatcttgggccccaaaagtcccttgatgagcacatgttttgtaataggtactaaagactatttacttatgatgaaaaataaaataacacaatttaaaacttgaaattgataaaaagcaacttgaaaccaaatttaggacagtgaacccatccctttcttatttttaaataggtaaatatagaaaaaatgaccacatgatgtgaaacaaaaagcaaatatttaaaaactacatttatactttatctcaccacactaatgtaaagaattttgattttacttataaattcttagccttgtctacacatatacataattgcatgtttaatttgagctatatatagtctgttttttgttcctttgcatgttacacaaacctttttctatttctacataatttttatctcatattttttattggatacattatagagagagcatttattaaatgagctgggattactataatttttattatttattttttaatttattacttatttttataatttactattgaaaaaaagcatttcttaaatgtactgggatacatatatatatatgactttttcttgttactaaaaaattactcatagaacttacatattaaaattttaggacttgtgatgaaaaataataaaataattcaaaacgataaaaagcaacataattttatatgttgtaccttgtacttccttataaggtacaacactacaatagccttagtgtgtagttttctttttgctatgtatgtatatatatattcataaaagtggaaaaataacatttaataaatcctctttattttctggaaaatccttgctttaaaaaaagtctttagctttttatatagttctacttctaacaccaattaaatatcttcaattcagtctcaagcaggaacaaatcttcagtccacttgcctacctttactgtctttgaagtgacagtgtgagtagtaaagcccaaatcagagagaaattgacttttgtaagattggtaacttcaccttccccggaaggaaatgaggtggttcttccctttgatcacaactgctttcttgatttgaaataaactgttgtacagcccagtcaccccatctttagacatttagaaatggcaatcatagttatataggacaactagcctgagtcccactaagtagaaatgatagtgaatttagtataagattatacctttaggctgggcaggtgactcacacctgtcacccagcacttcaggaggccaaggtgggtggatcatggatcacttgagattaggagtttgagaccagcctggccaacatggcaaaaacccaactctactgaaaatacacaaattagctgggtgtggtggcgtgcctgttatctcagctactcgggaggtcgcggcaggagaatcactggaacctgggaggtggaagttgcagtgagccaagatcatgccactgcactccaggctgggcgacagagtgagactccgtctacaaagaaaacaaagaaacaaaaaatcatacctttagagcaaggccagccttgtgaattagcaaatctgactacaaattcaatcagcagatgtactcagcccagcaaagtgagcaagcttactataggttgtgttaaggcatggactgggataaactggcaaaattagagtaaatttgacaatttgacattggattcattaatgatagcctgtccttcaatgaagtcaggcagcattgtgtttctattcacctctgtgttttgtgaggctataaaaatataagatatgagaaatgtgaatactttttatttgtgagggcagatatcttgaaaaagagagcgagaggaagtcagagtatgcgggtgaagactcttgtttttttgctgaggatttagctttggtttttagccattctcacagagatcattggtcctaattaactggttgttgttgttttttttcatgtgaatgtctgtaaggtttcaggcttgattttaaaaattgggcctatactcacagaaagacaaatactgcatgatctcgtttatatgtggaatctaaaagttttgaatccataaaagtagagagtagaatagtggttaccagaggctagttgggggcaaagttgggggatttagggagatattggtcaaaggatacaaaatttcagttaggaggaataagttcaagagatctagtgtacaacttgatgtctatagctaataacaatgtattgtatacttgaaaattactaagagtagattttaagtgttctcgccacacacacacaaaagaaaatgataagtatgtgaaggaatgcccaatgtaattagctcgatttagctaattatcttccaaaatatgtacataattatcttccaaaatatgtacataattcaagacatcatgttatataccataaatatatataatttttttatttgtcgaataaaaataatacaaaaaaaccctgggcctatactgcccacaggtagtggccacaggcagagctggtcccaagcccctccctctctctgtagtcccttatcccaggttgctttattcttgtatgacccacgtggcccctctgggcttgtaagggctctggggctgtattttaggactctatagcccttacattacccatttcctctaccaaaggtcatttctcttatcttcaagcttatttttggaagggtcattatttcttcatgagaagtcaaattctgatttgcaagtgctgaacacagatgccattagtctataaaactcttatattctcacatgtaaatgtagtaacctgctaacctcagattctgcttcctctaacctagttgccctgcaactgtgatgaacctcaaaatcaccaagggtacttccccattctcagagatcctgattccttaggtctatgtaggggccttagcactttttattaaataatgcatcactacaggattctgatgtctgtcggggtcttgagaactatttttctgactctagcactaaactcaaaatgtaatttcagatggaatttcctaggctcattcattttattttatttatggcttggccagtcatggatctaatcagtaacttgcaactgttgcttcaactacctctgtcctggactttccagagattggctttaagaaagaaagaggacatccctgggataagattaccatgtgtatttttatgtacagattttgaaaaacatacaaatgaatgggatctttgcttatctcttccatgtagaaaaatttattttacttctatttcaggttttcaataatgtagtaggacaagatgacatcactatatccctgttttttacacagatatattagagatgcattatcttattggaaattttaaactattcaataataaactattagtcttttagaatttctttttcctcaagtgttgataagtaactgaaagtctacaagcagacaagcagaattagtcggtggaacttcatttcttgctccatttttgtcctcagcagtagagggtggtgagatttcaacccagcctagcaggaccaataagtctggaaagaagtagctctagttcatattggcacctgctaattctagttctgaagaccatgggaaatctcttgcctatttagctcagtgatcatccaagatgggaaattcttgggctcagctgtgagggatcccaagtttatatgtaacactaatgtctcacaaatcaagaatccaagagaatcaagagactatagttcattccttatattaaattcttaggactgccaactgggtggctacagttttgggggctagaagtctgatatcaaggtgccaactggactggttccttctgaggaccacgagggcaggatctgttcaggcttgtagatggccttcttttccatgtgtcttcacattatcttcctctgtttgtatgtgtgtccaaatttcctcttctttttttttaatttagaaatttatactgtctacaagctttatatagctttagttaaaaaaaagcaaaaaaaaaaaaaaatcaaaacaaaaacagtgaagccaagacactcttccaaagtctggacccttccggccttccaaatacaagagctctggaagttgtatataccaaatttcctcttcttaaaatgtcaccagtcacattggattaaggcttaccctattaacaccattttaacttaatcacctctgtaaagaccctatctcctgatacagtcacattcggatgctcaggaagttagggtatcagtatcactatatgaatttgggagttgggggaggacacagtttagcccatgacagtcctgaatctcctttgctagatgcatgactgtgggccagtcacttcaccagttgggatactgccatctctatcagaaaaggggtttgggctaggtcatctataaagtcctttctgctctaaattgtaaatataatgagataccaacatttagtttaattgtttaaaattttagaagctaactggatgctttgctggtgtcaacactcccctttacaaaaaaaaattcggccgggcatggtggctcacgcctgtaatcccaacactttgggaggccgaggcaggcggatcacggggtcgagagattgagaccatctggccaacatggtgaaaccccgtctctactaaaaacacaaaaattagctgggcctggtggtgcacatctgtagtcccagctactcgggaagctgaggcaggagagtcacttgaacccgggaggcggagcttgcagtgagccgagatcgcgccactgcacctccagcctggcaacagagcgagactccgtctcaaaaaaataaataaataaataaaataaaataaaataaaataaaatctcactttctgtttctactgttctctcaagtacccctctgccttctgttacttctttgctgcattctgagaggaatggggtggggagcactctttcctgtagaaccccataacccatctattttcatcaatttatttgaaattcaaagccaggggttaaaatgtccactttcaatttgagatgtctaactttcagataaatctattaacatgcatttctaagtgacttttaagctaagcattttattttattgagctcgtatggaagggtaactattatacttgtataataaagtgcactttcaaaaatactcggttcaaatgtaaaataatattcgtaatattttaagacaaacctcctagaacttatatgtgtctttcttcccagagcagtctctatgggtgcctaaacaatactgcattattagatttttttcagtttataagccacacaagaaagttaacccatgtcatctctagaggcataaaaatagacagttgttctgagaaacatatctgtttattcctagttcagtaacagcgcaatgagatcctaaattatgaggtactttttgtttatcttattgtctcattggcaaccagcaactcctgttgcatttttgacatgggaatctatcagggtgtggttaataaagtacatttccatggtaagtattctttaagaaaaaataaaccaagatttcatcagagacagaaattactgcaaactgtacttaccagtttctggtgatttgtataactgagctttcaatttcaaaaattaaaaagttctctttagtgtaacatatttttgtgtccagtaattttacttcaaaaataaaagagaattttctttaccatcaaacaacgttgctgtaatgagtggtgatatatttagtcctagaggaccaaagagaaataaaatggctttgattatgctggtttaagaaaatatatccgatgaaacagaggttaatatttgtgatgtttgatttagtaaaattataagactaccaaagaaaactagaagagcaaaataaccaaaatttatataaagaattcaatgttgataattcaaaggtttagaattttttccacctttcaaatactaagttgctgttatagatttactaccattattacccagattttctattttactaaaaaataataacacagttcgttatgataaatcagtatagatctttaggctcaacacaaccctgctaccttttaaacttttttattatacaacaaacacatatgcattatcaagaaaagatgagtttagcaaaatgaagaaaaatagtcttatcaactagaaataagcaccattaaaatttctgtgtgttaaaagataatatgctgctgaaactttttttttcttgaaatgtccctcttttctttcacttttcattttcttaatccctaaccttctactgttgaattttctggaccaccgttataccccctcatcaatagggcatttttttctgcagtagctgagcacaatggtcatattgaagaaattcccttgtgggggctttgcctagaggtaaaatcctcttggccgggtgcgttggctcatgcctgtaatcccagcactttgggaagctgaggcgggagcatcttctgaggtcaggagtttgagattagcctggccaacgtggtgaaatgccgtctctactaaaaatacaaaaaattagccgtcatagtgtgcattcctgtaatcccacctactcgggaggctgaggcaggagaattgcttgaatgccggaggcagaggttgtagtgagccaagatctagattgtgccactgtgctccagcctgggtgacagagcaagactccgtctaaaacaaaacaaaacaaaacaacaacaacaaaaacaaagtaaaaccctcttcactgtgatgactctaaagcttgcttttgtctctctaaatcacaacaaaccgtttgcagtgtgatgctgtgctcaaaattgagaattctcactgactgttccaggcatctgtctactcattcttgccatgctgagggctgtcatttctcaccactgaatgcctttttttttttttttgtgcttctttttaaaagtcttttcctgtttgctttgaacttcaataaaaacagggggtaagaaggtaatatgcttttattttgtctgtggggtttttttcttccttcttttggttccttttcagatcctagctcatcaaggccatttgccacactgacactggaataagcctgaatgggggtctatatttcttccagtagttagtttaattcggtcattgagctgttgctctatttgtaaccgtcatgctagatccgagggctgactattcctgagaaagtgtggagatcctttcagactgccatggtgctagggcagagtttcagtcattatcttctgtgtctgctaattcttgcatcatttcttctactctgtaacctggttggctatgaaaagtgattcttcctcactgatgctgcaggcaatgggtgaatatccaattgttctctcaggttcttgtcatcggatacaaagaacaaatttcatgtgtccctgtttctgagaggttcaaagggagcaaatgcacagattctagcttaggatgacttccagcttctaactatttgtctgtgcattccatttcctcacccctgcgagaggttgcagtcatggtaacggctgttctgagaaattcagtgcccaaactggagggaggggaacacaaactcagcttcttcccaagcttcagggcagggctggcaagttttgccttccccgccagcaagagccctggctttaggggtcttgctacagttttcccagactggaggtcttggggctggattctggttcttagcgaattcttgccaaacacctcccctttccccagtatccatttgttttgaaggttctttgcaggcttcttgccaataattgtcttaaaacaaatggagttgtttgcatacctagatggagtaaaatatttaggaaactattctacaaatatgaaacagcccagatttgggccagaagtcctggtcctgagtctcttgttagccactcttaactgtgaattattggacaaatcatttctcgcactctgtgtaatctgtcacctgggtacttgatgatttaaaccaggaattgtggcccttctcataatactgtctcctaaatattgggtgaatttagtatatcaaggagggcagggcactatacccgtaggggactctctctctccctctgtctctttgcctttctcagatatgcatctttggtggcagacctggggttcaaaccacagttgttttgaaatttctctttccttctccactatgctccccctcactgaaactttaataataaaagtagcacacttattgggcatgtatttgttatgtgccaggttctgtgctaacagctttaagtgcattattccacgtattttcacaacaagcctgtgaggaagaggttatttccacttatagataaagaaactgagacttggagaatgtaagtgattttacccacaaacacagggcagtaagtgggaggccctgttcaccttagaacacctggcttctatcattcatggtgctgtttctagtgtggtttgaagaacctgagatccaaactgctatacaagtgacctgctgctttcttggagagagaaatctgaaagacagtggagccctcacattgtctttgcctgtgcacagcagatactgccaattttgggtgggttacacttgtttaccacgttgcttacttcagaaatcaataaaattctcttcatgcttttattttacaggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtatgttacacaaaacatccagagattacagtgaaagtcacagttaggagtagcacatagtaatcatgactataataattttacagtttttggttcccctatattatataacataactgagagaaaaacaactatgaaattattttccaaagatgagttttatttatatttatcacgcttatttgatgtggttatggataaatttaatttacaagtgacatgcacctctgaaatgagaagactggtctatttggctccatttttttctaagcaaaaatgactcatttgtgaatatgaaagcttatcatgtcaaaactgattaggatctaccataacaatagtggaactctgaaagcaagagacttctcctcttaagggatatgtctcagcacttcccttcaatcagaaggtctctaagaaagctgtcctggcactgaagcctgcaaaatatatttgcattttgcagctgaataactagacgaataagaaaagcaacaggcagaaaccaacagcttttttttttaaatcaatactttgaagggcaaactaatttcagatcacaaatccttcaaacactggtaaattagaagctaagcaaaatgcaattgtgcaaacatttcttcaactttgagtagagttgaaaaaaggaaaatagcacatgggttcatgtgatagattaatagaacaaaaaaggactgtagtatgtttcatggttgtcctcccaggcttccagcactcaagctgtaaaacaggatgggtcctgtttgtgaaaagattctaccagtctccctgtgcttcatgtccagattttaataaccgttatggaaaaatctcccctataacccaacccatttatacttaaacccatttacacttaaatcttctccaacacgaataaagaatggcgtcctggctttattataacctgctaaacacaatcaatttgctctatgaattgaaatctttgttcataattttaaaacctaaaatgtaaattaaaatgaacaaaatatgctttgcacatcaaactgtcaaggatttttgtctattgctttttcggttttgctttgttttattttaatttaagaagtgaatgtaaattgttacaaacttttaagaaatacatttggatatatgagtcaaaaatttgaaaaaaaattttttttaacttttttttcttattattatactttaagttttagggtacacatgcacaatctgcaggttagttacatatgtatacatgtgccatgctggtgcactgcacccactaactcgtcatctagcattaggtatatctcccaatgctatccctcccccctccccccaacccactgtttatacttgctaagatagcaattaatttatacgaaaataccctgagaaaataatcaaaaataaaggaaaatattgtacacatgatatttcattatcaatatgatgtaggattccttaggtaaattctggaatatttaaagactgaaatagtatgtatcaaagtcatgttttctgatatatttctaatataatcctcaattatataaaccttcttaagtaatttccaactgatctggctggattaactgattctccctgatccgtctataaaatatcctggatggcatccaaccatgttaaatactcttcccacttcaattccctcttgttgaattttaggcttatcaatatctaagttgcttccaaatctgtttatgctcattagtgttgtgatattcatatgtaatttgattgaatattgcataaattaatgaaatacaaatacagagaaaagacagattttatttctaagaaaactaggttgagtgctttggagaattcaataaagatgagctgctaaaatgttgttgatgaattttgtgagggaaaaataaaagttaagtagtaggaaaaatcacaaaaatctctaaagccattcatagagattattggtatgtttatgttttcctttcatcaaaaacgaagggagggagggagggagggagggaggagaaaaaaagaaagaaatgaaaaaggaagagaaaaatagacaaacaggaaattataggtgatgcattatggatgtgacttaagaaagaacctgggattataataacttctatatcacaaaattgtcaaatgattatatagttatattttataaattaaaacaaaatatttacagtatttttaagtgatttcctatgtaaattgacatttttgattaaatgatcaaagaagtcctccccacatcatcatattcaataagaaggattctatggtatactgcacacatatttcatatatacacattgtacatatatatatatacacacctgttatatatatgctcatgcatatacatgtatgtatgtattatatgcataggaatgcaacaaaataacggcaatatctccagattgttgatatatagttttttgtttgtttgtttgtctgtttttttgagatggagtctcactctgtagtccaggctgaagtgcagtggcatgatctcagctcactgcaacctctgccttctgggttcaagcaattctgcagcctcagcctcccaagtagctgggactacaggagcacaccacaacaccgggataattttttgtgtttttaatagaggcggggtttcaccatgttggtcagtctggtctcaaactcctgacctcaggtgatctgcctgccttggcctcccaatctgctgggattacagacatgacccactgtgcccggcctgatacataagttcttattatactttcctgccttttccaacatttctataataagcatatgtaccattatactaaaaaaagtattttaaaatctgattttcaataaaacaactacttattttcttattttaataaattttgttttcatactttggaggaacgaaagaacctgtggtttactgtatctccattataccaaggaagttgtgctaggcacattctgtaagataattcattaaagagaccaattcattcagagaccagtataataccactagcaaaaaataaaattatacttggacttgggttctgttttctttaaatattgctacaatgttatatagccctatgcactatttttgaattttgttctgggaatctccagtttgttttttactattgacagactattatctttacttactaaaatagcatatatatttacatgtcataatttgctcatgtagtaaatattttgttttatcaaaaagaatatatgaagttattaaggaattcatgttcctaggaaacacagcagaaattaattttgctgtataggtgagcagagcagattaaactgcttatatttttaaaactagttataccattaacaattagagtcactagtaatgtttttctcacacttcccttgatattttctgtcactttcttcttaattctctattcccttaccttcatctagctttccccatagcatttttttagcacttgatatcaatatatttatttgtgtattgtctgcctgcatcccaagaaggtgaagtctttggtgatgaagggtttatcttatttcctgcataatatcaaacttctaaaaagttcctaggactcaataggcatttaataaacacctatcagataaatgaattttttaagagaacacattacataatgctttctaatagcaatacagtgacaaactttatttttaagtaaattaatgcaaatatgtatattatttaaaattgtttgtttttaagataacaagcctgatagataataaattttggcataaatatgttaatgcttatcaaaactcatcagtacatatcctgtcttttgatgaaaaagtaatagaaaggggagaacaaagagaactctcatgctcactaggcaggccgagtgcagctctgacagcaatgcaagagaaatattactatctccatcatatgcaggatgaaatttaggcttggagaaaacaacacttcgttaaagattttatagctgctcaagatttgaccaaggcttttaaaacttcaaatgttcttttccttattacactgtttcttatcaggatttgtggactttggaaagtaaaatgaaaagtcagagcaatgtgagttagtttgataatctcagtggccagtaacagctatccccactctgaatatataccaaccaacctctcccctttctccaaggaagttagttcttggcaaaggcatttcatgcagtgtactttgtcattctaaccttcctttttttttgtatgctcctgttgctaatcatcctatttctatgggcttcagtcactcttttagcttttgtcttgggagactttctgtctgttgacatgacttttaaaataatcttctcccccattgtatttatatctcattagcctaccccccctccccttgtgttttagaagagttttattgtctgtcatccctctatagttcccaccctgttacctgcccgtgtcctgttcaaacacttgctccttttttccttgggcaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggtaagagtcttaaaatgcaattgaaagaggccaatcttggaatttcatgtagaaccatttataagacaatttgaaattggggcctactgtggtgctatgttgacacacaggaaagggaaggacaggtggctagggtaccgcagaaccaggtgccgagctaactactggtctagacctttatgagtaagtctaggcaattcttccagatataggagaatgagtaaatatgaaccctaggaacagggttcatcagctcaaatcaaaagctcagaaattattttttttctggccttgacttacgcttatataatggtgctcgttcatggccagaaaaattcagaagcctgcagatacaaggacacagaaatccaaaaggtaggtaggaatgctccccctttctttggggatttagtttgtcctgataattccatctggggacctgaattttcatggatatctcaatgtattctaaggacccagattgaagtataacagaagtgtttctagttttgtttgacatgaagaaacctctggacataaagcttttcccatccctattcagcctataaagcaatgtttctcatccctggcagtgcattagaattgcttagggagctactaaaaatgtttcatgtttaggtcccatctcagggcaattacatcagagtctctgagtgaggaccttggtattggcctgatggagtaagtctggggtagagcctaacattctacatttttaacaagctcccaggtgatgctcatgctgccagtccccaggtcaccctttgagtgttaaggctagagactagaggaacaggggagacgtctaagtattggtgaggtttgtcttggttgctgctaaatgattgctggccatttcaacctggggtttcctgttctgtgtttaaacactgactgtattactggtgtcatgctgtgactgttgatataagcagtggatctcaaaaatccatgcagctcctgcccaccattttcatagtctgcttataattagccgctataactaatagtttccaaactgattttctaggcttagaagtggaaataaactgcacccggacccagaataccaagtgcagatgtaaaccaaactttttttgtaactctactgtatgtgaacactgtgacccttgcaccaagtaagttttagtctttctctgattaaaacactagatataacatgagagttatcattttcctagggaagtaacactgactgagagttaagaattagggttctagtcctgctttgcctccaagcaactagatgactgtttgctcatttaaacactggtgaacttcctgtgtaggtgacactttgctggccacttaagctaaagatatgagccagacatatgcctggcatcaaggtatcagtccagaagcacagacagtcaaggaaagcaatggttattgtgtttcaacagcatgagaatagcatcagaagagacttatgttccaggtgttacaaattatacagaaaaacttttcaactctgcctgaggagatggaggtgaagacatgaatgtgtctcatgacttgaatcttgaagaaagaaaagaaagagcattaacaggtgcacatggatggaatgcacattataggcagggaaacagcagctgcaaagagacaaaggaagctcaggaaaacagaatacctggctggagtgtaggaaagactgagaagcgttcagggctgaatcatgaagggccttgtcttttaggctaaagaggttggttttgacccaaagttagagaacctgccttgtaagtcatcttgggaagcttttaggagttcatctaataggcttaagaaataagcacatgatgccttatgttttatttgctaggaaaattttatgtacagttgtcccaggctctcccctggccacaagtgtctgagagtgcccctatgatgacaggctaggtaggcattggggaagcagctgacttagtaaaataataacaataatagtaattccaaatatttcataatcttgatttaattttcttgtcatcataaccttttgaaatagataatattatttccatgttattgatgagataaaaggctcatggcagtgtgacttcccaagctcacctagtcaggtaatgggcagaggctgtgaactcagacaacctgattgtgaatgtttgtctgtctgaaggaaatcacacatgaacctcttgagtctcctgatcaccaccggttgctaaaagtggcagcctctaagggccagctgagtaccctccctgagctacatcatgggcgtggctatcacctggccattttcttggtctataggaattttttgaaattacttttgacagtttattttaagagctagtttaagctataggatttacgtgttcagtttattactaggtttaagtttatttttgtatccacttcatctctcttgtgtgtcactattttcctatcttcctttaactcttgaaatcttaagacagagtcattccttatgatatttttcatccagccatccaaattatattaacttgtgccagctttagatactaatttagaaatatttgaaggaatacgtttgccagagatgcaaagatgaataaaatggcccctaatttacaaagtgccattgaaaattataaaggaattattctgccaggcttttgaatttctcctgtatttttttttctagatgtgaacatggaatcatcaaggaatgcacactcaccagcaacaccaagtgcaaagaggaaggtaattatttttttacggttatattctcctttcccccaaccccatggaaagatgtgaagaaaaaccaatcactcttgattactagaaagtcctttatttaatcttaaagattgcttattttcatataaaatgtccaatgttccaacctacaggatccagatctaacttggggtggctttgtcttcttcttttgccaattccactaattgtttggggtaagttcttgctttgttcaaactgcagattgaaataacttgggaagtagttcacaaagatttgcctcattcttacctataaaaagctaccactttggtagatttatgtattgttaatttcttgcccctgaatgcagccttgagagctgactgataagaacaaatgaaattattcctcagctagtttctgagcaacagttttggggcattgagtggtattctcatccttcctatgaacaggtgttctctgcagcagcagaattggccaaaaatcagaagcaattcttcactattcattgagatctccctatgcaaaaagagaacacaagaagcaaaggcattcccaggaaacacattgcagggaacactttaaaaacttgtacttcactgcctcctcttcctcggcctaattgcttgtttttaattatttctccttcttaacttaaaatactatggggacacatgttatacaaaggtgacttagtagagtcagtagaaaagccaaaattagatattatcataattagtctagaaaaatccctttaagtcattcatcaactacagggtcacaccaactttcagtaacttagaagtattcaattttcccttctcagaacaattatctgtttcttcagttcagttgaagaagaaagtttgccttgcctttagcggttgtttagctgaaaatacatttgggatatttaagcactgtaattgtgctcagagacatacagattcttctatctcacattgactttaatgcatacacctattgagtatgtatgcttgagttatttgtgtgtgtatttcatttctgggcatccatagcaagttgatgttgacttgcttgtcctacggcttctgcatcctgccatagtcttgccgtccacatctttgctggacagagagtggtgcttgccatatggtaagtcaaaagccatctccttgctaggccagcctgtggtaattagatgactaattaagatatgtcctttcactagaacacttgacttagtagtacgaaagttccaaaatcagcggtctcctgcgatgtttggccacttttaagtttcactgaatttctcctttttccttcttatatttctcttagtgtgaaagtatgttctcacatgcattctacaaggctgagacctgagttgataaaatttctttgttctttcagtgaagagaaaggaagtacagaaaacatgcagaaagcacagaaaggaaaaccaaggttctcatgaatctccaactttaaatcctgtaggtattgaaataggtatcagctttccttgaaaagaaaaatagagaaattagtgatttggctttttgttacttccttttacttttttgtttcttgtttgtttcattttgtttgagatggagtcttgctccatagcccaggctggagtgcaggggtgcaatcatggctcactgcagcctcaaagtcctgggctcaagtgatcctcctgcctcaactgtgaccctgggactacaggcatgcaccaccatgccaggttaattttttatttttattttttatagagacagggttcactttgttgcccaggctggtctcaaacttttgacctcaagcaatccttctgcctcagcctcccaaagttctgggattataggtgtgagccatcacatccggcctgttactttctttatttaaacattgcttgtgtttgtgggtgcataggttaaaggggcctcacagatgaattatgatatggtacccaaattaaaagtaaacttgtacacaaaaaccgtaagaatcaacaaaggagggaattgagagtgtgctgaaaatgagctgaaaaaagaacttggccaacctccatgttccgtgttgttgttatccctgcagagaaacagcctttaccaggcatgggttcagtatccaagcctgagcaaagagattgctcttaaagtttgtcataagggcacagcttaactttctctggctgccggttgaccttatgtctcaccatatcttttcccaacatggtatcaatatatttcagatagcaagaaatacaccgagaaaagaaaccagttgcacttaatggaattattttcttatttggggccagggctcagtgggagttaggattctttaaattaatatggtaaaaaaaatttcaatttgagccattttctggtattaagaataagaatagttacagggaagaaaattttagagtagttatatttattatttattttaataagtctatatgaaaaataacctcaacctattttatgaattctttaggtttcttgcctttaaaaactaagacaatattgcttagtttctggcaaggccggaacctttcagaataaaaattgaatggtaaaagtaaccttcttaatcacttaatctagcttcctaattttatacatcaagcaactgattgtacttctttctgaattaaggaaaaattagaagttcacatttagaatattctaaagatatatttttatttgtctttctctgcttccattttttgctttctaggaaacagtggcaataaatttatctggtaaggcttttatcattttatttcatagagatggcatcctttagagtaataggccaatttcagagtaaaataatgttactaatttcagtgacatattatgggatcttgttatttctcatacaattctacctgctcagcataaagcatttatcaggcagtttgtttaaatttataatgaatactcatagttaaaaataatcaagtaacaataagacacaatagtctgaggcttaagaaacttttccttcataatcagctagatgtattacagaactcctgcctaaaaagatctagaggttaaagtgtactgtagactcaggtattatcagtgtacccaactctataacaacatacatgattccattcagttgttctttgatctgtgatttagagataagatgatcataaactctttgcttatacttttagatttgtgggtcattgatcattggatccataagagatgttataggtgatcttttccaatcctcttaatttataaatgagaaaagaagatacagaaatgttatgtattgtggcccaggttatttaacaaattactgggtatatggcaggatttggagttagaactcaaggttgtcttgtttctgtattcccctagtcagctcttcatagacctttaggacttagctatattctgaagtactataaaaagagaaataaacatggttttcactaatgggaatttcatttagaaaaacaaattttcagactattttctatttttcagatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggta

SEQ ID NO: 1698 - DNA, 25255 bp, Homo sapiens; identical to SEQ ID NO: 1697
  source 1..25255: mol_type = genomic DNA

SEQ ID NO: 1699 - DNA, 25255 bp, Homo sapiens; identical to SEQ ID NO: 1697
  source 1..25255: mol_type = genomic DNA

SEQ ID NO: 1700 - DNA, 25255 bp, Homo sapiens; identical to SEQ ID NO: 1697
  source 1..25255: mol_type = genomic DNA

SEQ ID NO: 1701 - DNA, 25255 bp, Homo sapiens; identical to SEQ ID NO: 1697
  source 1..25255: mol_type = genomic DNA

SEQ ID NO: 1702 - DNA, 25255 bp, Homo sapiens; identical to SEQ ID NO: 1697
  source 1..25255: mol_type = genomic DNA

SEQ ID NO: 1703 - DNA, 25255 bp, Homo sapiens; identical to SEQ ID NO: 1697
  source 1..25255: mol_type = genomic DNA

SEQ ID NO: 1704 - DNA, 7828 bp, Homo sapiens
  source 1..7828: mol_type = genomic DNA
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagaggtaagcctgccggcagactgctgtgccctggaggcaccaggcataaggggatggagggcccactgcctggcttgcaaagtgcttttcaatcctttttttttttttcttagaaatgggttgttctagttattctattctatagacagagaaatggaggctcataggggtgaagggaatattttttactttgtaaagaatcagagcccaacagtttgtctttcctcagttgtcaactcagtctgttgaaccacttactgcctcatacctattgatttaaggagtaaaaaacaaacaaacaaaacttttaagttttgcttggaagtaaatttgttcagatgaccaaactaaatcttgaaaattggtacgattccaaatcacaaaactgagggacagtgaggcaaaattgcttggccaaagcccaagttagcagaacttctgaggtatttggattctctttccagggcttggtttatttgacgattctgcctcttttgcttaaagaattttatttttattatacatcttttctctttctgttttactagtctaccagccagatgcacacagcatcatctttggagaagcaaataggtgagtcttttttcgcatgtacattgagttcccaaagatgatcctcagcacagaactatgttaatggaatgccttaaattctgtcccacactttggtttctgtacactataagaggaattctggctaattcagaatctctggtctatgattccttgagctgctttaaaaatgtgaagtgaattgaattgctcacaatcaatatagctgagcactgcacacaattcaaaatcacttccacttgactttggaaagagacacacatatacaaccctggacctttgccccctgagaagtggctccaggcctgtccccttccacagacatcctggtcctggcacacacgccagtggctgtaactcctgggaagagaaggcgaaatgaaggcagagacagatgtttctgagaaacgtcctttcctcttttaaatgccctaaagagattacattgaagctttatttacaatatgttttataggatgtaagcttttaaaacatggataatcaattccccacattagaatggtttttcttgaagtcactgagaagcttaagggaagacttcagccatcattcaaaggatgttcagcttcacccacagaggcagtcatgaggtacccttgatcacaaaggaaaatcctttgtatgggagctagggcaagaagatgataggttgaacactgatctcatgaaatttcagggcatagttgtgcaagctctgtacagatagattttacagtgtgcttcactagtctaagattcattgaaattttagatttagatttacaatgagattcattgaatttttagaggtggaaggaagcttagaatatatctagtccagccatttcattttttggaagagaaacaaaataccagatggattaggtgaatatgcccaagaccactggtatgccattggggctagaaggaacacaggctcttgatgccttgtcacctacagggctttccagtactggactggtgcctcatgaaggagggaaactcctgtctctctgtagtgagcatggaataagaaatagatgaaaagcaggatacctctgcaaagactataggtagatctcatccttagaaactcagaataaagaagaaggcagcactggccatctattaagtgaagcaagttccagtttctccggatgtggctactgcacatgacccagtcgcctgtctactatcctagactgttaagttcttatatgagccactgttgggatgctctggcccctgcttctgtgtcctaatccttaaatgttagaaagtccatatgtacacaagcagagtggaaatatttgatagaaaagtaaagcctctggaggacgtctgaaataagatcattttgaaaatctgtggaatgtgcctggtctgataggtatctaattattcatctttcacccactctctggagtcaatttagtgattaaaagtcaaatgatcaggtgagtcagatccatctaccccagtaagcaattatgttctctagatcaacccaaataaaccagaaattggtaaatcatcacatggaaatcaaatcagtaactttactaataagaaaagagatgcaaattaaaaatagggaataccaattttcatcaaattaataaagattaaaaaaaaacccagactgacaaagatttgagagaaaagtgcctgtgcaaacattagtttcagccagtatacatgtaaattgctataactttttttgaagagcgctttagaaatacatagcaaaagcttgtaactagtagtttacgttgtaatcctatcgctaagaatttatcttaagaaaataatcagagatgtgcccgaagatttatatataaggatgttcattacttccttatgagcctatttataataaataattcagaagaaacttgaatgcctcatacgagattagttatatacattatggtgtattcagacaagcacataataagcagcaactaaaagtgatgtatcagaaggacatttaatgctttggggattgtgcactctgtattgttagataaaaagacaagttacaaaagggtatgtttagtttcatactgactatgtaaccatgtatgcacatttttatattcttaggaactggaaagttttacacactgacatactaacagtgattttctctgggagatactattatagattatttatactttctaatttgctcctttttacattttccatttttttccggttaactaattaaatcttttattcattcacatgtgtgaggctagatgttgggtgttggatgctgattgaggatgagccagcccagggggcctgtccttatggagcttttagcagggggaagaagctaaacaaaagcaagcaaacagaccatgcaattccaaagttgtactaagtacaacctgagaatcttctttaaggaggtgttgtttacgctaacaccttgggggtcagaagcccgatgagtgaacggctgtgtgcatgtgctgtggagtggggtggggctgggggcgggcatttcagcgctgggaacggcacatgcaaaaaccctggggcaggaagcactcataaccagtgtctaggatatccttgcaatttatttattccagtataggtacagcagatattcttagtgagcatgttctgtaagaataacgttgtactaggctctgtgagggatataaagacatgcaacatgtggttctctgttccgtttcctgccggtgcgtggctgagtgccagattagttgctcgggtggtttgcggtgtaggaatgcagaggagactcagttttgcctttcctgttcgctaacacctcctacatggtgggttgtcttggatgactagagaggtcatgattgctcagctaatgttctctgtggattgggccattctcataccatatgtgagttttacaggctaatcacgaacctgacatagacaagcatctcctgtgaatatttattgaagtctcagttagctgaattcattagctaagtggcagctgtctatcttgtctgaaacagttgaagtcagagaaatagtgtctgttttgagaactattgtctatccttccatttaatttgtccaacatttgctagtaacatgccctgtgttagaaactgggcttctctggtgaactcaacgtatcgtaaggaacttgtcgttatttgaggggaataagataatttatgtagttaccccagagacaagaggagtcagaaatgacaagagaggggaagacagagggatcctagatttcaaaagaggggcagatcatatttgatcaaaaaaggcttgagagggtttcccaaagaaagcggtaataggtagtccttatgggatgtttaggaatttgacacagaaatctgcttgaaagaacattacgggcagaagacatggcatgaacaaaggcacagaggaaggaaagtgggggtatgtgtaggccacagaactcccgttgtgtggcaatgctcagtgggagtaaggagataaggctggacagatgggctgggattgtgtgatggggatacttgtatacgacggcatcttcggggaggagcaattaaaggtgtttgaggactcagtgatatgaggtgattgtcagaggtcttaagataattaatttggggcagattgtaaaatgtcactgggggaagatctggtgacacgcagacagatcagtagtcttcttcagcctctgtcctgtaagtctttggaacaagagaatcagagtggacagagccctggaattggcgtcaggagagcagggtgtggtcccatctgtgatgctgactagctgggtcttcttggattagtcacccaacttctaagctcattttgcaatcgataaggtgggacaataatacctacctcaaagggttgtggtgagttctaaatgcaataactgacatgacagctctttatgaataaatgtttatattaattatgttttattgtaacattataatttatacatatgtcaatcttaatttggtttatttttttacctctttgtttctgaaatatagactactatgaatcctgcagttcagacctacatgattagtatatgttagactgttgccatttacggttttaaaatcttttttttaaaatgattggatttaaattcccaccaaaataatagttgctatttcattttaacatatatttttcctctctctatgatacaggccaccccagtccaccccctgaaaaaaaggagctgaggaaagtggcccatttaacaggtctgtatctggaaggtacaggtgagatttgggaaagcttttggcaaaaggcaaaatggctgcctggtttccattaccaggctctagagagttgttacttcctggagacagtatttgaacccaataatactaacacttttcttgtcgagtcagtcttatgaacacactttgatcccctattctctgggcaaggccctcttctaaattggagacctggagctgattatgacatgacccctgcccataagaagctcattcttttcagtcattccaaagtcccttgggggattgggggcacagatccaagaggtgagagatgagaaggtgaggaatgaggacttattttagtcagtgctttcttggttttctggaagagcttcactctgctttgtccaagagtataaataggagtgagaagggagactcaatcctggcacttgtagagtttcaatatgtgcctgtaaagtggagtgaaatgatatggtatgggcactcccattataaactacataaataatggaataaatatcacagaaagtggtaggctattgtccctggaattatttaggcagaaattatagaatgatccggtcacatcagcagacacttactgaatacctgctgtgtgccaatttggggatgtgaagatgagtagcacatggctcttgcccccagggagcttgacatctaatagggaaagacaggcacttatgataatttcagtacttcagagatttaggttatgttcatgatgttgtggggatacaaagaaaagggaactgtaccccaaattgaggggctgaataattcttactgcaggtgagaagatggaccagatggtccctaagatccttcccaactttagaactttagagttccttggatttggctttttccttcaggaaaggacttcaaagcctagcagatttggtgctagttctgaagatagtaaaatctttgttccagagagcaaatattttctcaataatttcttactgcaatggattacgggtatatactattgttccaattgtgtggatgacaaaataggacaacgttgttgaggaaattctgtgatggatcaagttctgacccctcagccagttctataccagctgtcattctgggtgaaacatttgttgaaggaagggcccacagttttgccttagaaacttagtttgttggatgcatgactattccttgttgaaagctccttttggatttatttcaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaa

SEQ ID NO: 1705 - DNA, 14156 bp, Homo sapiens
  source 1..14156: mol_type = genomic DNA
ctcttttctaagcttgtctcttaaaacccactggacgttggcacagtgctgggatgactatggagacccaaatgtctcagaatgtatgtcccagaaacctgtggctgcttcaaccattgacagttttgctgctgctgggtgagtgagggtcattctgaaatggggcaatttcagacactcctactgcctggactccaggtaccagtgtggtaaggagcaggcctgggccctggaagcaggggatagattgaaagaggagagaggaccctgaattcttaagtgttccaatggttcctaaggtcagaactcagaggtagtttcatagtccctggaaagtccattctgcaccaaacattcatgtgtactttgtagtcatgaggaggaacaggaaatgagataaaggggacatatgaagtgaatacttttataaaagatcaactggaaacaggatcttgagatgggtcctggagaaggaagagcccaagctcacctccccagcatttcacatacgcagctaaatttgaagccgtgttctcctgctcgacgttgatccactctcttctcttttacagcttctgcagacagtcaagctggtgagtatgccctttgcttccttgtattgacagtgttgtatcctcataatatgatgctgtgtttgctggggcggcgggggggtatgtctattccactgaaaatcaagcttgggttcagcatgggcagttcccccattttagtggggtctgggatttgcttcttagatccactgaagacccaagggaatgaggccgctgcaagtacagatcttgaactacatctacaataggactcttgggtgcctgacctcccttgggagctcctttggcatccacagtcccttcagggttatttattccacacccctttccactctgcccctcagcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccggtcagtggaggaaggccccagggtggacctgggagggccaggacggatgaaatctgtttacagacagaggtttgcaggaaagagtgggcgtggactgcttactgggaagcactgttgtgagttgctcattcattccccatttcacccaccctctttgcttagcatgcgtggtgggggaagggggaatttctaataattttctcagcatgtgttaggttgtttttgcctcagtcttgattgagcaagggggttacgaggccacaaacagctgagtgtgggagaagcagaaggaaatccctactttaaaaaactaccctcctcctgtggcaatgcggtaaagcagagaggttgggggaaatagacctctaaaggctctaaggcaggaggctgccagacaggtgtgtggaggtgggagtgtagaattcagtctggaagatgaggtcagaggtgaggggagggtgaagggtagatcaggcagaggctgataggctgttgcaactattttgacttttattcctgagtgagttgagatggctttaattaaaggagtcacgtgatctgatttagctttatgtaaacatctgacagtgttcagtttaatagagtctgtagagaaaatgcttctagatagtatttcttttttttttcccccaagtagctgggactccaggcacacaccaccatgccaagtgacttgtttttatttatttttatagagacagggtctcagtatgttgcccaggctggtcttcagctcctggcctcaagtgatcttccctcctcaggctctcaaagtattgggattataggcgtgagccaccacgcctggcttagatactgtttctacctgcttccaatgtctgaaaatataagcacatttctattgttgtttacttgagctgcactcttggtgcataaaccctggagatggtcacaggtaaacattcagtgttttagattctcctgttcaacactgaaagggtgatttgtttttgtggtcctttaaggctgctgctgtaccagagagatcctggctgtggagtcgctttctgttgatggtgctttactgaaggggaataaataaatattgagttgacctcaaaagctgcctaatgacatcatagctcctctctgtattggcttcccagagacagccgatagtaattctgactcttcttatgaaaatgtaaaaatatagataataaaaattgagggctgggtgtggtggctcatgcctgtaatcccagcactttgggaggctgaggcaggaggatcacctgaggttgggatttcgagaccagcctgaccaacatggagaaaccctgtttctactaaaaatacaaaattagccgggcatggtggcgcttgcctgtaatcccagctactcgggagactgaggcaggagaattgcttgaacctgggaggtggaggttgcggtgagccaagatcacaccactgcactccagcctgggcaacaagagtgaaactctgtctcaaaaaaaaaaaaaaaaaaaaaaaaaattgagatctgaagcattgttagagagaaactacctagtcccacctatccattgtacaaagaaatgcaactgattagacccaagagctcagcagttaatggcacagccaaaatcgcaatcctgactttagtttctgttttatgccatctcagtaatggtacctggcctttcatatacagaatactttttttttttggccaggcacagtggctcatgcctgtaatcccagcactttgggaggacgaggtggatggatcacttgaggtcgggagttcgagaccagcctggccaacatggaaaaaccccatctctactaaaaatacaaaattagccgggcgtgatggcgcatgcctgtaatccagctactcaggaggctgagggaggaggattgcttgaacttgggaggtggagtttgcagtgagccgagatcgcgccattccactccagcctgggcaataagagcgaaactccatctcaaaaaaaaaaaaaagaaaaagaaaactgtttttttaaatgaatttttatttaaataagatcgaataaattatatttattcctatgatacagcaatttgattttcatctttattaagtctattgaaactttgttaatagatttgtcctccgaggtagctgaattttggaatctgattactctgccatcagtgaagggaaggaattgttgggagtgaggatgtttgtaggcaaaaaggaaaaagtgattttaaatttaaaatttttcttgaatgccccttttattcagagtcacaaatgaatactgaattcacctgtgtgaattcaagtcatgcctttttatttcttatgtggatggaagattttatgcagggtacagtatggtctgaatgtttctgtgcccccaaaattcatatgatatgaattaatcaaatagcaacccccagggtgatggtattaggaggtgaggtctttgggtaggtgattaggtcatgagggcagagcccttataaaagagggccgagggagctcaaaggcctcttccgccatgtgaggacacagtaagaagcctcagttctgtgaaccaagaagtaggctcttatcaaagaagctgtaagcaccttgatcttggactttccagcccccagaacagggagaaataaatttctgttgtttataaaccacccagtttatagcattttgttatagcagccagaacagactaagacagggtggatgagggatgattaaggctctatttttttttttttttaaccagcaacagcatgtggaaaaaaggggggaagaaggctctacttctttgctaatacagttcaaggctgcccaccctcacttcccaaagcttgtacaaaatttaccattaaattagtaatccccagaccacaaaaactgacggcttcaggccctgtcgagtagcctctacagttactgaaatgcgctcatttctctactcaaacgtagtattttaaattcctcagaattgttttaaatatctgctctgcatctttgaaacctctgaaaacttctgcttttagaagtcccacagatataataccatatattgcctataagagaatgctcacatctgtcatgaagcatcttcatttctgtctgccagacatcatgtcaagttctgtgagtaacgtacctctgagactgaaaaacccttggaatctatccttacaactttttcttatcatatttgtgtctttcagaatggctggtgctccagacccctcacctggagttccaggagggagaaaccatcatgctgaggtgccacagctggaaggacaagcctctggtcaaggtcacattcttccagaatggaaaatcccagaaattctcccatttggatcccaccttctccatcccacaagcaaaccacagtcacagtggtgattaccactgcacaggaaacataggctacacgctgttctcatccaagcctgtgaccatcactgtccaaggtatggggagtctgccaagatgtagggaggggagaagaggggatggacaagggctgaggtcacatgggcctacatggaggtctgagaaagcccatagcagcaaaattgggcactggagcaaagaggagtggggtggaagcctggctaagtattgaccaacaagtaggggccagagcttggagccctcacgtcccaggtaataggtagtcaggctgttgtttcactttgaaatgtaggccccagactaaagatggcagtgaagcagagctccctcattgatgcagaggttccctaagctcctgggcattcctaagagctgaggtttgcctcgtttcttctcatggctcatgttatagccattcactccagaaagcctggcacgtcatggactgttcaaggctgtgctccatagagtaatgatgcctccagctatgcgaggctttgggcccaccctccgtactgtccccaggggctaaggggaatccttccctctgctcctgcatgctcaccagtgtgctttcattcatttggtggagaaacctgggtagggaggaggcacaagtccagccacagaaaccctgtgccagtgaggctggggatgtggtgaatcttgcattggtgagtgactcagacacagaagagcttcaggtgacaagcactgggacatagcattggaggtgggaggtgggacagggagaatacaaacgttgtcattaaaatagtaaccccccatcctgccctaatgtctgtcttccctagtgcccagcatgggcagctcttcaccaatggggatcattgtggctgtggtcattgcgactgctgtagcagccattgttgctgctgtagtggccttgatctactgcaggaaaaagcggatttcaggtttgtagctcctcccagtcccttttgttatcagtttccatttggcccagggcctaaccccagacattgccagaatcccgctcttagggctagatatgcattccgatctaggcccaccttttatttattagttcatttattagttcatcctcaacaagagcactaataggagtcacctcacagggttgccatggggatgaaagaggctgatgctcttacaccagtgcctggtaggcagtaacagcacacaaacagggctgttgccattctggaggaggtggtatgtgagggcagcgcttagctagggaaggaggactctccaggcactgggccaaggcagggactgaggctgggtggggcttatatgaggggggagtagatagggtactgcaagcctctgagaaagagaaataatcccactaacacctcacaaagcactttgcaattggttcatagccaacacctcagttactgatgataagtaaatacagagaaacagagagagagagaggcagactgtgagacacaggggtgtttttaaaaggcagagcaagcctcagacagatgccatggcgtggcctttctgacactcctgggcgtccccatgggtgagctgaattctgcctctggactagcccttttccaggtgggagcagcccctgagcaggggaactgggggtgggaggacaggaaacatctgccagagggaaggcctgagctggtcccatccaatcctggccctggtccttggtcctgaggactcaggccccactgcctaatcctgctaacctcctgtgtgtccctcccagctctcccaggagaccctgagtgcagggaaatgggagagaccctccctgagaaaccaggtgaatacagagttgtctcagggattcagtgatggctcaccagggctgccggctggacctgagccagcgagaaggggcttgtgcgagttcagctgggagccagggagggagcagcgatggggggatggccagggctcaaatcgcttggtcaactctgagtctaatttctgggcctaaagaggacctcgctggagatgagaagagaaacaccagtcccagatacagaggagagggcggtgttcaaatttctaggaccaggaatctggtgatatttccagagcaagaaatcagagatactttggtctttctgtggagctttggcagagctggcagaggatggggttaggggctgtaagactgaggccaatcggacgtgggaggcaggagtctaaggggaaaggaggaggaggcctggaaacccctcaatttgctgaggaatctgcctctgtggagggatggggtggagtggccaggctcagctgtctgtggaacactaagaggaggtttgggcttgagaaaattctggggggctaggggcactagtgggctctactctgtgggcaaagctcggttccaatgcccatgcactcaaggttgactgaattttggcctggttctgcccccatcacacagtggagccctgagcaagtcagtctccctgatggggttcagtctcctcactgaggaaatgagtgggtggccagggtgacctctcaggccttctaggtctgacattcaggtgggagtatgtaaaggaacttccaggaggatgccaggcaacttccagactgtagttaaagtcagagcataaaggaaaccagtgctttctctgggggcttccatgacagtaggaacaggcaggaaaaaggctgtcaaagaccgcacctcagatggctggagtatgatttagagcagagccaacagatttaagagcttgagcaaaatatcacttgttcagctgtgcttgcagcaaggttgcacgtccactggccaggcccagtggtgataggggcctgtgttcacaccagggccaaagcagatctggaaaatacaaagtccaagcaactggattatccgtcttgttgtgtggttctgtctacactggcataagcacacttcacgaggcacttttgcagccaggcatgggggctgcataaatggttttttaaaaatcctttcgcaaaaggcaaagctgggttgctggaattgttggggaatgtattagaatgggaattcagaatgtggtttgctgcagaatttacagcatggcaataaaggctctctgtgttcagggggtgagagaagagactagatgcattgtctcagatgtctcccgacttcctgagaaatgccactttgcaaatactggggctacttttcacactggccaagtcagtttatgacaaaaacatgaggcaattaggtgtgttttggacactaaccagagaaagtccttccttccctcccttcctccctccctccttccctccctctctcccttcctgccttccttccttcccccttccctccctccctttctccctccctaagctccctccctgcctctctttttctctctcatgttactttctctttctgtcttcctttttaatgccatggagtactatattcttcaaagttccaacaaagatgcactacatttggacaatgtggaaatggccctcagccttctcttcctgatgtggtcagcaaaaatctggactttacttcactctgatgctgaacaccctgctccacgtcttccccagtatctcagatccccaagctgtctggtttgcttctaggaaagctcagcaattccctgaaaagagtgtggcccaagtgactgcttccctccaccagtgtggcccatggggaaggcttgtggctgggtgaccccaagggtgggtacatgaggccatatttacttagcccttggccttacaggactgtgtcaaggggtcagcagtccttgctttgagtctggttatggttttgcagcctcagcatcagcgtgggcaggcccttttcaacagcagtgccctggctaatctttttctttttccccacagccaattccactgatcctgtgaaggctgcccaatttgaggtgagtaatcccagccatctccttttcctcctgccttgtcccttctctcctgtttcctctcatttttgcctttgttaatgcaaaattaaaatggagactgggcctgaaaactcctgagcaaacaaagccacccaggccttagaaatagccttatcattgcttaaactgcaaacataagtgaaactcaagttggattgtaactaaaaataggtaatacttaacttggatcatttctggtaaatgtttatgttagacagaaataagatttaaccctagccaatcgtaagcagccaactaacataattatgtgactaagaacacttcagtaaggtacctcacccaaaagacaattatgtaactgcaaacctatcaaatttctttatttttcttccacattttccaaattaatacttgtctctgactttctgtcattaaaacattagacctcttttggtttggtgtcacccaattcatgaattgcttcttattcaaatgaactctttaaaattgtattgtgccttagatttttctttaacagtttggtgtcagaagtaggatataaagtagaatctcccccaaagatccctaagagcaatgggtgaccaggcataggtacccattaagcccattgtgttcactggtttcttcctgcatttgtgagtcactaggtaagtccctctcagatatcaggcttgcaacttgtgtcctgagctctctgagtttatttgagtaattttatttctcatttgattcagcagttaatcttggtatttgacaagttcatctgtttccaacaggaactatactaggtccagtatagtgtactagtttccagacaaggtctgatttctggattgggatccagaggtcaaattgggtacttgacagattgaactaggtgttcaacagaaaccgaactgggggtccagttggagtcctcaggtaggtaaatttcagaagggcaagatattatggctttgtcagaatgtacagagtctgggactcctccatctgaaacacagtgatttctatgttcagataatatgggcccagaacctgtgactttctagagaaataggtgtgccttacctattgagccttaccagagatgacttaaagttgcaatggtcacagtgaggatgtttaaatctagaaaaaattgttcatttaagggatgcattgggaaaaaatgagatcccaaatgtctcagaaacaatgataaataattttgattggtatgtaaaggtttctaaaagaatgatttaaaaaaatagtctctctaagtaaatctttacaatgtgctaataagaaagtattctaaacctattaacctctttgattgcttgctttttccatctgaacctactcaatgctaacgtccttaaaaaattagatcctcaaatgagccaggagtatctacaacaactaaatttaactcttgttattgcacacatgaactattataaaagcaaccactaaggctaaaaataataaaaactaattggaaataggccagataaactaggtgtctcgttagtcactcatttaaaatttaatccagtctcaataagattgactcctaataataggtgaaaatgccccaaaactccttcttggagaagcttcgtaccctttctctgggcctttgagttgtgtaaatgtttttaaaacacaagcttcagcaaaatgactcatcaaaaagaaaaaaggaggaattttttagaaacaaactggcaaatgaaaaatcttaatagtcctctccacaaatatcaataaaaagtgccagccatcagaacagctaactttaactagaggctagatccaactaattagttttatattattatacctggcacatggctaaaatttcagaacaaaagccatgaatttctgtttgcatctttctgtatgtttacatatatctacacatgtgtatgctatttgtacataatattattctacctccagatggtatttattagaaacagtattaaaggagctcaactggcctagagaaaaataagcacttatataaattacatattttctcagaagaaaagaactttgccaaaatgcttttcaacttcatatgacctgagtaatctttaataaatgagaatattggtattaatgaaagtgaatattccacctagttttacccaaataagctcatgttgtctgctatacaatttgtcaaaaaaataccttgagatgacaggtagttggttttgttaatattatgtttgccactttaactatgttaaatgaaatgacaggtattcattaaatatctacaccatttccagataagacaaactactaaaacaaaaataaaaaagtgttccacttatctttttctctctacctgattgtttcagaatttggaaactcttattaagtatttttattttcaatctgggtatttgcataggttcaataagaatctattctccttgtaacaggacataattgggcaagtccttggcttggcttcttagcctagagaggcttttaaaggtctaatctgagatttctcaattactagatagtttttaaaaactaaagttgactgataaaaagtcagtaaagtctcttggatatcaccaaagctgtggctaaaatatattttaaaattactgtttttattatacctatataaataatcaggtcaaatttaatgaaactagatttatttttgcaaaaaagttaactttgattttcggtaaaaatggaaaataaaaatatttttctccagaataaaaaagattatattttagtagaaaactattgtgcatccattgtcaaattctaggcctgttcattttctttgaagttttattatctccctataaaccagattgactcctgaatttttgttttttagttccactaaaaactaaaactgcccttttccaaagctctgcaaactgaaactggtgactttaagcttcagaaaaatcactgcaacagagcacttatgccttaatgccaatcttaatgcctgctgctatctgggtcactcagagagtttaccagaatgtttaatgaaataaccagagacattcaaattgcaaaccagtaaagcacatcacattgcaactgctatcttcagtctaccatttaaacttgcctcaaactcacctctagaaattgtttcacctagctgccctctaaactcaaaaactaagatcataatttgctccaaatattaactttgtttttttaatagaagaatactctgaattcctttcaagcaatacaatctaaaatgagcaagttagcctcaatagcaccccaaaatagaagttcttgatatcttaacagcttaacaaggaggagcttgtgttcctactgatgtcaaaagaaatggttgaagatctcagctggctttatggtgattctagaactgggcaacacttgcctccttaaattagaataaggtttccaatgagttacagcagaggagattggcttcatagacagaaaaaggtctgaagaaagcagaaacaaagaatttaaagtggattggctattttaaaactggttaaagttgcaaaagacaggaataggaaaacagaataataaataactggttggttaacatcaggttactcttttgtaaggatgccaattgaaactggcctgtttgggaaattagatttttaggttattaggttattatctctctctcctgatttttccaaaggccagataagaatgtagtttctgtttgatgacttgaaactttatcatgggtgattccactttgatttttagtctgttctgtttgggcctagtgcaggagcttagtgcaaaacaatagcctcctaaaatttaaaagactttaaagaacatacatgagtttttcatcagataatatttatttgtattcattaatttatttgattggttaagtcttggctcccgagaatctttgctcagaggaatttttcaatccttggctattattctccttatagttattgtatttacctccccggtgtattgaattatcctatgggttttaaatgctttcctgcagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctgagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttcctttaacatcttttttttttttgacagagtctcaatctgttacccaggctggagtgcagtggtgctatcttggctcactgcaaacccgcctcccaggtttaagcgattctcatgcctcagcctcccagtagctgggattagaggcatgtgccatcatacccagctaatttttgtattttttattttttttttttagtagagacagggtttcgcaatgttggccaggccgatctcgaacttctggcctctagcgatctgcccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattttatttttctataatgatcatatattacctttgtaataaaacattataaccaaaaca

SEQ ID NO: 1706 - DNA, 14156 bp, Homo sapiens; identical to SEQ ID NO: 1705
  source 1..14156: mol_type = genomic DNA

SEQ ID NO: 1707 - DNA, 8268 bp, Homo sapiens
  source 1..8268: mol_type = genomic DNA
ttatcattcatattttattaccatggttttcccatcttctatctaagagtagcatgcaagatcttgtaaaatgctttattggaaccaagaaatgttgcgcttaaagcttacaaaacagagacagctaaagctttctttcataagcaacaattgtcttctccatccccacctcattggaactgacatgatgaaggatttgaaagtttcataacttaactcagcgaagctcagtagtacatttagtattggttatacaacatttgtttaataaatgcaatgaacaaagctacacaggaattagatattgaagcagaaaaggtggttttacagtccctgcattaacctctaattcttactaccctggccaagaaagcattttcacctcctgcgctttccttcctgtgtgcttgtggttggttctttcttctcaggctttctcattctgatgctgagatagttctgttcacttagcaacttgggacagtgacacagggtttgttctgtactttcttttccaccccaccccccaccgcaatcctcagtccccttcctaggaccattttctactcctagcattaagaggactcatcgttatatacttggagatggtccagttctgatagagtcccctggaagactcaattctacgtcaccctcatgatttcctgttaattccactacggctaatgttctaggaagacacccttatctctgggctcagatgggaacacctcccttagactatcctggactacctgctatttctcagccatgctttcattggtcccactgaattccctagatccccagcagttcccacactctgtatggtcctgcctcaaccattaattctacttatccatttatttaggaataattgtttttttttcccctctaaactgggtaatttataacacgagcaatttttgtatgtttaaaggattaccatccctagcctgtattgttgctttgctgtgagggaacggttgggacagaaaaagtgtttgtgtagctctgaaacttcaatttctaggaatgcagctactcactggggcttccctgcttgaagatcatgggcttttcccttccactggagaccaaggaaaagtcgagagttggataagggatctggctctgagttctatgtttcctgctgcttgtagagaggcctgaggatgatggggttgcaaatccagagaaatgttcagagatgctgctgctactgctcttattacccccatgggatgggggtcatttgtcttgagggtcctttctccatttaaatttatggtccttccagtctcttgttgagcttcgaatgtttgtcttcacagagaaatatagtcctgtgtccactgcaaaaaggagtaccatcaccaagcagaaagagacttggtacccaggtggaaagaatgatgagatggttgacactgccaaacctattaggagaagtggagagatgaaaaaaaatgacagtcactaaggcagatatttggaacaaacagtgaggtcaccagtagaaagtctttgacaacagccaacaggcaagtggtaggaatggtggggaagtctgggggaaagtattgcttcctcccattggttcctgatcttagtgctatctgagcagaggacagctcaccaaacactgagcaaaggctcctgcttgtttgacagagatgtgacagggagcgttaacaagttaggttgtaagctgggttttgtgtgacagttaagaaattgtcagacaatgctatggtctagaaactgggacaaatttgttgattttgcatttcaattttttaaactcttgattttgatatatttccaaacttaaaaaaaaaatgaccagaatagtttaatctcgtatatcctttacccagatccactcattgtttacatgttaccccatttgctttatttgctctctttccctaaccacttgggagtatttactttcagtttaaagtgtcatgaaattatttttgtacaaattatggcattgtagtgtcaaaatctcaaaaggtgttttgctgcctttctacatgcaaattgtttacaatttatgtcttgggctagttacagatagaagttctgtgaaactggaaagtccaggcacaccactctagagctctgattctggaggctggtgctacagaacctagagatgttttgtggatgacttaatgggatcataggatattagtgcttgttcaaatcttttacttactggttaaatatacaggctttgaagtctttgatgtgaccttagggaaacttatttatttatttttgcacctcggttacttcatctgtaaaatggaatattacctatctcatgttgtgaaggtctactgtgatagtcaaaccaggtgcatgtaaagaattgtttagcacagagtctagcacactgaaaggtgcccaataaatgtcagcttatttttgttacggaagaagaaattggggttcagagagactaagtggctcacctctggtcagatggttaattagctgcagggccagaacccaggttctgggctctttctgtgaggggatgaggggctcctgccagtttggatcgtggctaaaaggcttggataagaaggaggccagcacgataggaacatatgacaccgtgggtgtgattagcgtaaggaaagacagaggtatttattggggaggagatgtggcttctgctcctgccatcatgctgcagagtgaatgacacctcctagctaccccaaaagaatggactgaaacagagctgcaaacctaccctgcaatcagggacttttggggacctcctggtgatcaccaggagggaaccacatatgaagaagtgcgtgtaagaatcaggaatctcctcccaactcaacttcccagtgtgattgcaggttccacacacaggcgtccctgggcattccagggtggcacatgtctcaccttgagtgatggtgatgttcacagtctctgaagacacatttttactcccaaaaagccccctgcagaagtaggagccgctgtctttgagtgtggcttttggaatgtagaagtcagaattatgatgaaaatacttcctgcctttgccattctgtaaatatgtgaccttatgcagagcagtgttcttccagctgtgacacctcaggtgaatagggtcttcctccttgaacacccaccgaggggcctggagcaacagccagcctgaaagacacagacaccccaggcccgggaggcctcagctctcagtgcagagctttgtgaaggggccacgtaccacccagatcctgagacataagggaaagccagattgggagtcaaccctgcatagctccctttggggaagagctgatggggccctgcaagagaactgaagtcataccaagacctttgtctaatggggaagagggacacacacacatgtgatcaacacacagggttagagcagagggactaagcaatgaggtaagtgagaagcaacgatgagcatatctgcaggatccttaagtgctagacttagatttgctgtggcaggtgacaaggattcacagtaagttctagatcagagtaaaaattgcatttgaaaatgatgaattgccctattagaggaaaaggtagatttcagaaggaataggcaatcaaaggaatattgaaagactcttgtggcagtcaggaataaggtgacggtggccacggagtggctgcagaaattgtgaaggagaactcaatgtaaacaccagggaggggaagggcgggactggtattgctcagcctggcaattcgtggtttctaaggtgtcacagggcctcggtgagaccaactttattactgagcatggccttcaagagaggaaattcttgtatcgccagagcttattctcacgatcatgtcaccaagtaatttactgagcatggccttcaagagaggaaattcttatatcgccagagcttattctcacgatcatgtcaccaagtaatcagacttcacaaagagagaacatgaggtcatggtcgggaaagggcctgaataattaaaaaataatgatgttataggtaagtattataatggcataagaaaatattcatgagacaattttaagttaaaaaagcataatacttcaaatattttaaaaagtattatgcacagaaaaaagaaggatatgcacttacatattaacaggggttttctctgaaggagtgggactgaaggacattttaaatttctcctgtttacttttatatatttttgaaattgaccccaaatgacttttgtaataagaacaaaacaaaatttacaataattttattttttaaatctacattctcagcttgaattactataatttaaaaaatctactacctgatgctaaacaaaattggtaggacgtgtgttggtcatgattctctaccacaaagatttgccaaacagaaagtaatcttcattacctattaagagatatcatttatcaaaagaagccatgtgcctatctatccacttactttttcagcagagagatgaatcattattagcataaagtcatggttagtatatagtctggtggcctttggaggaacattcttgttcgaatctatcctgtcatggacccagtgaatgtccatatgtatattccttcaagtgatatttcatcaagcactcactatgtatgacacactgtggactggagatacccagatgatgggacatatagttctcagcctcaaagaatctacagtctagacatagaaacataaatattcagaaataatcacaatacaatatgacaagtgctacaacaggctaagaataaaggactgcggggctgactagattggaataaagaaattctgcctgaaagaagtaaaaaatgcaggctgggcgcggtggctcacatctgtaatcctagtactttgggaggccgaggtgggcagatcatgaagtcaggagatcaagaccatcctggctaacgctgcgaaaccctgtctctactaaaaatacaaaaaattagccgggcgtggtggcatgcacctgtagtcccagctacttgggaggctgaggcaggagaattgcttgaacccgggaggtggaggttgcagtgagccaagattgcgccactgcactccagcttgggtgacagagagagactctgtctcaaaaacaaaaacaaaaacaaacacaaacaaacaaacaaaaaaagaagtaaaaaatgcttctcagaggaggacataagtgaaatgggtcctaaaggattaaaggatgctcagaagtttacctggtgaagctaattctcatggtcacagtttaatatagccttgattggctagacttctaaagccagtttctagagccaagttcaaggcaaactagtaactcttagacttgatttttctattgctttctcttggtaattcccccattttatttggttgtaggtggacatctcttacctagctagaaatggacatatcttcttgtagctctggagagtgaagaccatgtcagttgagtggtactgtcagaggccaaagagccacaaaaatcagtttcagaggcccaattccatggagctctcttgcagatccacctccttatgcccttcttcccccaaagcttgttccacccataaacattgtatgaatggaacagccgtggaagtagagttaggtttgcagggcgacactgcagggaccagcctatgtggtaagattgtagggacaccaggaaagacctctgccttcaaaatatttctcctacctgtgtctgacgtctatattctgttaatagtacacaagaactttcatgtcatgattaatgtgcaggctgaacatgtatctgcctctattggaagagctatcacattaccaaatttatgcttaattataggtttgagtatagcattgatgaggagacagaaagatatgatgctaggccactaggattgctttgggaggtggcttagggcattacatgtctgagagcgagaaggagattgaggtcctaacaccaaattcattaatttattcaataaatattattggccaggtgtggtggctcacgcctgtagtcccagcactttgggaagccaaggctggtgaatcacctgaggtcaggagtttgagaccagactgaccaacatggtgaaaccctgtctctactaaaaatacaaaaattagctgggcgtggtggcgggtgcctgtaatctcagctactcgggaggctgaggcaggagaatcactacaacccaagggggcagaagttgcagtgagctgagattgccgcattgcactccagcctgggtgacagagtgatactctgtctcaaaaaataaaattaaaaaaaatgaaaataaatatataaataactattattgagcatctatgccatggcctaaccttcacatgacacattcacattgtatgcactccatatggggattcttggaattgtgcaatgcagcagtcctatatctactgtctgacaggctttgacattttgcccaagacctacttagagctaggactacaactctgataccattcagtgggaccacacatcatctcatcttagcttttatctctaagaatatcatctctggctcttaccaagtatttcaggaccctttgtttcaccctttattggtgattttcctcttccccttcatcaactcaccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttctgaggagccaagataatgtggggtgaggacagggagaggagcaggctctacactgccattcccagggagcctcaaagccagaatgagctcattgcaaacccatgcttggtggctcagtcttagagcatcttggccccatttttggcctgttcagtatcttaaggaaagctggccagagaagcacagggccaagttctgctgtgttggaggaactatccctgctaaccccacatcagcattttcccattcaacaagcatttcccaatatcttatggcctttgtccccatatgtgccccactgggtcaatccaagaccatgaagctgactcaccagtccgcatgccagctgaaactgcaagaaaaaagataaatcaaatattgagtaggggcagagatcagagtgattagaacatagagtgagtttaaaactcccctgccctcctctgccccaggagcccaattttcccaagaatcaggatgtttctggtggaaaccttgctacctgctctctggtctccactgttcatgcctcttgcgccactgtcaacacaaatccctattttcaacactgctcccttaccccttgctccctgtgcaaactcacaaattaagggtacaggttgaatttccctgaaccaagctacagaaagagcctcaacccatatccccacaagaaagggtagaaattgaaaatcatagaggagaaccctggaatgtcaaactgaaagagacagaccctagggaccatctagtcgaagctctttggttccacagagtgattctgggacccagaggggtgaagtgactggcctcactcatgagtatgccccaattggaaccagcattctcctcatttctagccccatcttggcttgtcctaggagctcaatccacagctatagatgtggtgaggggtcccatcccttcgtgggagtctcattcgtagcctgaaaaggggtctctgctgaacccaaggcatctcaaacttctccctcaaccagggagaccctgacttacctagaagtagcagagcagttgggaggagcagctgccacatgatgccacactggagtggacaagtcaccaaagatatccggagccctaaagggaccaaaccgactagacaggaggaagtaaacagcctttccccagcccctccacccatctctgtcacccaccaatttccttttcttgaaacttcatctgacttctcagtctgaagtctggcaagggagccccaccatagaacaggaccaggaaggaaagagcctggaggcaaggtgggtgggtctgccccctttactccctcaaaggtctgtggctgagcatctgaggacacacacagaatc

SEQ ID NO: 1708 - DNA, 8268 bp, Homo sapiens; identical to SEQ ID NO: 1707
  source 1..8268: mol_type = genomic DNA

SEQ ID NO: 1709 - DNA, 8863 bp, Homo sapiens
  source 1..8863: mol_type = genomic DNA
ttatcattcatattttattaccatggttttcccatcttctatctaagagtagcatgcaagatcttgtaaaatgctttattggaaccaagaaatgttgcgcttaaagcttacaaaacagagacagctaaagctttctttcataagcaacaattgtcttctccatccccacctcattggaactgacatgatgaaggatttgaaagtttcataacttaactcagcgaagctcagtagtacatttagtattggttatacaacatttgtttaataaatgcaatgaacaaagctacacaggaattagatattgaagcagaaaaggtggttttacagtccctgcattaacctctaattcttactaccctggccaagaaagcattttcacctcctgcgctttccttcctgtgtgcttgtggttggttctttcttctcaggctttctcattctgatgctgagatagttctgttcacttagcaacttgggacagtgacacagggtttgttctgtactttcttttccaccccaccccccaccgcaatcctcagtccccttcctaggaccattttctactcctagcattaagaggactcatcgttatatacttggagatggtccagttctgatagagtcccctggaagactcaattctacgtcaccctcatgatttcctgttaattccactacggctaatgttctaggaagacacccttatctctgggctcagatgggaacacctcccttagactatcctggactacctgctatttctcagccatgctttcattggtcccactgaattccctagatccccagcagttcccacactctgtatggtcctgcctcaaccattaattctacttatccatttatttaggaataattgtttttttttcccctctaaactgggtaatttataacacgagcaatttttgtatgtttaaaggattaccatccctagcctgtattgttgctttgctgtgagggaacggttgggacagaaaaagtgtttgtgtagctctgaaacttcaatttctaggaatgcagctactcactggggcttccctgcttgaagatcatgggcttttcccttccactggagaccaaggaaaagtcgagagttggataagggatctggctctgagttctatgtttcctgctgcttgtagagaggcctgaggatgatggggttgcaaatccagagaaatgttcagagatgctgctgctactgctcttattacccccatgggatgggggtcatttgtcttgagggtcctttctccatttaaatttatggtccttccagtctcttgttgagcttcgaatgtttgtcttcacagagaaatatagtcctgtgtccactgcaaaaaggagtaccatcaccaagcagaaagagacttggtacccaggtggaaagaatgatgagatggttgacactgccaaacctattaggagaagtggagagatgaaaaaaaatgacagtcactaaggcagatatttggaacaaacagtgaggtcaccagtagaaagtctttgacaacagccaacaggcaagtggtaggaatggtggggaagtctgggggaaagtattgcttcctcccattggttcctgatcttagtgctatctgagcagaggacagctcaccaaacactgagcaaaggctcctgcttgtttgacagagatgtgacagggagcgttaacaagttaggttgtaagctgggttttgtgtgacagttaagaaattgtcagacaatgctatggtctagaaactgggacaaatttgttgattttgcatttcaattttttaaactcttgattttgatatatttccaaacttaaaaaaaaaatgaccagaatagtttaatctcgtatatcctttacccagatccactcattgtttacatgttaccccatttgctttatttgctctctttccctaaccacttgggagtatttactttcagtttaaagtgtcatgaaattatttttgtacaaattatggcattgtagtgtcaaaatctcaaaaggtgttttgctgcctttctacatgcaaattgtttacaatttatgtcttgggctagttacagatagaagttctgtgaaactggaaagtccaggcacaccactctagagctctgattctggaggctggtgctacagaacctagagatgttttgtggatgacttaatgggatcataggatattagtgcttgttcaaatcttttacttactggttaaatatacaggctttgaagtctttgatgtgaccttagggaaacttatttatttatttttgcacctcggttacttcatctgtaaaatggaatattacctatctcatgttgtgaaggtctactgtgatagtcaaaccaggtgcatgtaaagaattgtttagcacagagtctagcacactgaaaggtgcccaataaatgtcagcttatttttgttacggaagaagaaattggggttcagagagactaagtggctcacctctggtcagatggttaattagctgcagggccagaacccaggttctgggctctttctgtgaggggatgaggggctcctgccagtttggatcgtggctaaaaggcttggataagaaggaggccagcacgataggaacatatgacaccgtgggtgtgattagcgtaaggaaagacagaggtatttattggggaggagatgtggcttctgctcctgccatcatgctgcagagtgaatgacacctcctagctaccccaaaagaatggactgaaacagagctgcaaacctaccctgcaatcagggacttttggggacctcctggtgatcaccaggagggaaccacatatgaagaagtgcgtgtaagaatcaggaatctcctcccaactcaacttcccagtgtgattgcaggttccacacacaggcgtccctgggcattccagggtggcacatgtctcaccttgagtgatggtgatgttcacagtctctgaagacacatttttactcccaaaaagccccctgcagaagtaggagccgctgtctttgagtgtggcttttggaatgtagaagtcagaattatgatgaaaatacttcctgcctttgccattctgtaaatatgtgaccttatgcagagcagtgttcttccagctgtgacacctcaggtgaatagggtcttcctccttgaacacccaccgaggggcctggagcaacagccagcctgaaagacacagacaccccaggcccgggaggcctcagctctcagtgcagagctttgtgaaggggccacgtaccacccagatcctgagacataagggaaagccagattgggagtcaaccctgcatagctccctttggggaagagctgatggggccctgcaagagaactgaagtcataccaagacctttgtctaatggggaagagggacacacacacatgtgatcaacacacagggttagagcagagggactaagcaatgaggtaagtgagaagcaacgatgagcatatctgcaggatccttaagtgctagacttagatttgctgtggcaggtgacaaggattcacagtaagttctagatcagagtaaaaattgcatttgaaaatgatgaattgccctattagaggaaaaggtagatttcagaaggaataggcaatcaaaggaatattgaaagactcttgtggcagtcaggaataaggtgacggtggccacggagtggctgcagaaattgtgaaggagaactcaatgtaaacaccagggaggggaagggcgggactggtattgctcagcctggcaattcgtggtttctaaggtgtcacagggcctcggtgagaccaactttattactgagcatggccttcaagagaggaaattcttgtatcgccagagcttattctcacgatcatgtcaccaagtaatttactgagcatggccttcaagagaggaaattcttatatcgccagagcttattctcacgatcatgtcaccaagtaatcagacttcacaaagagagaacatgaggtcatggtcgggaaagggcctgaataattaaaaaataatgatgttataggtaagtattataatggcataagaaaatattcatgagacaattttaagttaaaaaagcataatacttcaaatattttaaaaagtattatgcacagaaaaaagaaggatatgcacttacatattaacaggggttttctctgaaggagtgggactgaaggacattttaaatttctcctgtttacttttatatatttttgaaattgaccccaaatgacttttgtaataagaacaaaacaaaatttacaataattttattttttaaatctacattctcagcttgaattactataatttaaaaaatctactacctgatgctaaacaaaattggtaggacgtgtgttggtcatgattctctaccacaaagatttgccaaacagaaagtaatcttcattacctattaagagatatcatttatcaaaagaagccatgtgcctatctatccacttactttttcagcagagagatgaatcattattagcataaagtcatggttagtatatagtctggtggcctttggaggaacattcttgttcgaatctatcctgtcatggacccagtgaatgtccatatgtatattccttcaagtgatatttcatcaagcactcactatgtatgacacactgtggactggagatacccagatgatgggacatatagttctcagcctcaaagaatctacagtctagacatagaaacataaatattcagaaataatcacaatacaatatgacaagtgctacaacaggctaagaataaaggactgcggggctgactagattggaataaagaaattctgcctgaaagaagtaaaaaatgcaggctgggcgcggtggctcacatctgtaatcctagtactttgggaggccgaggtgggcagatcatgaagtcaggagatcaagaccatcctggctaacgctgcgaaaccctgtctctactaaaaatacaaaaaattagccgggcgtggtggcatgcacctgtagtcccagctacttgggaggctgaggcaggagaattgcttgaacccgggaggtggaggttgcagtgagccaagattgcgccactgcactccagcttgggtgacagagagagactctgtctcaaaaacaaaaacaaaaacaaacacaaacaaacaaacaaaaaaagaagtaaaaaatgcttctcagaggaggacataagtgaaatgggtcctaaaggattaaaggatgctcagaagtttacctggtgaagctaattctcatggtcacagtttaatatagccttgattggctagacttctaaagccagtttctagagccaagttcaaggcaaactagtaactcttagacttgatttttctattgctttctcttggtaattcccccattttatttggttgtaggtggacatctcttacctagctagaaatggacatatcttcttgtagctctggagagtgaagaccatgtcagttgagtggtactgtcagaggccaaagagccacaaaaatcagtttcagaggcccaattccatggagctctcttgcagatccacctccttatgcccttcttcccccaaagcttgttccacccataaacattgtatgaatggaacagccgtggaagtagagttaggtttgcagggcgacactgcagggaccagcctatgtggtaagattgtagggacaccaggaaagacctctgccttcaaaatatttctcctacctgtgtctgacgtctatattctgttaatagtacacaagaactttcatgtcatgattaatgtgcaggctgaacatgtatctgcctctattggaagagctatcacattaccaaatttatgcttaattataggtttgagtatagcattgatgaggagacagaaagatatgatgctaggccactaggattgctttgggaggtggcttagggcattacatgtctgagagcgagaaggagattgaggtcctaacaccaaattcattaatttattcaataaatattattggccaggtgtggtggctcacgcctgtagtcccagcactttgggaagccaaggctggtgaatcacctgaggtcaggagtttgagaccagactgaccaacatggtgaaaccctgtctctactaaaaatacaaaaattagctgggcgtggtggcgggtgcctgtaatctcagctactcgggaggctgaggcaggagaatcactacaacccaagggggcagaagttgcagtgagctgagattgccgcattgcactccagcctgggtgacagagtgatactctgtctcaaaaaataaaattaaaaaaaatgaaaataaatatataaataactattattgagcatctatgccatggcctaaccttcacatgacacattcacattgtatgcactccatatggggattcttggaattgtgcaatgcagcagtcctatatctactgtctgacaggctttgacattttgcccaagacctacttagagctaggactacaactctgataccattcagtgggaccacacatcatctcatcttagcttttatctctaagaatatcatctctggctcttaccaagtatttcaggaccctttgtttcaccctttattggtgattttcctcttccccttcatcaactcaccgatatggacttctagctgcaccgggtcactgagggtggagaggtttgtctggcacctgtactctccactgtcgtcgactgtggcagcgtcaatgaagtagctcgaggcctggcttgagatgaggctctcattgtgaaaccactgtgtggaattgtcctcaggggagtaggctccctggcacttcagagtcacactgtccttctcgagcaccctgtaccattgaggctccaggaacaccacagcctttgggagatcttctgaggagccaagataatgtggggtgaggacagggagaggagcaggctctacactgccattcccagggagcctcaaagccagaatgagctcattgcaaacccatgcttggtggctcagtcttagagcatcttggccccatttttggcctgttcagtatcttaaggaaagctggccagagaagcacagggccaagttctgctgtgttggaggaactatccctgctaaccccacatcagcattttcccattcaacaagcatttcccaatatcttatggcctttgtccccatatgtgccccactgggtcaatccaagaccatgaagctgactcaccagtccgcatgccagctgaaactgcaagaaaaaagataaatcaaatattgagtaggggcagagatcagagtgattagaacatagagtgagtttaaaactcccctgccctcctctgccccaggagcccaattttcccaagaatcaggatgtttctggtggaaaccttgctacctgctctctggtctccactgttcatgcctcttgcgccactgtcaacacaaatccctattttcaacactgctcccttaccccttgctccctgtgcaaactcacaaattaagggtacaggttgaatttccctgaaccaagctacagaaagagcctcaacccatatccccacaagaaagggtagaaattgaaaatcatagaggagaaccctggaatgtcaaactgaaagagacagaccctagggaccatctagtcgaagctctttggttccacagagtgattctgggacccagaggggtgaagtgactggcctcactcatgagtatgccccaattggaaccagcattctcctcatttctagccccatcttggcttgtcctaggagctcaatccacagctatagatgtggtgaggggtcccatcccttcgtgggagtctcattcgtagcctgaaaaggggtctctgctgaacccaaggcatctcaaacttctccctcaaccagggagaccctgacttacctagaagtagcagagcagttgggaggagcagctgccacatgatgccacactggagtggacaagtcaccaaagatatccggagccctaaagggaccaaaccgactagacaggaggaagtaaacagcctttccccagcccctccacccatctctgtcacccaccaatttccttttcttgaaacttcatctgacttctcagtctgaagtctggcaagggagccccaccatagaacaggaccaggaaggaaagagcctggaggcaaggtgggtgggtctgccccctttactccctcaaaggtctgtggctgagcatctgaggacacacacagaatctgccagagtgtgccctcagccatcccaggatgcttgccccatctcctggatttggatccacccagcaccaagaatgggacagtgagaccctggggatgagattcaaggtgggaggagcattctctgagggcttccttcatttcacctcagaacttgtcactctcctgcctcgcccagacccatctatctccagctgaggccctgcctgcacacagaaagtggtcctttcaaatcttcagaccactagcagtgtctctgcctcaatattatctccacgcagaatttctttcaaaattcaaaattcaaaatctatatgctcctgggatatgtaatccacaggagctactgactttttagtgtgatttgatcattagatttccaggttagaagaaacccaggtagggtagagaaatgggccctggaagaacaagtcaccagcgaaaggctgaaaagatcacagaaaaggtgggggtggggaggggcgaggacaggaactctttaccttcctcgtgttacccaggtcctgcggatttagctcaggcccctccgggccactggatctgggctggtctgtcagcctaggagccggggctcc

SEQ ID NO: 1710 - DNA, 8863 bp, Homo sapiens; identical to SEQ ID NO: 1709
  source 1..8863: mol_type = genomic DNA

SEQ ID NO: 1711 - DNA, 8863 bp, Homo sapiens; identical to SEQ ID NO: 1709
  source 1..8863: mol_type = genomic DNA

SEQ ID NO: 1712 - DNA, 5715 bp, Homo sapiens
  source 1..5715: mol_type = genomic DNA
ttgaaagggctaaaatgattttatttttaaatgtggacaggcaagcagaggtggttggcaaaggcaaggtggctgacgatccggaagctgtacaggagagataagggcactggctgccagagtgccctatcgaagcatcatccgaaccctgcggtaggggtggcccacaccacggcctgaggcccagtcaatgccatatttgtgggcggcagcctcagacactgcatagcgaccattgagatttgatcggtaacaggatgcataccaccaggcaccgtggacaatcactgcacagttgctgttgcttgaatcgtggtcagcgtcataggtggtaaagggcctcccactgtggaggctcagggaatcccctagcagggaagggatggaaagcaccttggtgcccagcaccacgcctggcacctttggagatataatgccatgggagtctcagagcaactaagagttgaattttatcaggccccacgagcaacaccaaggggccaggttgtttgcgcagggttactcggctggttgaagcagcggcaggacttgaactcgggactgtctggctccaaagctcccagcttttccccctgtcttaccccctccagaatccccggcccccctctagctcctttgtcttctctcagctcccatccagtctgagcaactctgctaggaaaagctgggaggaacctcttaggtgcctggccaggaaaggtggttccctgaggcactccctcataaccacttccctcttttaaatctctccccaatagtcactgtttctctgaaagaagacttccgtggttcctcttccaaagcagagaacactaacactcaacagagcctcaggcggcacccaaaacttcctccttgcctccctgcgctccccccgcctttttttttttttctgagatggagtctcgctctgtcgcccaggctagagtgcagtgacactctcttggctcgctgcaacctctgcctcccagatttaagtgattctcctgcctcagcctcccgagtagctgggattacaggcaccctccaccacgcccggctaatttttttgtatttttagtagagacggggtttcaccatgttggccaggttgggtttgaactcctgacctcaagttatctgcccgcctcggcctcccagagtgctagggttacaggcatgagccaccgtgcccggcctccctgcccattttatagaggaggaaactgaggctcagtggaggggtaggacttgcccaaggtcacataagtactaaatggcagagatggattcaaactcaggtctgtttgcctccagatcccaaattcttcactgttgcaccatcctgtttcatgattgccatttctcagatgcggaaactaaggcccacagaggagacaggattgccctgggtcattcatgggggcagtggcagcactgggaaaggatccagcctccttcctctgctccccttaggctcactcacctgcagtgccctctgagaacttgcccagtgccagctggtagtggtctacctcaccgaggaggcggaaggtcgcatagtgggcgaaagtacggttaccattaaagtcttccagctctacccgcagctcccagttacctggaaagaaggggaggcagggatggaggaatcctcagttcttgggggtggggcagggattcaggatggcagacagtaacccccagactccaggaccctgctgggaactcaccctggagagtaagctggtgcaaattctcatttcccagccagaattcagactcttggttcccaaaacctgctctgtaggaggaccaagagcggaagaaatccacagaaccatcctggcgcctctgaaacacctgggggagggggggcacagcagctattactccaggctgggcactggcagctgagggtgcaggaactgtgaggggtgggtggatacccactctctctttggattggggcctgttgataaaatggggatccttcaagttagctttgaatatttctatgaactctacattcccttgttaacttttactgacactcaacttcatgccacagccttgcaagccctgggaagactgaattgacaaaacactgtccccacccacaggagatggccagcgctgctgggtgtcagtcaaaataacccaatttcatttactataagaaccaagaacgcttggtggctcatgcctgtaattccagcactttgggaggccgaggcgggtggatcacttgaggtcaggagtttgaaaccagcctggccaacatggtgaaatcccgtctctactaaaaatacaaatattagccgggtgtggtggctcacacctgtagttccagctactcaggaggctgaggcacaagaactgcttgaacctgggaggtggaggttgcagtgagccgagatcacaccactgcactccagcctgggcagcagagcaagactccgtctcaaaacaaacaaacaaacaaaaaaaccaagatattttacattagagaggccactcccacagcccaagctggacccctggccttaccctgatgtcttccacctccccctccaagccaagtaggccccaggtcctatagagttgtcaacctaagtacttctatttccattgctccactgtcttattttatttatttatttttttgagatagagtctcaccccctgttaccaggctggagtacagtggtgtgatctcggctcactgcaacctctgcctccctggttcaagcaattctcgtgccttagctttctgcatagctgggattacaggcacctgccaccacgcccagctaattttttgtatttttagtagagatggggttttgccatgttgcccaggctggtcttgaactcctgagctcaggcaatccacccacctcggcctcccaaagtgctgggattacaggtgtgagctactgtgtcaggcctgctccactgtctttactgcctggctccttgctgtcttcctaaaccatgtccctgcctccactggtcccccaatgcagtgcatctttcatggtgtagcccgaatcatctttttaaaacagaagttctacttggcccctcccctgcttaaaactctcctggggctacccattgccctgcacactcttcttttttttttttttttttaagacagagtctcactccgttgcccaggctggagtgcagtgactcaatcttggctcactgcaaccaccacctccggggttcaagcaattctcccagctcagcctcctgaataacttggattacaggcgcccaccatcacgcctggctaatttttatatttttagtaaagatggggtttcaccatgttggccaggctgatctcgaactcttgacctcaggtgatctgcccgccttggcctcccaaagtgctgggattataggcgtgagccaccacgtccagccaaccaccgcgtctgggcgcgctgcacacttcttaagttgatcatttagtgccttccatgaactggcctttacagaggtcctcaatccatgttccgtcagtgccggcagactttagccgacacccacgcctgctctcagctcactcacgcgttccctgcaaaccttttactctgctgcctccctgagtttatctttacttctagctggaatgcccctccctaccctatttttttttttttttttttttgagacagagtttcactcttttcacccaggctggagtgcaatggcaagaactcggctcactgcaacctccacctcctgggttcaggcaattctcttgcctcagcctcccaagtagctgggattacaggcgtgagctactgcactcaacttaaggtcttttcaaaaggcacctcctctgtgaagccctcatacttcttcaggtcccattgggggctcactaaacatttgtcagtgaattcctctaggaaatgccttgctctggtgggttctggctcccctaggggccaagggggagaagtgaccagtgggcctggcctgttagcccatttctcagacactcaccagccagccgcccccctcggtgtccatgtcacaaaagactgggagggccctgccctcaggtaggcacagatggtaccagccgctcaaggtggcgccctggctcaacagctcccggcagtttctggggcctgggaaaggggagatggactggggtggtgcccaggttattccctgacccccacccccaggcactggaacaagtgtgggaccctagggaccctcttggctccttcaggtccctgaagaagggttctgaggaggctgtggggaggatcttggccacacttgggggtctgccaacacccaacaccatgtgatcccaagttcctggctcctgcaagggctgcctcaccttcctggcaccggagcaggttcactggatctcctgccccagagaagggatgagtgttggctctgatgtctcagcaccccagcgctgagccaccagtggagccggtacccaggcccttttccgaatccttcccactcctcccagccttccataccctgtaggagggccatcatagggtacccaggcccttctcctaatcctctccactcctcccagccttccaaaccctgtaggagggccttcatagggtacccaggcccttctcctaatcctccccactcctcccagccctccatccccaataggagggccatcatagggtagccaggcccttctcctaatccttcccactcctcccagccatccattcccctgtgagagagccatcataggcacagcagccaagcagagatcccaccctagagtccagggacagaggcaaagaaagcggggaggcctccagccccacttactcacctggctcacccttggggcccatcttgcctggtggtccaggtggccctgaaatcacaaaggcagagatttcctgagtcccaccccatgcccaggaccaaaaagaaacaagagacttggagccagaggttcaaatcccagtttcacccttcactcactttgtgattgcgggcaaatatcttatcctctctgaacctccctttcctcctcagcagaatggggatgaaaccacttacctggcagagttgatcttaggatgccgggtgcccagcctggagctggcacagagtaggttccttgctcctttgtcgtggcccctcagcacagacaaaaattgctactttcctgccttccccattcccaagatcccagcccgctccccagcccctctcaccttgaggacctggggctcccttctccccaggacttcctggagctccgggacaactgggcaggaggacaactttgctggcttccagttccctgggtcctacagggagacacaggcagggtgggcacagggtagactgtctcttccagacccctcttcagttctcttcctgtctcccagattcccactgtcaggatgcttgtctcctgagctggcaaggtttcgtgtgctttgcatccatttgcatatatttacatgcagagcccagattatgaaactcccaccctgctccttgaggttgatgagccttggtggggggacacccagcgagggaatgaggagtgggttggtgaggagggcaccctaggtgcccacctgggcagctggggtgttcctgggtcttcaggcaggcaggccccccaagcaggagaagccacagggagggcaggatccacagtagatccatcttgct

SEQ ID NO: 1713 - DNA, 5715 bp, Homo sapiens; identical to SEQ ID NO: 1712
  source 1..5715: mol_type = genomic DNA
